United States Patent 12,508,308 (INFLUENZA mRNA VACCINES) - sequence listing, part 34

SEQ ID NO: 129325 - RNA, 1701 nt, Artificial Sequence; identical to SEQ ID NO: 125038
  derived and/or modified sequence opt3 from hemagglutinin__InfluenzaA__AEO01209

SEQ ID NO: 129326 - RNA, 1701 nt, Artificial Sequence; identical to SEQ ID NO: 124685
  derived and/or modified sequence opt3 from hemagglutinin__InfluenzaA__AEO01210

SEQ ID NO: 129327 - RNA, 1701 nt, Artificial Sequence; identical to SEQ ID NO: 125038
  derived and/or modified sequence opt3 from hemagglutinin__InfluenzaA__AEO01211

SEQ ID NO: 129328 - RNA, 1701 nt, Artificial Sequence; identical to SEQ ID NO: 124685
  derived and/or modified sequence opt3 from hemagglutinin__InfluenzaA__AEO01212

SEQ ID NO: 129329 - RNA, 1701 nt, Artificial Sequence; identical to SEQ ID NO: 124685
  derived and/or modified sequence opt3 from hemagglutinin__InfluenzaA__AEO01213

SEQ ID NO: 129330 - RNA, 1701 nt, Artificial Sequence
  derived and/or modified sequence opt3 from hemagglutinin__InfluenzaA__AEO01214
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucgcuccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacgagaucacgaauaaggucaacucugugauagagaaaaugaauacccaguuuacagccguugguaaggaguucaaccaccuggaaaagcggauugaaaauuuaaacaaaaagguggaugacggguuccuggauaucuggacuuacaaugcagagcuccuuguccuguuggaaaacgagcgcacccuagacuaucaugauagcaaugugaaaaaccuguacgagaagguacgaucacagcucaaaaacaaugccaaggaaaucggcaacggauguuuugaguucuaucacaagugcgacaauacauguauggaaaguguuaaaaacggcacuuacgauuauccuaaguacuccgaggaagcuaaacugaauagagaggagauugacggggugaaacuugaaagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 129331 - RNA, 1701 nt, Artificial Sequence; identical to SEQ ID NO: 125038
  derived and/or modified sequence opt3 from hemagglutinin__InfluenzaA__AEO01215

SEQ ID NO: 129332 - RNA, 1701 nt, Artificial Sequence
  derived and/or modified sequence opt3 from hemagglutinin__InfluenzaA__AEO01216
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcgggucgagaauuuaaacaaaaagguggacgauggguuccuggacauuuggacuuacaaugccgaacuccuuguacuguuggagaacgagcgcacccuagauuaucaugacagcaauguuaaaaaccuguacgaaaaggugcgaucacagcucaaaaacaaugcaaaggagaucggcaacggauguuuugaguucuaucacaagugcgauaauacauguauggagagugucaaaaacggcacuuacgacuauccuaaguacuccgaagaggccaaacugaauagagaggaaaucgauggggugaaacuugagagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 129333 - RNA, 1701 nt, Artificial Sequence; identical to SEQ ID NO: 125038
  derived and/or modified sequence opt3 from hemagglutinin__InfluenzaA__AEO01217

SEQ ID NO: 129334 - RNA, 1701 nt, Artificial Sequence; identical to SEQ ID NO: 125038
  derived and/or modified sequence opt3 from hemagglutinin__InfluenzaA__AEO01218

SEQ ID NO: 129335 - RNA, 1701 nt, Artificial Sequence; identical to SEQ ID NO: 125038
  derived and/or modified sequence opt3 from hemagglutinin__InfluenzaA__AEO01219

SEQ ID NO: 129336 - RNA, 1701 nt, Artificial Sequence; identical to SEQ ID NO: 124776
  derived and/or modified sequence opt3 from hemagglutinin__InfluenzaA__AEO01220

SEQ ID NO: 129337 - RNA, 1701 nt, Artificial Sequence; identical to SEQ ID NO: 124685
  derived and/or modified sequence opt3 from hemagglutinin__InfluenzaA__AEO01221

SEQ ID NO: 129338 - RNA, 1701 nt, Artificial Sequence; identical to SEQ ID NO: 124685
  derived and/or modified sequence opt3 from hemagglutinin__InfluenzaA__AEO01222

SEQ ID NO: 129339 - RNA, 1701 nt, Artificial Sequence; identical to SEQ ID NO: 125038
  derived and/or modified sequence opt3 from hemagglutinin__InfluenzaA__AEO01223

SEQ ID NO: 129340 - RNA, 1701 nt, Artificial Sequence
  derived and/or modified sequence opt3 from hemagglutinin__InfluenzaA__AEO01224
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccaccgaacggaacgcagggagcggaaucauaauuucggauacaccagugcaugacugcaauaccacgugucaaacuccgaaaggcgcuaucaacacaucucuccccuuccagaauauucacccuaucaccaucgguaagugcccaaaguauguaaaauccacuaagcugcgccuugccacagggcugagaaacgugcccucaauucagaguaggggauuguuuggcgcgauagccggcuucaucgaagggggauggaccgguauggucgacggcugguacggguaucaucaccagaaugaacaaggaagcggcuacgcagcugaucucaaauccacgcagaacgccauugacgagaucaccaauaaggugaacucuguuauagagaaaaugaauacacaguuuacugcuguggguaaggaguucaaccaccuggaaaagcggauugaaaauuuaaacaaaaaggucgaugacggguuccuggauaucuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuauccuaaguacuccgaggaagccaaacugaauagagaggagauugacggggucaaacuugaaagcacaaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 129341 - RNA, 1701 nt, Artificial Sequence
  derived and/or modified sequence opt3 from hemagglutinin__InfluenzaA__AEO01225
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggaccguggucgaacccggugacaagauuacauucgaggccacuggcaaccugguugugccuagguacgcuuuugccauggaacggaacgcagggagcggaaucauaauuucggauaccccaguacaugacugcaauacaaccugucaaacgccgaaaggcgcuaucaacacuucucuacccuuccagaauauucacccuaucacaaucgguaagugcccaaaguaugugaaauccaccaagcuccgccuggccacugggcuuagaaacguccccucaauucagaguaggggacuguuuggcgcgauagccggcuucaucgaagggggauggacagguaugguggacggcugguacggguaucaucaccagaaugaacaaggaagcggcuacgcagcugauuugaaauccacccagaacgccauugacgagaucacgaauaagguuaacucugugauagagaaaaugaauacccaguuuacagcugucgguaaggaguucaaccaccucgaaaagcggauugaaaaucugaacaaaaagguggaugacggguucuuagauaucuggacuuacaaugccgagcugcucguacuucuggaaaacgagcgcaccuuggacuaucaugauagcaauguuaaaaaccuauacgagaaggugcgaucacagcugaaaaacaaugcaaaggaaaucggcaacggauguuuugaguucuaucacaagugcgacaauacauguauggaaagugucaaaaacggcacuuacgauuauccuaaguacuccgaggaagccaaacucaauagagaggagauugacggggugaagcuggaaagcaccaggaucuaucaaauucuugcuauauacucuacagucgcgucaagucugguguugguugugagccucggagcaaucuccuuuuggaugugcucuaacgguucgcugcagugccggauuuguaucuga

SEQ ID NO: 129342 - RNA, 1701 nt, Artificial Sequence
  derived and/or modified sequence opt3 from hemagglutinin__InfluenzaA__AEO01226
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgaugggagcggaaucauaauuucggacaccccagugcaugacugcaauacaaccugucaaacgccgaaaggcgcaaucaacacuucucuccccuuccagaauauucacccuaucacaaucgguaagugcccaaaguauguaaaauccaccaagcugcgccuugcuacugggcugagaaacgugcccucaauucagaguaggggauuguuuggcgccauagcgggcuucaucgaagggggauggacagguauggucgauggcugguacggguaucaucaccagaaugaacaaggaagcggcuacgccgcagaccucaaauccacccagaacgcuauugaugagaucacgaauaaggugaacucuguuauagagaaaaugaauacccaguuuacagccguggguaaggaguucaaccaccuggaaaagcggauugaaaauuuaaacaaaaaggucgacgauggguuccuggacaucuggacuuacaaugcugagcuccuugugcuguuggaaaacgagcgcacccuagauuaucaugacagcaauguaaagaaccuguacgagaagguucgaucacagcucaaaaacaaugccaaggaaaucggcaacggauguuuugaguucuaucacaagugcgauaauacauguauggaaagugugaaaaacggcacuuacgacuauccuaaguacuccgaggaagcaaaacugaauagagaggagauugauggggucaaacuugaaagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 129343 - RNA, 1701 nt, Artificial Sequence; identical to SEQ ID NO: 126852
  derived and/or modified sequence opt3 from hemagglutinin__InfluenzaA__AEO01227

SEQ ID NO: 129344 - RNA, 1701 nt, Artificial Sequence; identical to SEQ ID NO: 124685
  derived and/or modified sequence opt3 from hemagglutinin__InfluenzaA__AEO01228

SEQ ID NO: 129345 - RNA, 1701 nt, Artificial Sequence; identical to SEQ ID NO: 124685
  derived and/or modified sequence opt3 from hemagglutinin__InfluenzaA__AEO01229

SEQ ID NO: 129346 - RNA, 1701 nt, Artificial Sequence
  derived and/or modified sequence opt3 from hemagglutinin__InfluenzaA__AEO01230
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaagcacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccaaggaggccaaacugaauagggaagagauugacggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 129347 - RNA, 1701 nt, Artificial Sequence; identical to SEQ ID NO: 124685
  derived and/or modified sequence opt3 from hemagglutinin__InfluenzaA__AEO01231

SEQ ID NO: 129348 - RNA, 1701 nt, Artificial Sequence; identical to SEQ ID NO: 125038
  derived and/or modified sequence opt3 from hemagglutinin__InfluenzaA__AEO01232

SEQ ID NO: 129349 - RNA, 1701 nt, Artificial Sequence; identical to SEQ ID NO: 124685
  derived and/or modified sequence opt3 from hemagglutinin__InfluenzaA__AEO01233

SEQ ID NO: 129350 - RNA, 1701 nt, Artificial Sequence; identical to SEQ ID NO: 124685
  derived and/or modified sequence opt3 from hemagglutinin__InfluenzaA__AEO01234

SEQ ID NO: 129351 - RNA, 1701 nt, Artificial Sequence; identical to SEQ ID NO: 124685
  derived and/or modified sequence opt3 from hemagglutinin__InfluenzaA__AEO01235

SEQ ID NO: 129352 - RNA, 1701 nt, Artificial Sequence; identical to SEQ ID NO: 128557
  derived and/or modified sequence opt3 from hemagglutinin__InfluenzaA__AEO01236

SEQ ID NO: 129353 - RNA, 1701 nt, Artificial Sequence; identical to SEQ ID NO: 124685
  derived and/or modified sequence opt3 from hemagglutinin__InfluenzaA__AEO01237

SEQ ID NO: 129354 - RNA, 1701 nt, Artificial Sequence; identical to SEQ ID NO: 124685
  derived and/or modified sequence opt3 from hemagglutinin__InfluenzaA__AEO01238

SEQ ID NO: 129355 - RNA, 1701 nt, Artificial Sequence; identical to SEQ ID NO: 124685
  derived and/or modified sequence opt3 from hemagglutinin__InfluenzaA__AEO01240

SEQ ID NO: 129356 - RNA, 1701 nt, Artificial Sequence; identical to SEQ ID NO: 125038
  derived and/or modified sequence opt3 from hemagglutinin__InfluenzaA__AEO01241

SEQ ID NO: 129357 - RNA, 1701 nt, Artificial Sequence; identical to SEQ ID NO: 124685
  derived and/or modified sequence opt3 from hemagglutinin__InfluenzaA__AEO01242

SEQ ID NO: 129358 - RNA, 1701 nt, Artificial Sequence
  derived and/or modified sequence opt3 from hemagglutinin__InfluenzaA__AEO01244
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgaggacaggagggucguaugaauuacuauuggacccugguggaacccggcgauaaaauuacauucgaggccacugggaaccuagucguuccuagauacgcuuuugccauggaaaggaacgcaggaagcggcaucauaauuucggacaccccagugcaugauugcaauacaaccugucaaacgccgaagggugcuaucaacacuucucuccccuuccagaauauucacccuaucacaaucgggaagugcccaaaauauguaaaguccaccaaacugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaccucaaguccacccagaacgccauugaugagaucacgaauaaagugaacucuguuauagagaagaugaauacccaguuuacagcuguggggaaggaguucaaccaccuggagaaaaggauugaaaauuuaaacaagaaagucgacgauggcuuccuggacaucuggacuuacaaugccgagcuccuugugcuguuggaaaacgagcggacccuagauuaucaugacagcaauguaaagaaccuguacgagaaaguucgcucacagcucaagaacaaugcaaaggaaaucggaaacggcuguuuugaguucuaucacaaaugcgauaauacauguauggaaagugugaagaacgggacuuacgacuauccuaaauacuccgaggaagccaagcugaaucgagaggagauugauggagucaaacuugaaagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 129359 - RNA, 1701 nt, Artificial Sequence; identical to SEQ ID NO: 124685
  derived and/or modified sequence opt3 from hemagglutinin__InfluenzaA__AEO01245

SEQ ID NO: 129360 - RNA, 1701 nt, Artificial Sequence
  derived and/or modified sequence opt3 from hemagglutinin__InfluenzaA__AEO01247
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaauccucauaucggauaccccagugcaugacugcaauacaaccugucaaacgccgaaaggcgcuauuaacacuucucugcccuuccagaauauccacccuauuacaaucgguaagugcccaaaguauguaaaauccaccaaacuucgccuggccacuggguugagaaacgugcccucaauccagaguaggggacucuuuggcgcgauugccggcuucauagaagggggauggacagguauggucgacggcugguacggguaucaucaccagaaugaacaaggaagcggcuacgcagcugaucugaaguccacccagcacgccaucgacgagauuacgaacaagguaaauucuguuaucgagaaaaugaacacccaguuuacagcuguggguaaggaguucaaucauuuagaaaagcggauagaaaaccugaauaaaaaggucgaugacggguuccucgauauuuggacuuacaacgccgagcuucugguguugcuagaaaaugagcgcacccuggacuaucacgauagcaacgugaaaaaucucuacgagaagguucgaucacagcugaaaaacaacgcaaaggaaaucggcaauggauguuuugaguucuaucauaagugcgacaacacauguauggaaagugugaaaaauggcacuuacgauuauccuaaguacuccgaggaagccaaacuuaacagagaggagaucgacggggucaagcuggaaagcaccaggauuuaucaaaucuuggcuauuuacucuacaguggcgucaagucucguccuggugguuagcuuaggagcaauauccuuuuggaugugcucuaaugguucgcugcagugccggaucuguauuuga

SEQ ID NO: 129361 - RNA, 1701 nt, Artificial Sequence; identical to SEQ ID NO: 124685
  derived and/or modified sequence opt3 from hemagglutinin__InfluenzaA__AEO01248

SEQ ID NO: 129362 - RNA, 1701 nt, Artificial Sequence; identical to SEQ ID NO: 124685
  derived and/or modified sequence opt3 from hemagglutinin__InfluenzaA__AEO01249

SEQ ID NO: 129363 - RNA, 1701 nt, Artificial Sequence
  derived and/or modified sequence opt3 from hemagglutinin__InfluenzaA__AEO01250
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgaggacgccuacguguucgucgggacuucucgcuauuccaagaaauuuaagccugagauugcgauccgaccaaaagugcgugaucaggaaggaagaaugaauuacuauuggacccugguggagcccggugacaagauuacauucgaagcaacuggcaaccuagucguuccuagguacgccuuugcuauggagcggaacgccgggagcggaaucauaauuucggauaccccagugcaugacugcaauacaaccugucaaacgccgaaaggcgcaaucaacacuucucuccccuuccagaauauucacccuaucacaaucgguaagugcccaaaguauguaaaauccaccaagcugcgccuugcuacugggcugagaaacgugcccucaauucagaguaggggauuguuuggcgccauagcgggcuucaucgaagggggauggacagguauggucgacggcugguacggguaucaucaccagaaugagcaaggaagcggcuacgccgcagaucucaaauccacccagaacgcuauugacgagaucacgaauaaggugaacucuguuauagaaaagaugaauacccaguuuacagccguggguaaggaguucaaccaccuggaaaagcggauugagaauuuaaacaaaaaggucgaugacggguuccuggauaucuggacuuacaaugcugaacuccuugugcuguuggagaacgagcgcacccuagacuaucaugauagcaauguuaaaaaccuguacgaaaagguacgaucacagcucaaaaacaaugccaaggagaucggcaacggauguuuugaguucuaucacaagugcgacaauacauguauggagagugugaaaaacggcacuuacgauuauccuaaguacuccgaagaggcaaaacugaauagagaggaaauugacggggucaaacuugagagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 129364 - RNA, 1701 nt, Artificial Sequence; identical to SEQ ID NO: 126282
  derived and/or modified sequence opt3 from hemagglutinin__InfluenzaA__AEO01251

SEQ ID NO: 129365 - RNA, 1701 nt, Artificial Sequence; identical to SEQ ID NO: 124685
  derived and/or modified sequence opt3 from hemagglutinin__InfluenzaA__AEO01252

SEQ ID NO: 129366 - RNA, 1701 nt, Artificial Sequence; identical to SEQ ID NO: 124685
  derived and/or modified sequence opt3 from hemagglutinin__InfluenzaA__AEO01253

SEQ ID NO: 129367 - RNA, 1701 nt, Artificial Sequence
  derived and/or modified sequence opt3 from hemagglutinin__InfluenzaA__AEO01254
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaauaacaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaccuguacgagaaaguucgaucacagcucaagaauaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129368 - RNA, 1701 nt, Artificial Sequence; identical to SEQ ID NO: 125132
  derived and/or modified sequence opt3 from hemagglutinin__InfluenzaA__AEO01256

SEQ ID NO: 129369 - RNA, 1701 nt, Artificial Sequence; identical to SEQ ID NO: 128104
  derived and/or modified sequence opt3 from hemagglutinin__InfluenzaA__AEO01257

SEQ ID NO: 129370 - RNA, 1701 nt, Artificial Sequence; identical to SEQ ID NO: 124685
  derived and/or modified sequence opt3 from hemagglutinin__InfluenzaA__AEO01258

SEQ ID NO: 129371 - RNA, 1701 nt, Artificial Sequence; identical to SEQ ID NO: 129367
  derived and/or modified sequence opt3 from hemagglutinin__InfluenzaA__AEO01259

SEQ ID NO: 129372 - RNA, 1701 nt, Artificial Sequence; identical to SEQ ID NO: 127240
  derived and/or modified sequence opt3 from hemagglutinin__InfluenzaA__AEO01260

SEQ ID NO: 129373 - RNA, 1701 nt, Artificial Sequence
  derived and/or modified sequence opt3 from hemagglutinin__InfluenzaA__AEO01261
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgcauggccacugggcuuagaaacgugcccucaauucagaguaggggacuguuuggcgcgauagccggcuucaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguuuacagcuguggguaaggaguucaaccaccucgaaaagcggauugaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaagccaaacucaauagagaggagauugacggggucaagcuggaaagcaccggaaucuaucaaauucuugcuauauacucuacaguggcgucaagucuggucuuggugguuagccucggugcaaucuccuuuuggaugugcucuaacggcucgcugcagugcaggauuuguaucuga

SEQ ID NO: 129374 - RNA, 1701 nt, Artificial Sequence; identical to SEQ ID NO: 124685
  derived and/or modified sequence opt3 from hemagglutinin__InfluenzaA__AEO01262

SEQ ID NO: 129375 - RNA, 1701 nt, Artificial Sequence; identical to SEQ ID NO: 126367
  derived and/or modified sequence opt3 from hemagglutinin__InfluenzaA__AEO01263

SEQ ID NO: 129376 - RNA, 1701 nt, Artificial Sequence; identical to SEQ ID NO: 125038
  derived and/or modified sequence opt3 from hemagglutinin__InfluenzaA__AEO01264

SEQ ID NO: 129377 - RNA, 1701 nt, Artificial Sequence; identical to SEQ ID NO: 124685
  derived and/or modified sequence opt3 from hemagglutinin__InfluenzaA__AEO01265

SEQ ID NO: 129378 - RNA, 1701 nt, Artificial Sequence
  derived and/or modified sequence opt3 from hemagglutinin__InfluenzaA__AEO01266
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacgcuccagugcaugauugcaauaccacaugucaaaccccgaaaggugccaucaacacgucucuccccuuccagaauauucacccuaucacuaucgggaagugcccaaaguauguaaaauccacaaagcugcgccuugcgaccggacugagaaacgugcccucaauucagaguaggggcuuguuuggcgccauagcaggguucaucgagggagguuggacuggcauggucgacgggugguacggauaucaucaccagaaugaacaaggcagcgguuacgcugccgaccucaaauccacacagaacgcuauugaugagaucaccaauaaggugaacucuguuauagagaaaaugaauacgcaguuuaccgccguggggaaggaguucaaccaccuggagaagcggauugaaaauuuaaacaaaaaggucgacgauggcuuccuggacaucuggacauacaaugcagagcuccuugugcuguuggaaaacgagcgcacucuagauuaucaugacagcaauguaaagaaccuguacgagaagguucgaucacagcucaaaaacaaugccaaggaaaucggaaacggcuguuuugaguucuaucacaagugcgauaauaccuguauggaaagugugaaaaacgggacauacgacuauccuaaguacuccgaggaagcuaaacugaauagagaggagauugauggagucaaacuugaaagcacuaggaucuaucaaauucuggcgauauacucuaccguggcaucaaguuugguccucgugguuagccugggugccaucuccuuuuggaugugcucuaacggcucguuacagugccggauuuguaucuga

SEQ ID NO: 129379 - RNA, 1701 nt, Artificial Sequence; identical to SEQ ID NO: 124685
  derived and/or modified sequence opt3 from hemagglutinin__InfluenzaA__AEO01267

SEQ ID NO: 129380 - RNA, 1701 nt, Artificial Sequence; identical to SEQ ID NO: 124685
  derived and/or modified sequence opt3 from hemagglutinin__InfluenzaA__AEO01268

SEQ ID NO: 129381 - RNA, 1701 nt, Artificial Sequence
  derived and/or modified sequence opt3 from hemagglutinin__InfluenzaA__AEO01269
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucgugauaucggacaccccaguacaugauugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugagcaaggaagcggcuacgcagcugaccucaaauccacccagaacgccaucgaugagauuacgaauaagguuaacucugugaucgaaaagaugaauacccaguuuacagcugucgguaaggaguucaaccaccuggaaaagcggauggagaauuuaaacaaaaagguggacgauggguuccuggacauauggacuuacaaugccgaacuccuuguacuguuggagaacgagcgcacccuagauuaucaugacagcaauguuaaaaaccuguacgaaaaggugcgaucacagcucaaaaacaaugcaaaggagauuggcaacggauguuuugaguucuaucacaagugcgauaauacauguauggagagugucaaaaacggcacuuacgacuauccuaaguacuccgaagaggccaaacugaauagagaggaaaucgauggggugaaacuugagagcaccaggaucuaucaaauucuggcuaucuacucuacagucgcgucaaguuuggugcucguugugagccugggagcaauuuccuuuuggaugugcucuaacgguucguuacagugccggauauguaucuga

SEQ ID NO: 129382 - RNA, 1701 nt, Artificial Sequence; identical to SEQ ID NO: 125849
  derived and/or modified sequence opt3 from hemagglutinin__InfluenzaA__AEO01270

SEQ ID NO: 129383 - RNA, 1701 nt, Artificial Sequence
  derived and/or modified sequence opt3 from hemagglutinin__InfluenzaA__AEO01271
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcgacauagccggcuggauccuggggaacccugagugugaaucuuugucaacagcaaguagcugguccuacauuguugagaccccaucuucggauaauggaacuugcuauccgggcgacuuuaucgauuacgaggagcucagggagcagcugucaagcgugaguuccuucgaacgguuugagauuuuccccaagacaucuagcuggccuaaccacgacuccaauaagggugucaccgccgcuuguccacaugcaggggccaaaucauuuuauaagaaccugaucuggcucgugaaaaagggaaauaguuaccccaaauuaagcaagucuuauauaaacgauaagggcaaagaaguacugguucuuuggggcauccaccacccuuccacgucagcugaccaacagagcuuguaccagaaugccgaugcguacguguucgucgggaccagucgcuauucuaagaaauuuaagccagagauugcaauccgacccaaagugcgugaccaggagggaagaaugaacuacuauuggacucugguggaaccuggugauaagauuacauucgaggccacuggcaaucuagucguuccaagguacgcuuuugccauggaacggaacgcaggguccggaaucauaauuagcgacaccccggugcaugacugcaacacaaccugucaaacgcccaaaggcgcuaucaauacuucgcucccuuuccagaacauucacccaaucacaaucgguaagugccccaaguauguaaaaucuaccaagcugcgccuugccacugggcugagaaaugugccuuccauucagucaaggggauuguuuggcgcgauagccggcuucaucgaagggggauggacagguauggucgauggcugguacggguaucaucaccagaacgaacaaggaaguggcuacgcagcugaccucaaaagcacccagcacgccauugaugagaucacgaauaaggugaacuccguuauagagaaaaugaauacccaguuuacagcuguggguaaggaguucaaccaucuggaaaagcggauugaaaauuuaaacaaaaaggucgacgauggguuccuggacaucuggacuuacaaugccgagcuccuugugcuguuggaaaacgagcgcacccuagauuaucacgacucuaauguaaagaaccuguacgagaagguucgaagccagcucaaaaauaacgcaaaggaaaucggcaacggauguuuugaguucuaucauaagugcgauaauacauguauggaaucagugaaaaacggcacuuacgacuauccaaaguacagugaggaagccaaacugaauagagaggagauugauggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129384 - RNA, 1701 nt, Artificial Sequence; identical to SEQ ID NO: 124685
  derived and/or modified sequence opt3 from hemagglutinin__InfluenzaA__AEO01272

SEQ ID NO: 129385 - RNA, 1701 nt, Artificial Sequence; identical to SEQ ID NO: 124685
  derived and/or modified sequence opt3 from hemagglutinin__InfluenzaA__AEO01273

SEQ ID NO: 129386 - RNA, 1701 nt, Artificial Sequence; identical to SEQ ID NO: 124685
  derived and/or modified sequence opt3 from hemagglutinin__InfluenzaA__AEO01274

SEQ ID NO: 129387 - RNA, 1701 nt, Artificial Sequence; identical to SEQ ID NO: 126853
  derived and/or modified sequence opt3 from hemagglutinin__InfluenzaA__AEO01275

SEQ ID NO: 129388 - RNA, 1701 nt, Artificial Sequence
  derived and/or modified sequence opt3 from hemagglutinin__InfluenzaA__AEO01276
augaaggccauccuggugguccuccuuuacaccuucgcuacagcaaacgccgacacucugugcauuggcuaucacgcgaauaacagcacggauaccguugacacaguguugaagaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggaacucagggagcagcugagcaguguguccucuuucgagcgguuugaaauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggagguacugguucuuuggggcauccaccaccccucaacgagcgcugaucaacagaguuuguaccagaacgccgacgcguacguguucgucgggacuucucgcuauuccaaaaaguuuaaaccugaaauugcaauccgaccaaaggugcgugaucaggagggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgaaaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcagaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129389 - RNA, 1701 nt, Artificial Sequence; identical to SEQ ID NO: 124685
  derived and/or modified sequence opt3 from hemagglutinin__InfluenzaA__AEO01277

SEQ ID NO: 129390 - RNA, 1701 nt, Artificial Sequence
  derived and/or modified sequence opt3 from hemagglutinin__InfluenzaA__AEO01278
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcgacauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagcacgccauugaugagaucacgaauaaggugaacucuguuauagagaaaaugaauacccaguuuacagcuguggguaaggaguucaaccaucuggagaagcggauugccaauuuaaacaaaaaggucgacgauggguuccuggacaucuggacuuacaaugcagaacuccuugugcuguuggagaacgaacgcacccuagauuaucacgacagcaauguaaagaaccuguacgagaagguucgaucacagcucaaaaauaacgccaaggagaucggcaacggauguuuugaguucuaucauaagugcgauaauacauguauggagagugugaaaaacggcacuuacgacuauccuaaguacuccgaagaggcuaaacugaauagagaagagauugauggggucaaacuugagagcaccaggaucuaucaaauucuggcgauauacucuacaguggcaucaaguuugguccucgugguuagccugggagccaucuccuuuuggaugugcucuaacgguucguuacagugccggauuuguaucuga

SEQ ID NO: 129391 - RNA, 1701 nt, Artificial Sequence
  derived and/or modified sequence opt3 from hemagglutinin__InfluenzaA__AEO01279
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaccgcagggagcggaaucauaauuucggauacaccagugcaugacugcaacaccacgugucaaacuccgaaaggcgcuaucaauacaucucuccccuuccagaacauucacccuaucaccaucgguaagugcccaaaguauguaaaauccacuaagcugcgccuugccacagggcugagaaaugugcccucaauucagaguaggggauuguuuggcgcgauagccggcuucaucgaagggggauggaccgguauggucgacggcugguacggguaucaucaccagaacgaacaaggaagcggcuacgcagcugaucucaaauccacgcagaaugccauugacaagaucaccaacaaaguuaauucugugauagagaagaugaacacacaguuuacugcuguggguaaggaguucaaucaccuggaaaaacggauugagaacuuaaauaagaaagucgaugacggguuccuggauaucuggaccuacaacgccgaacuccuugugcuguuggagaaugaacgcacacuagacuaucaugauagcaacguaaagaaucuguacgagaaaguucgaucacagcucaagaacaacgcaaaggagaucggcaauggauguuuugaguucuaucacaaaugcgacaacacuuguauggaaagugugaagaauggcaccuacgauuauccuaaauacuccgaagaggccaagcugaacagagaagagauugacggggucaaacuugagagcacaaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 129392 - RNA, 1701 nt, Artificial Sequence
  derived and/or modified sequence opt3 from hemagglutinin__InfluenzaA__AEO01282
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaagcuguacgagaaaguacgaucacagcucaagaacaacgcaaaggaaaucggcaauggauguuuugaguucuaucacaaaugcaacaauacauguauggaaagugugaagaacggcacuuacgacuauccuaaauacuccgaggaagccaagcugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129393 - RNA, 1701 nt, Artificial Sequence; identical to SEQ ID NO: 125787
  derived and/or modified sequence opt3 from hemagglutinin__InfluenzaA__AEO01283

SEQ ID NO: 129394 - RNA, 1701 nt, Artificial Sequence
  derived and/or modified sequence opt3 from hemagglutinin__InfluenzaA__AEO01284
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagcacgccaucgacgagauaaccaacaagguaaauucuguuauugagaaaaugaacacgcaguuuaccgcuguggguaaggaguucaaucaucuggaaaagcggaucgaaaacuuaaauaaaaaggucgaugacggguuccuggauaucuggacauacaacgccgagcuccuugugcuguuggaaaaugagcgcacucuagacuaucacgauagcaacgugaaaaaucuguacgagaagguucgaucacagcucaaaaacaacgcaaaggaaauuggcaauggauguuuugaguucuaucauaagugcgacaacaccuguauggaaagugugaaaaauggcacauacgauuauccuaaguacuccgaggaagccaaacugaacagagaggagaucaauggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 129395 - RNA, 1701 nt, Artificial Sequence; identical to SEQ ID NO: 125786
  derived and/or modified sequence opt3 from hemagglutinin__InfluenzaA__AEO01285

SEQ ID NO: 129396 - RNA, 1701 nt, Artificial Sequence; identical to SEQ ID NO: 125879
  derived and/or modified sequence opt3 from hemagglutinin__InfluenzaA__AEO01286

SEQ ID NO: 129397 - RNA, 1701 nt, Artificial Sequence
  derived and/or modified sequence opt3 from hemagglutinin__InfluenzaA__AEO01287
augaaggccauccuggugguccuccuuuacaccuucgcuacagcaaacagcgacacucugugcauuggcuaucacgccaauaacuccacggauaccguugacacaguguuggagaaaaauguaacugugacccauucugucaacuuacuggaagauaagcacaaugggaaacuauguaagcucagaggaguggcgccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuauccaagucauauauaaaugacaagggcaaagaaguacugguucuuuggggcauccaccaccccagcacgagugccgaucaacagucuuuguaccagaacgcugacgccuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguuaaaaaccuguacgagaagguacgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 129398 - RNA, 1701 nt, Artificial Sequence; identical to SEQ ID NO: 125038
  derived and/or modified sequence opt3 from hemagglutinin__InfluenzaA__AEO01288

SEQ ID NO: 129399 - RNA, 1701 nt, Artificial Sequence; identical to SEQ ID NO: 124685
  derived and/or modified sequence opt3 from hemagglutinin__InfluenzaA__AEO01289

SEQ ID NO: 129400 - RNA, 1701 nt, Artificial Sequence
  derived and/or modified sequence opt3 from hemagglutinin__InfluenzaA__AEO01290
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucucuccuuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguucgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 129401 - RNA, 1701 nt, Artificial Sequence; identical to SEQ ID NO: 124685
  derived and/or modified sequence opt3 from hemagglutinin__InfluenzaA__AEO01291

SEQ ID NO: 129402 - RNA, 1701 nt, Artificial Sequence; identical to SEQ ID NO: 124685
  derived and/or modified sequence opt3 from hemagglutinin__InfluenzaA__AEO01292

SEQ ID NO: 129403 - RNA, 1701 nt, Artificial Sequence
  derived and/or modified sequence opt3 from hemagglutinin__InfluenzaA__AEO01294
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcgacauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagcacgccauugaugagaucacgaauaaggugaacucuguuauagagaaaaugaauacccaguuuacagcuguggguaaggaguucaaccaucuggaaaagcggauugaaaauuuaaacaaaaaggucgacgauggguuccuggacaucuggacuuacaaugccgagcuccuugugcuguuggaaaacgagcgcacccuagauuaucacgacagcaauguaaagaaccuguacgagaagguucgaucacagcucaaaaauaacgcaaaggaaaucggcaacggauguuuugaguucuaucauaagugcgauaauacauguauggaaagugugaaaaacggcacuuacgacuauccuaaguacuccgaggaagccaaacugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129404 - RNA, 1701 nt, Artificial Sequence
  derived and/or modified sequence opt3 from hemagglutinin__InfluenzaA__AEO01295
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcauuauugcaacacaaccugucaaacgccgaaaggcgcuaucaauacuucgcuccccuuccagaacauucacccuaucacaaucgguaagugcccaaaguacguaaaaucuaccaagcugcgccuugccacugggcugagaaaugugcccuccauucagucaaggggauuguuuggcgcgauagccggcuucaucgaagggggauggacagguauggucgacggcugguauggguaccaucaccagaacgaacaaggaaguggcuacgcagcugaccucaaaagcacccagaaugccauugauaagaucacgaacaaagugaauaguguuauagagaagaugaacacccaguuuacagcuguggguaaggaguucaaucaccuggaaaaacggauugagaacuuaaauaagaaagucgacgauggguuccuggacaucuggacuuauaacgccgaacuccuugugcuguuggagaaugaacgcacccuagauuaccaugacucuaacguaaagaaccuguaugagaaaguucgaagccagcucaagaauaacgcaaaggagaucggcaauggauguuuugaguucuaccacaaaugcgauaacacauguauggaaucagugaagaauggcacuuaugacuacccuaaauauagugaagaggccaagcugaacagagaagagauugauggggucaaacuugaguccaccaggaucuaccaaauucuggcuauauacagcacaguggcgucuucauugguccucgugguuagucugggagcaaucagcuuuuggaugugcuccaaugguucuuuacagugccggauuuguaucuga

SEQ ID NO: 129405 - RNA, 1701 nt, Artificial Sequence; identical to SEQ ID NO: 124685
  derived and/or modified sequence opt3 from hemagglutinin__InfluenzaA__AEO01296

SEQ ID NO: 129406 - RNA, 1701 nt, Artificial Sequence; identical to SEQ ID NO: 126367
  derived and/or modified sequence opt3 from hemagglutinin__InfluenzaA__AEO01297

SEQ ID NO: 129407 - RNA, 1701 nt, Artificial Sequence; identical to SEQ ID NO: 126372
  derived and/or modified sequence opt3 from hemagglutinin__InfluenzaA__AEO01298

SEQ ID NO: 129408 - RNA, 1701 nt, Artificial Sequence; identical to SEQ ID NO: 124685
  derived and/or modified sequence opt3 from hemagglutinin__InfluenzaA__AEO01299

SEQ ID NO: 129409 - RNA, 1701 nt, Artificial Sequence; identical to SEQ ID NO: 124685
  derived and/or modified sequence opt3 from hemagglutinin__InfluenzaA__AEO01300

SEQ ID NO: 129410 - RNA, 1701 nt, Artificial Sequence; identical to SEQ ID NO: 124685
  derived and/or modified sequence opt3 from hemagglutinin__InfluenzaA__AEO01301

SEQ ID NO: 129411 - RNA, 1701 nt, Artificial Sequence; identical to SEQ ID NO: 124685
  derived and/or modified sequence opt3 from hemagglutinin__InfluenzaA__AEO01302

SEQ ID NO: 129412 - RNA, 1701 nt, Artificial Sequence; identical to SEQ ID NO: 126282
  derived and/or modified sequence opt3 from hemagglutinin__InfluenzaA__AEO01303

SEQ ID NO: 129413 - RNA, 1701 nt, Artificial Sequence
  derived and/or modified sequence opt3 from hemagglutinin__InfluenzaA__AEO01304
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaaggccagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaaggcguacugguucuuugggggauccaccaccccucaaccagcgccgaucaacagaguuuguaccagaacgcggacgcauacguguucgucggaacgucucgcuauuccaagaaauuuaagccugaaauugccauccgaccaaaagugcgugaucaggaggguagaaugaauuacuauuggacucugguggagcccggcgacaagauuaccuucgaagcuacagggaaccuagucguuccuagguacgccuuugcaauggagcggaacgcuggaagcggcaucauaauuucggauacuccagugcaugacugcaauaccacaugucaaaccccgaaaggugccaucaacacgucucuccccuuccagaauauucacccuaucacuaucgggaagugcccaaaguauguaaaauccacaaagcugcgccuugcgaccggacugagaaacgugcccucaauucagaguaggggcuuguuuggcgccauagcaggguucaucgaaggagguuggacuggcauggucgacgggugguacggauaucaucaccagaaugagcaaggcagcgguuacgcugccgaucucaaauccacacagaacgcuauugacgaaaucaccaauaaggugaacucuguuauagagaaaaugaauacgcaguuuaccgccguggggaaggaguucaaccaccuggaaaagcggauugagaauuuaaacaaaaaggucgaugacggcuuccuggauaucuggacauacaaugcagaacuccuugugcuguuggagaacgaacgcacucuagacuaucaugauagcaauguaaagaaccuguacgagaagguucgaucacagcucaaaaacaaugccaaggagaucggaaacggcuguuuugaguucuaucacaagugcgacaauaccuguauggagagugugaaaaacgggacauacgauuauccuaaguacuccgaagaggcuaaacugaauagagaagagauugacggagucaaacuugagagcacuaggaucuaucaaauucuggcgauauacucuaccguggcaucaaguuugguccucgugguuagccugggugccaucuccuuuuggaugugcucuaacggcucguuacagugccggauuuguaucuga

SEQ ID NO: 129414 - RNA, 1701 nt, Artificial Sequence
  derived and/or modified sequence opt3 from hemagglutinin__InfluenzaA__AEO01305
augaaggccauccuggugguccuccuuuacaccuucgcuacagcaagcgccgacacucugugcauuggcuaucacgcgaacaauuccacggauaccguugacacaguguuggagaaaaacguaacugugacccauucugucaauuuacuggaagauaagcacaacgggaaacuauguaagcucagaggaguggcuccccugcaucuugguaaaugcaauauagccggcuggauccuggggaacccugagugugaaucauugaguacagcaagcuccuggucuuacauuguugagaccucgucaagcgacaauggaacuugcuauccaggcgauuuuaucgacuacgaggagcucagggagcagcugaguuccgugucuagcuucgaacgguuugagauuuucccgaagacauccucauggcccaaccacgauaguaauaagggugucaccgccgcuuguccucaugcaggggccaagagcuuuuauaagaaccugaucuggcucgugaaaaagggaaauucuuacccaaaauuauccaagucauauauaaacgacaagggcaaagaaguacugguucuuuggggcauccaccaccccagcacgagugcugaucaacagucuuuguaccagaaugccgacgcguacguguucgucgggacuucccgcuauagcaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggucgggaaucauaauuucugauaccccagugcaugacugcaacacaaccugucaaacgccgaaaggcgcuaucaauacuucccuccccuuccagaacauucacccuaucacaaucgguaagugcccaaaguauguaaaaucaaccaagcugcgccuugccacugggcugagaaaugugcccaguauucagagcaggggauuguuuggcgcgauagccggcuucaucgaagggggauggacagguauggucgacggcugguacggguaucaucaccagaacgaacaaggauccggcuacgcagcugaucucaaaucuacccagaaugccauugacgagaucacgaacaaggugaauagcguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucaaacguuaaaaaucuguacgagaagguacgaagucagcucaaaaacaacgcaaaggaaaucggcaauggauguuuugaguucuaucacaagugcgacaacacauguauggaauccgugaaaaauggcacuuacgauuauccuaaguacagcgaggaagccaaacugaacagagaggagauugacggggucaaacuugaaucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 129415 - RNA, 1701 nt, Artificial Sequence; identical to SEQ ID NO: 124685
  derived and/or modified sequence opt3 from hemagglutinin__InfluenzaA__AEO01306

SEQ ID NO: 129416 - RNA, 1701 nt, Artificial Sequence; identical to SEQ ID NO: 124685
  derived and/or modified sequence opt3 from hemagglutinin__InfluenzaA__AEO01307

SEQ ID NO: 129417 - RNA, 1701 nt, Artificial Sequence; identical to SEQ ID NO: 124685
  derived and/or modified sequence opt3 from hemagglutinin__InfluenzaA__AEO01308

SEQ ID NO: 129418 - RNA, 1701 nt, Artificial Sequence
  derived and/or modified sequence opt3 from hemagglutinin__InfluenzaA__AEO01309
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagcacgccaucgacgagauaaccaacaagguaaauucuguuauugagaaaaugaacacgcaguuuaccgcuguggguaaggaguucaaucaucuggaaaagcggaucgaaaacuuaaauaaaaaggucgaugacggguuccuggauaucuggacauacaacgccgagcuccuugugcuguuggaaaaugagcgcacucuagacuaucacgauagcaacgugaaaaaucuguacgagaagguucgaucacagcucaaaaacaacgcaaaggaaauuggcaauggauguuuugaguucuaucauaagugcgacaacaccuguauggaaagugugaaaaauggcacauacgauuauccuaaguacuccaaagaggccaagcugaacagagaagagaucaauggggucaaacuugagagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 129419 - RNA, 1701 nt, Artificial Sequence
  derived and/or modified sequence opt3 from hemagglutinin__InfluenzaA__AEO01310
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugaccgcggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 129420 - RNA, 1701 nt, Artificial Sequence; identical to SEQ ID NO: 124685
  derived and/or modified sequence opt3 from hemagglutinin__InfluenzaA__AEO01311

SEQ ID NO: 129421 - RNA, 1701 nt, Artificial Sequence
  derived and/or modified sequence opt3 from hemagglutinin__InfluenzaA__AEO01312
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauugucgacggcugguacggguaucaucaccagaaugaacaaggaagcggcuacgcagcugaucucaaauccacccagaacgccaucgacgagauaacgaauaaggugaacucuguuauugagaaaaugaauacccaguuuacagcuguggguaaggaguucaaccaccuggaaaagcggaucgaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaauuggcaacggauguuuugaguucuaucacaagugcgacaauacauguauggaaagugugaaaaacggcacuuacgauuauccuaaguacuccgaggaagccaaacugaauagagaggagaucgacggggucaaacuugaaagcaccaggauuuaucaaauacuggcuaucuacucuacaguggcgucaaguuugguccucgugguuagccugggagcaauuuccuuuuggaugugcucuaacgguucguuacagugccggaucuguaucuga

SEQ ID NO: 129422 - RNA, 1701 nt, Artificial Sequence; identical to SEQ ID NO: 125038
  derived and/or modified sequence opt3 from hemagglutinin__InfluenzaA__AEO01313

SEQ ID NO: 129423 - RNA, 1701 nt, Artificial Sequence; identical to SEQ ID NO: 125849
  derived and/or modified sequence opt3 from hemagglutinin__InfluenzaA__AEO01314

SEQ ID NO: 129424 - RNA, 1701 nt, Artificial Sequence
  derived and/or modified sequence opt3 from hemagglutinin__InfluenzaA__AEO01315
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaauagaaaacuauguaagcucagggguguggcuccccugcaucuuggaaaaugcaacauagccgguuggauccugggcaauccugagugugaaucuuugucaacagcaaguagcugguccuacauuguugagaccucuucgucagacaacgggacuugcuauccaggagauuuuaucgacuacgaagaacuccgggagcagcugagcaguguguccucuuucgaacgcuuugagauuuucccgaagacaagcuccuggcccaaucacgauucaaacaagggcgucaccgccgcuuguccucaugcaggggccaaaaguuuuuauaagaaucugaucuggcucgugaaaaaggggaacagcuacccaaaauuaucuaaguccuauauaaaugacaagggaaaagaaguacugguucuuuggggcauccaccaccccucaacgagcgcugaucaacagaguuuguaccagaacgccgacgcguacguguucgucggcacuucucgauauuccaagaaauuuaagccugagauugcaauccguccaaaagugagagaucaggaggggaggaugaauuacuauuggacccugguggaacccggagacaagauuacauucgaggccacugguaaccuagucguuccucgguacgcuuuugccauggaacgcaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugagacuugccacuggucugaggaacgugcccucaauucagagucggggguuguuuggagcgauagccggcuucaucgagggcggguggacaggaauggucgacgguugguacggcuaucaucaccagaaugaacaagggagcggauacgcagcugaucucaaauccacccagaacgccauugacgagaucacgaauaaggugaacucuguuauagagaaaaugaauacccaguuuacagcugugggcaaggaguucaaccaccuggagaagcgcauugaaaauuuaaacaaaaaggucgaugacgguuuccuggauaucuggacuuacaaugccgagcuccuugugcuguuggaaaacgagcgaacccuagacuaucaugauagcaauguaaagaaccuguacgagaagguuagaucacagcucaaaaacaaugcaaaggaaaucgggaacggcuguuuugaguucuaucacaagugcgacaauacauguauggaaagugugaaaaacggaacuuacgauuauccuaaguacuccgaggaagccaaacugaauagggaggagauugacggcgucaaacuugaaagcacccggaucuaucaaauucuggcuauauacucuacaguggcgucaaguuugguccucgugguuagccugggggcaaucuccuuuuggaugugcucuaacggaucguuacagugccguauuuguaucuga

SEQ ID NO: 129425 - RNA, 1701 nt, Artificial Sequence; identical to SEQ ID NO: 124685
  derived and/or modified sequence opt3 from hemagglutinin__InfluenzaA__AEO01316

SEQ ID NO: 129426 - RNA, 1701 nt, Artificial Sequence; identical to SEQ ID NO: 124685
  derived and/or modified sequence opt3 from hemagglutinin__InfluenzaA__AEO01317

SEQ ID NO: 129427 - RNA, 1701 nt, Artificial Sequence; identical to SEQ ID NO: 124685
  derived and/or modified sequence opt3 from hemagglutinin__InfluenzaA__AEO01318

SEQ ID NO: 129428 - RNA, 1701 nt, Artificial Sequence; identical to SEQ ID NO: 124685
  derived and/or modified sequence opt3 from hemagglutinin__InfluenzaA__AEO01319

SEQ ID NO: 129429 - RNA, 1701 nt, Artificial Sequence
  derived and/or modified sequence opt3 from hemagglutinin__InfluenzaA__AEO01321
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgagaagcggaucgaaaaucugaacaaaaaggucgaugacggguucuuagauaucuggacuuacaaugccgagcugcucgcacuucuggaaaacgagcgcaccuuggacuaucaugauagcaaugugaaaaaccuauacgagaagguacgaucacagcugaaaaacaaugccaaggaaauuggcaacggauguuuugaguucuaucacaagugcgacaauacauguauggaaaguguuaaaaacggcacuuacgauuauccuaaguacuccgaggaagcuaaacucaauagagaggagaucgacggggugaagcuggaaagcaccaggauuuaucaaauacuugcgaucuacucuacagucgcaucaagucugguguuggucgugagccucggagccauuuccuuuuggaugugcucuaacgguucgcugcagugccggaucuguaucuga

SEQ ID NO: 129430 - RNA, 1701 nt, Artificial Sequence; identical to SEQ ID NO: 124685
  derived and/or modified sequence opt3 from hemagglutinin__InfluenzaA__AEO01322

SEQ ID NO: 129431 - RNA, 1701 nt, Artificial Sequence; identical to SEQ ID NO: 126367
  derived and/or modified sequence opt3 from hemagglutinin__InfluenzaA__AEO01323

SEQ ID NO: 129432 - RNA, 1701 nt, Artificial Sequence; identical to SEQ ID NO: 126282
  derived and/or modified sequence opt3 from hemagglutinin__InfluenzaA__AEO01324

SEQ ID NO: 129433 - RNA, 1701 nt, Artificial Sequence; identical to SEQ ID NO: 124685
  derived and/or modified sequence opt3 from hemagglutinin__InfluenzaA__AEO01325

SEQ ID NO: 129434 - RNA, 1701 nt, Artificial Sequence
  derived and/or modified sequence opt3 from hemagglutinin__InfluenzaA__AEO01326
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccaggacgccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129435 - RNA, 1701 nt, Artificial Sequence; identical to SEQ ID NO: 124685
  derived and/or modified sequence opt3 from hemagglutinin__InfluenzaA__AEO01327

SEQ ID NO: 129436 - RNA, 1701 nt, Artificial Sequence; identical to SEQ ID NO: 129394
  derived and/or modified sequence opt3 from hemagglutinin__InfluenzaA__AEO01328

SEQ ID NO: 129437 - RNA, 1701 nt, Artificial Sequence; identical to SEQ ID NO: 124685
  derived and/or modified sequence opt3 from hemagglutinin__InfluenzaA__AEO01330

SEQ ID NO: 129438 - RNA, 1701 nt, Artificial Sequence
  derived and/or modified sequence opt3 from hemagglutinin__InfluenzaA__AEO01331
augaaggccauccuggugguccuccuuuacaccuucgcuacagcaaacgccgacacucugugcauuggcuaucacgcgaauaacagcacggauaccguugacacauuguuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaggagcugagggagcagcugagcaguguuuccucuuucgaacgguuugagauuuucccgaagacaagcuccuggcccaaucacgauucaaacaagggugugaccgccgcuuguccucaugcaggggccaaaaguuuuuauaagaaucucaucugguuagucaaaaagggaaacagcuacccaaaacugucuaaguccuauauaaaugacaagggcaaagaagugcuuguauuguggggcauccaccaccccucaacgagcgcugaucaacagagucuguaccagaacgccgacgcguacguuuucguggggacuucucgcuauuccaagaaauuuaagccugagauugcaauccgaccaaaaguccgugaucaggagggaagaaugaauuacuauuggacccuaguggaacccggugacaagauuacauucgaggccacuggcaaccucguggucccuagguacgcuuuugccauggaacggaacgcagggagcggaaucauaauuucggauaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacguacccucaauucagaguaggggacucuuuggcgcgauagccggcuucaucgaagggggauggacagguaugguggacggcugguacggguaucaucaccagaaugaacaaggaagcggcuacgcagcugaucugaaguccacccagaacgccauugacgagaucacgaauaaggucaacucugugauagagaaaaugaauacccaguuuacagcuguugguaaggaguucaaccacuuagaaaagcggauugaaaaucugaacaaaaagguggaugacggguuccucgauaucuggacuuacaaugccgagcuucuggucuugcuagaaaacgagcgcacccuggacuaucaugauagcaaugugaaaaaccucuacgagaagguacgaucacagcugaaaaacaaugcaaaggaaaucggcaacggauguuuugaguucuaucacaagugcgacaauacauguauggaaaguguuaaaaacggcacuuacgauuauccuaaguacuccgaggaagccaaacuuaauagagaggagauugacggggugaagcuggaaagcaccaggaucuaucaaauuuuggcuauauacucuacagucgcgucaagucucgugcuggucgugagcuuaggagcaaucuccuuuuggaugugcucuaacgguucgcugcagugccggauuuguaucuga

SEQ ID NO: 129439 - RNA, 1701 nt, Artificial Sequence
  derived and/or modified sequence opt3 from hemagglutinin__InfluenzaA__AEO01332
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggcugucucgcuauuccaagaaauuuaagccugagauugcaauccgaccaaaagugcgugagcaggaaggaagaaugaauuacuauuggacucuaguggagcccggugauaagauuaccuucgaagccacaggcaaccucgucguuccuagguacgcuuuugccauggagcggaacgcagggagcggaaucgugauaucggacacuccaguacaugauugcaauaccacaugucaaaccccgaaaggcgcuauuaacacgucucugcccuuccagaauauccacccuauuacuaucgguaagugcccaaaguaugugaaauccacaaaacuucgccuggccaccggguugagaaacguccccucaauccagaguaggggacucuuuggcgcgauugccggcuucauagaagggggauggacugguaugguggacggcugguacggguaucaucaccagaaugagcaaggaagcggcuacgcagcugaccugaaauccacacagaacgccaucgaugagauuaccaauaagguuaacucugugaucgaaaagaugaauacgcaguuuaccgcugucgguaaggaguucaaccacuuagaaaagcggauggagaaucugaacaaaaagguggacgauggguuccucgacauauggacauacaaugccgaacuucugguauugcuagagaacgagcgcacucuggauuaucaugacagcaauguuaaaaaccucuacgaaaaggugcgaucacagcugaaaaccaacgcaaaggagauuggcaauggauguuuugaguucuaucacaagugcgauaacacauguauggagagugucaaaaauggcacuuacgacuauccuaaguacuccgaagaggccaaacuuaacagagaggaaaucgauggggugaagcuggagagcaccaggaucuaucaaauuuuggcuaucuacucuacagucgcgucaagucucgugcugguugugagcuuaggagcaauuuccuuuuggaugugcucuaaugguucgcugcagugccggauauguaucuga

SEQ ID NO: 129440 - RNA, 1701 nt, Artificial Sequence; identical to SEQ ID NO: 126853
  derived and/or modified sequence opt3 from hemagglutinin__InfluenzaA__AEO01333

SEQ ID NO: 129441 - RNA, 1701 nt, Artificial Sequence
  derived and/or modified sequence opt3 from hemagglutinin__InfluenzaA__AEO01334
augaaggccauccuggugguccuccuuuacaccuucgcuacagcaaacgccgacacucugugcauuggcuaucacgcgaauaacagcacggauaccguugacacaauauuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 129442 - RNA, 1701 nt, Artificial Sequence; identical to SEQ ID NO: 126282
  derived and/or modified sequence opt3 from hemagglutinin__InfluenzaA__AEO01335

SEQ ID NO: 129443 - RNA, 1701 nt, Artificial Sequence
  derived and/or modified sequence opt3 from hemagglutinin__InfluenzaA__AEO01336
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucggugagugcccaaaguauguaaagucuaccaaacugcgccuugccacugggcugagaaaugugcccuccauucagucaaggggauuguuuggcgcgauagccggcuucaucgaagggggauggacagguauggucgacggcugguacggguaucaucaccagaacgagcaaggaaguggcuacgcagcugaucucaagagcacccagaaugccauugacaaaaucacgaacaaggugaauaguguuauagagaaaaugaacacccaguuuacagcuguggguaaggaguucaaucaccuggagaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 129444 - RNA, 1701 nt, Artificial Sequence
  derived and/or modified sequence opt3 from hemagglutinin__InfluenzaA__AEO01337
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuaccauuggacccugguggaacccggugacaagauuacauucgaggccacuggcaaccuagucguuccuagguaugcuuuugccauggaacggaacgcagggagcggaaucauaauuucggauaccccagugcacgacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaccagaaugaacaaggaagcggcuaugcagcugaucucaaauccacccagcaugccauugacgagaucacgaacaagguaaauucuguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaccaugauagcaacgugaaaaaucuguaugagaagguucgaucacagcucaaaaacaacgcaaaggaaaucggcaauggauguuuugaguucuaccacaagugcgacaacacauguauggaaagugugaaaaauggcacuuaugauuacccuaaguauuccgaggaagccaaacugaacagagaggagauugacggggucaaacuugaaagcaccaggaucuaccaaauucuggcuauauauucuacaguggcgucaaguuugguccucgugguuagccugggagcaaucuccuuuuggaugugcucuaaugguucguuacagugccggauuuguaucuga

SEQ ID NO: 129445 - RNA, 1701 nt, Artificial Sequence; identical to SEQ ID NO: 124685
  derived and/or modified sequence opt3 from hemagglutinin__InfluenzaA__AEO01338

SEQ ID NO: 129446 - RNA, 1701 nt, Artificial Sequence; identical to SEQ ID NO: 128557
  derived and/or modified sequence opt3 from hemagglutinin__InfluenzaA__AEO01339

SEQ ID NO: 129447 - RNA, 1701 nt, Artificial Sequence; identical to SEQ ID NO: 129403
  derived and/or modified sequence opt3 from hemagglutinin__InfluenzaA__AEO01340

SEQ ID NO: 129448 - RNA, 1701 nt, Artificial Sequence; identical to SEQ ID NO: 129403
  derived and/or modified sequence opt3 from hemagglutinin__InfluenzaA__AEO01341

SEQ ID NO: 129449 - RNA, 1701 nt, Artificial Sequence; identical to SEQ ID NO: 124685
  derived and/or modified sequence opt3 from hemagglutinin__InfluenzaA__AEO01342

SEQ ID NO: 129450 - RNA, 1701 nt, Artificial Sequence
  derived and/or modified sequence opt3 from hemagglutinin__InfluenzaA__AEO01343
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacaagaucacgaacaaagugaauaguguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucuaacguaaagaaccuguacgagaaaguucgaagccagcucaagaauaacgcaaaggagaucggcaauggauguuuugaguucuaucacaaaugcgacaacacauguauggaaucagugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 129451 - RNA, 1701 nt, Artificial Sequence
  derived and/or modified sequence opt3 from hemagglutinin__InfluenzaA__AEO01344
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucuaaguauuccaaaaaguuuaaaccugagaucgcaauucgcccaaaggugcgagaucaggagggacguaugaauuacuauuggaccuugguggaacccggugacaaaaucacauucgaggccacuggcaaccuggucguuccuagauacgcuuuugccauggaaaggaacgcagggagcggaauaauuaucucggauaccccagugcaugacugcaauacaaccugucaaacgccgaagggcgcuauuaacacuucucuacccuuccagaauauccacccuaucacaauugguaagugcccaaaauauguaaaguccaccaaacuccggcuggccacugggcuucgcaacgugcccucaauacagaguagaggacuguuuggcgcgaucgccggcuucauugaagggggauggacagguauggucgacggcugguacggguaucaucaccagaaugaacaaggaagcggcuacgcagcugauuugaaguccacccagaacgccaucgacgagauaacgaauaaagugaacucuguuauugagaagaugaauacccaguuuacagcuguggguaaggaguucaaccaccucgagaaaaggaucgaaaaucugaacaagaaagucgaugacggguucuuagauaucuggacuuacaaugccgagcugcucgugcuucuggaaaacgagcggaccuuggacuaucaugauagcaauguaaagaaccuauacgagaaaguucgcucacagcugaagaacaaugcaaaggaaauuggcaacggauguuuugaguucuaucacaaaugcgacaauacauguauggaaagugugaagaacggcacuuacgauuauccuaaauacuccgaggaagccaagcucaaucgagaggagaucgacggggucaaacuggaaagcaccagaauuuaucaaauacuugcuaucuacucuacaguggcgucaagucuggucuuggugguuagccucggagcaauuuccuuuuggaugugcucuaacgguucgcugcagugcaggaucuguaucuga

SEQ ID NO: 129452 - RNA, 1701 nt, Artificial Sequence; identical to SEQ ID NO: 128557
  derived and/or modified sequence opt3 from hemagglutinin__InfluenzaA__AEO01345

SEQ ID NO: 129453 - RNA, 1701 nt, Artificial Sequence; identical to SEQ ID NO: 124685
  derived and/or modified sequence opt3 from hemagglutinin__InfluenzaA__AEO01346

SEQ ID NO: 129454 - RNA, 1701 nt, Artificial Sequence
  derived and/or modified sequence opt3 from hemagglutinin__InfluenzaA__AEO01347
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucggugagugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacaaaaucacgaauaaggugaacucuguuauagagaaaaugaauacccaguuuacagcuguggguaaggaguucaaccaccuggagaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129455 - RNA, 1701 nt, Artificial Sequence
  derived and/or modified sequence opt3 from hemagglutinin__InfluenzaA__AEO01348
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaagaacucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugagcaggaaggaagaaugaauuacuauuggacucugguggagcccggugauaagaucaccuucgaagccacaggcaaccuagucguuccuagguacgcuuuugccauggagcggaacgcagggagcggaauaauuaucucggacacuccagugcaugauugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugagcaaggaagcggcuacgcagcugaccucaaauccacacagaacgccaucgaugagauaaccaauaaggugaacucuguuauugaaaagaugaauacgcaguuuaccgcuguggguaaggaguucaaccaccuggaaaagcggaucgagaauuuaaacaaaaaggucgacgauggguuccuggacaucuggacauacaaugccgaacuccuugugcuguuggagaacgagcgcacucuagauuaucaugacagcaauguuaaaaaccuguacgaaaagguacgaucacagcucaaaaacaaugcaaaggagauuggcaacggauguuuugaguucuaucacaagugcgauaauaccuguauggagagugugaaaaacggcacauacgacuauccuaaguacuccgaagaggccaaacugaauagagaggaaaucgauggggucaaacuugagagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 129456 - RNA, 1701 nt, Artificial Sequence
  derived and/or modified sequence opt3 from hemagglutinin__InfluenzaA__AEO01349
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagaaaacggaacuugcuauccaggcgacuuuaucgauuacgaggagcucagggaacagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguuuguaccagaacgccgaugcguacguguucgucgggacuucucgcuauuccaagaaauuuaagccugagauugcaauccgaccaaaagugcgugaccaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaagaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauacauguauggaaagugugaaaaacggcacuuacgacuauccuaaguacuccaaagaagccaagcugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129457 - RNA, 1701 nt, Artificial Sequence
  derived and/or modified sequence opt3 from hemagglutinin__InfluenzaA__AEO01350
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagcacgcuauugacgagaucaccaacaagguaaauucuguuauagagaaaaugaacacacaguuuacugccguggguaaggaguucaaucaucuggaaaagcggauugaaaacuuaaauaaaaaggucgaugacggguuccuggauaucuggaccuacaacgcugagcuccuugugcuguuggaaaaugagcgcacacuagacuaucacgauagcaacgugaaaaaucuguacgagaagguucgaucacagcucaaaaacaacgccaaggaaaucggcaauggauguuuugaguucuaucauaagugcgacaacacuuguauggaaagugugaaaaauggcaccuacgauuauccuaaguacuccgaggaagcaaaacugaacagagaggagauugacggggucaaacuugaaagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 129458 - RNA, 1701 nt, Artificial Sequence; identical to SEQ ID NO: 124685
  derived and/or modified sequence opt3 from hemagglutinin__InfluenzaA__AEO01351

SEQ ID NO: 129459 - RNA, 1701 nt, Artificial Sequence; identical to SEQ ID NO: 125849
  derived and/or modified sequence opt3 from hemagglutinin__InfluenzaA__AEO01352

SEQ ID NO: 129460 - RNA, 1701 nt, Artificial Sequence
  derived and/or modified sequence opt3 from hemagglutinin__InfluenzaA__AEO01353
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuuuucugggagcaaucagcuucuggaugugcuccaacgguucuuuacagugccggauuuguaucuga

SEQ ID NO: 129461 - RNA, 1701 nt, Artificial Sequence
  derived and/or modified sequence opt3 from hemagglutinin__InfluenzaA__AEO01354
augaaggccauccuggugguccuccuuuacaaauucgcuaccgcaaacgccgacacacugugcauuggcuaucacgcgaauaacagcacugauacgguugacaccguguuggagaagaauguaacagugacucauuccgucaacuuacuggaagauaaacacaaugggaagcuauguaaacucagaggaguggcuccccugcaucuugguaagugcaacauagccggcuggauccuggggaauccugagugugaaucuuugucaaccgcaaguagcugguccuacauuguugagacaucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaaaggugucacagccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaaccagcgcugaucaacagaguuuguaccagaacgccgacgcguacguguucgucgggacgucucgcuauuccaaaaaguuuaaaccugagauugcaauccgaccaaaggugcgugaucaggagggaagaaugaauuacuauuggacucugguggaacccggugacaaaauuaccuucgaggccacaggcaaccuagucguuccuagguacgcuuuugccauggaacggaacgcagggagcggaaucauaauuucggauacuccagugcaugacugcaauaccacaugucaaaccccgaagggcgcuaucaacacgucucuccccuuccagaauauucacccuaucacuaucgguaagugcccaaaauauguaaaguccacaaaacugcgccuugccaccgggcugagaaacgugcccucaauucagaguaggggauuguuuggcgcgauagccggcuucaucgaagggggauggacugguauggucgacggcugguacggguaucaucaccagaaugaacaaggaagcggcuacgcagcugaucucaaguccacacagaacgccauugacgagaucaccaauaaagugaacucuguuauagagaagaugaauacgcaguuuaccgcuguggguaaggaguucaaccaccuggaaaaacggauugaaaauuuaaacaagaaagucgaugacggguuccuggauaucuggacauacaaugccgagcuccuugugcuguuggaaaacgagcgcacucuagacuaucaugauagcaauguaaagaaccuguacgagaaaguucgaucacagcucaagaacaaugcaaaggaaaucggcaacggauguuuugaguucuaucacaaaugcgacaauaccuguauggaaagugugaagaacggcacauacgauuauccuaaauacuccgaggaagccaagcugaauagagaggagauugacggggucaaacuugaaagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 129462 - RNA, 1701 nt, Artificial Sequence; identical to SEQ ID NO: 126105
  derived and/or modified sequence opt3 from hemagglutinin__InfluenzaA__AEO01355

SEQ ID NO: 129463 - RNA, 1701 nt, Artificial Sequence; identical to SEQ ID NO: 124685
  derived and/or modified sequence opt3 from hemagglutinin__InfluenzaA__AEO01356

SEQ ID NO: 129464 - RNA, 1701 nt, Artificial Sequence
  derived and/or modified sequence opt3 from hemagglutinin__InfluenzaA__AEO01358
augaaggccauccuggugguccuccuuuacaccuucgcuacagcaaacgccgacacucugugcguuggcuaucacgcgaauaacagcacggauaccguggacacaguauuggagaaaaaugugacugucacccauuccgugaacuuacuggaagauaagcacaaugggaaacuauguaagcucagaggaguugcuccccugcaucuugguaaaugcaacauugccggcuggauacuggggaauccugagugugaaucuuugucaacagcaaguagcugguccuacaucguggagaccucuucgucagacaacggaacuugcuauccaggcgauuuuauugacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccagcucaugacugcaauacaaccugucaaacgccgaaaggcgccauuaacacuucucuccccuuccagaauauccacccuauuacaaucgguaagugcccaaaguauguaaaauccaccaagcugcgccuugcgacugggcugagaaacgugcccucaauccagaguaggggauuguuuggcgccauugcaggcuucauagaagggggauggacagguauggucgacggcugguacggguaucaucaccagaaugaacaaggaagcggcuacgcugccgaucucaaauccacccagaacgcuaucgacgagauuacgaauaaggugaacucuguuaucgagaaaaugaauacccaguuuacagccguggguaaggaguucaaccaccuggaaaagcggauagaaaauuuaaacaaaaaggucgaugacggguuccuggauauuuggacuuacaaugcagagcuccuugugcuguuggaaaacgagcgcacccuagacuaucaugauagcaauguuaaaaaccuguacgagaagguacgaucacagcucaaaaacaaugccaaggaaaucggcaacggauguuuugaguucuaucacaagugcgacaauacauguauggaaagugugaaaaacggcacuuacgauuauccuaaguacuccgaggaagcuaaacugaauagagaggagaucgacggggucaaacuugaaagcaccaggauuuaucaaauccuggcgauuuacucuacaguggcaucaaguuugguccucgugguuagccugggagccauauccuuuuggaugugcucuaacgguucguuacagugccggaucuguauuuga

SEQ ID NO: 129465 - RNA, 1701 nt, Artificial Sequence; identical to SEQ ID NO: 126105
  derived and/or modified sequence opt3 from hemagglutinin__InfluenzaA__AEO01359

SEQ ID NO: 129466 - RNA, 1701 nt, Artificial Sequence; identical to SEQ ID NO: 129438
  derived and/or modified sequence opt3 from hemagglutinin__InfluenzaA__AEO01360

SEQ ID NO: 129467 - RNA, 1701 nt, Artificial Sequence; identical to SEQ ID NO: 125038
  derived and/or modified sequence opt3 from hemagglutinin__InfluenzaA__AEO01361

SEQ ID NO: 129468 - RNA, 1701 nt, Artificial Sequence; identical to SEQ ID NO: 129438
  derived and/or modified sequence opt3 from hemagglutinin__InfluenzaA__AEO01362

SEQ ID NO: 129469 - RNA, 1701 nt, Artificial Sequence; identical to SEQ ID NO: 125849
  derived and/or modified sequence opt3 from hemagglutinin__InfluenzaA__AEO01363

SEQ ID NO: 129470 - RNA, 1701 nt, Artificial Sequence
  derived and/or modified sequence opt3 from hemagglutinin__InfluenzaA__AEO01365
augaaggccauccuggugguccuccuuuacaccuucgcuacagcaaacgccgacacucugugcauuggcuaucacgcgaauaacagcacggauaccguugacacaguguugaaaaagaauguaacugugacccauuccgucaacauauuagaggauaaacacaaugggaagcuguguaaacuaagaggaguggcuccccuccaucuggguaagugcaacaucgccggcuggauucuugggaauccugaaugugagucucugucaacagcaaguagcugguccuacaucguugaaaccucuucgucagacaacggaacuugcuauccaggcgauuuuauugacuacgaggaauugagggagcagcucagcaguguguccucuuucgagcgguuugaaaucuucccgaagacaagcuccuggcccaaucacgauucaaacaaaggugucaccgccgcuuguccucaugcaggggccaagaguuuuuauaaaaaucugauauggcuggugaagaaaggaaacagcuacccaaagcucucuaaguccuauaucaaugacaaaggcaaggagguauuaguucuguggggcauucaccaccccucaacgagcgcugaucaacagagucuuuaccagaacgccgacgcguacguguucgucgggacuucucgcuauuccaaaaaguuuaaaccugaaaucgcaauucgaccaaaggugcgugaucaggagggaagaaugaauuacuauuggaccuugguggagcccggugacaaaaucacauucgaagccacuggcaaccuggucguuccuagguacgcuuuugccauggagcggagcgcagggucgggaauaauuaucucugauaccccagugcaugacugcaacacaaccugucaaacgccgaagggcgcuauuaauacuucccuacccuuccagaacauccacccuaucacaauugguaagugcccaaaauauguaaagucaaccaaacuccgccuggccacugggcuuagaaaugugcccaguauacagagcaggggacuguuuggcgcgaucgccggcuucauugaagggggauggacagguauggucgacggcugguacggguaucaucaccagaacgagcaaggauccggcuacgcagcugauuugaagucuacccagaaugccaucgacgaaauaacgaacaaagugaauagcguuauugagaagaugaacacccaguuuacagcuguggguaaggaguucaaucaccucgaaaaacggaucgagaaccugaauaagaaagucgaugacggguucuuagauaucuggacuuacaacgccgaacugcucgugcuucuggagaaugaacgcaccuuggacuaucaugauucaaacguaaagaaucuauacgagaaaguucgaagucagcugaagaacaacgcaaaggagauuggcaauggauguuuugaguucuaucacaaaugcgacaacacauguauggaauccgugaagaauggcacuuacgauuauccuaaauacagcgaagaggccaagcucaacagagaagagaucgacggggucaaacuggagucuaccaggauuuaucaaauacuugcuaucuacucaacaguggcgaguagccuggucuuggugguuucccucggagcaauuucuuuuuggaugugcucgaaugguagccugcagugccggaucuguaucuga

SEQ ID NO: 129471 - RNA, 1701 nt, Artificial Sequence
  derived and/or modified sequence opt3 from hemagglutinin__InfluenzaA__AEO01366
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcucuacaaccugucaaacgccgaaaggcgcuaucaauacuucccuccccuuccagaacguacacccuauuacaaucgguaagugcccaaaguaugugaaaucaaccaagcugcgccuugccacugggcugagaaauguccccaguauccagagcaggggauuguuuggcgcgauugccggcuucauagaagggggauggacagguaugguggacggcugguacggguaucaucaccagaacgaacaaggauccggcuacgcagcugaucucaaaucuacccagaaugccaucgacgagauuacgaacaagguuaauagcgugaucgagaaaaugaacacccaguuuacagcugucgguaaggaguucaaucaccuggaaaagcggauagaaaacuuaaauaaaaagguggaugacggguuccuggauauuuggacuuacaacgccgagcuccuuguacuguuggaaaaugagcgcacccuagacuaucaugauucaaacguuaaaaaucuguacgagaaggugcgaagucagcucaaaaacaacgcaaaggaaaucggcaauggauguuuugaguucuaucacaagugcgacaacacauguauggaauccgucaaaaauggcacuuacgauuauccuaaguacagcgaggaagccaaacugaacagagaggagaucgacggggugaaacuugaaucuaccaggauuuaucaaauccuggcuauuuacucaacagucgcgaguagcuuggugcucguugugucccugggagcaauaucuuuuuggaugugcucgaaugguagcuuacagugccggaucuguauuuga

SEQ ID NO: 129472 - RNA, 1701 nt, Artificial Sequence; identical to SEQ ID NO: 129443
  derived and/or modified sequence opt3 from hemagglutinin__InfluenzaA__AEO01367

SEQ ID NO: 129473 - RNA, 1701 nt, Artificial Sequence
  derived and/or modified sequence opt3 from hemagglutinin__InfluenzaA__AEO01368
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaauacaagcuccuggcccaaccacgauucaaauaagggugucaccgccgcuuguccucaugcaggggccaagaguuuuuauaaaaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacaaaaucacgaacaagguaaauucuguuauagagaaaaugaacacccaguuuacagcuguggguaaggaguucaaucaccuggaaaagcggauugagaacuuaaauaaaaaggucgaugacggguuccuggauaucuggacuuacaacgccgaacuccuugugcuguuggagaaugaacgcacccuagacuaucaugauagcaacgugaaaaaccuguacgagaagguucgaucacagcucaaaaauaacgcaaaggagaucggcaauggauguuuugaguucuaucacaagugcgacaacacauguauggaaagugugaaaaauggcacuuacgauuauccuaaguacuccgaagaggccaaacugaacagagaagagauugacggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129474 - RNA, 1701 nt, Artificial Sequence; identical to SEQ ID NO: 124685
  derived and/or modified sequence opt3 from hemagglutinin__InfluenzaA__AEO01369

SEQ ID NO: 129475 - RNA, 1701 nt, Artificial Sequence; identical to SEQ ID NO: 129403
  derived and/or modified sequence opt3 from hemagglutinin__InfluenzaA__AEO01370

SEQ ID NO: 129476 - RNA, 1701 nt, Artificial Sequence; identical to SEQ ID NO: 129450
  derived and/or modified sequence opt3 from hemagglutinin__InfluenzaA__AEO01371

SEQ ID NO: 129477 - RNA, 1701 nt, Artificial Sequence; identical to SEQ ID NO: 126282
  derived and/or modified sequence opt3 from hemagglutinin__InfluenzaA__AEO01372

SEQ ID NO: 129478 - RNA, 1701 nt, Artificial Sequence; identical to SEQ ID NO: 126282
  derived and/or modified sequence opt3 from hemagglutinin__InfluenzaA__AEO01373

SEQ ID NO: 129479 - RNA, 1701 nt, Artificial Sequence
  derived and/or modified sequence opt3 from hemagglutinin__InfluenzaA__AEO01374
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcgacauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauauuaaauccaccaagcugcgccuugccacugggcugagaaauguacccucaauacagaguaggggauuguuuggcgcgaucgccggcuucauugaagggggauggacagguaugguggauggcugguacggguaucaucaccagaacgaacaaggaagcggcuacgcagcugaccucaaauccacccagcacgccaucgaugagauaacgaauaaggucaacucugugauugagaaaaugaauacccaguuuacagcuguugguaaggaguucaaccaucuggaaaagcggaucgaaaauuuaaacaaaaagguggacgauggguuccuggacaucuggacuuacaaugccgagcuccuuguccuguuggaaaacgagcgcacccuagauuaucacgacagcaaugugaaaaaccuguacgagaagguacgaucacagcucaaaaauaacgcaaaggaaauuggcaacggauguuuugaguucuaucauaagugcgauaauacauguauggaaaguguuaaaaacggcacuuacgacuauccuaaguacuccgaggaagccaaacugaauagagaggagaucgauggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 129480 - RNA, 1701 nt, Artificial Sequence; identical to SEQ ID NO: 129454
  derived and/or modified sequence opt3 from hemagglutinin__InfluenzaA__AEO01375

SEQ ID NO: 129481 - RNA, 1701 nt, Artificial Sequence; identical to SEQ ID NO: 124685
  derived and/or modified sequence opt3 from hemagglutinin__InfluenzaA__AEO01376

SEQ ID NO: 129482 - RNA, 1701 nt, Artificial Sequence; identical to SEQ ID NO: 126853
  derived and/or modified sequence opt3 from hemagglutinin__InfluenzaA__AEO01377

SEQ ID NO: 129483 - RNA, 1701 nt, Artificial Sequence
  derived and/or modified sequence opt3 from hemagglutinin__InfluenzaA__AEO01378
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuuugaguucuaucacaagugcgacaauacauguauggaaucagugaaaaacggcacuuacgauuauccaaaguacagugaggaagccaaacugaauagagaggagauugacggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129484 - RNA, 1701 nt, Artificial Sequence; identical to SEQ ID NO: 125849
  derived and/or modified sequence opt3 from hemagglutinin__InfluenzaA__AEO01379

SEQ ID NO: 129485 - RNA, 1701 nt, Artificial Sequence; identical to SEQ ID NO: 129454
  derived and/or modified sequence opt3 from hemagglutinin__InfluenzaA__AEO01380

SEQ ID NO: 129486 - RNA, 1701 nt, Artificial Sequence; identical to SEQ ID NO: 129454
  derived and/or modified sequence opt3 from hemagglutinin__InfluenzaA__AEO01381

SEQ ID NO: 129487 - RNA, 1701 nt, Artificial Sequence; identical to SEQ ID NO: 125849
  derived and/or modified sequence opt3 from hemagglutinin__InfluenzaA__AEO01382

SEQ ID NO: 129488 - RNA, 1701 nt, Artificial Sequence; identical to SEQ ID NO: 126282
  derived and/or modified sequence opt3 from hemagglutinin__InfluenzaA__AEO01383

SEQ ID NO: 129489 - RNA, 1701 nt, Artificial Sequence
  derived and/or modified sequence opt3 from hemagglutinin__InfluenzaA__AEO01384
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugucuccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuauccaagucauauauaaaugacaagggcaaagaaguacugguucuuuggggcauccaccaccccagcacgagugccgaucaacagucuuuguaccagaacgcugacgccuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguuaaaaaccuguacgagaagguacgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 129490 - RNA, 1701 nt, Artificial Sequence
  derived and/or modified sequence opt3 from hemagglutinin__InfluenzaA__AEO01385
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccaaugcguacguguucgucgggacuucucgcuauuccaagaaauuuaagccugagaucgcaauucgaccaaaagugcgugaccaggagggaagaaugaacuacuauuggaccuugguggaacccggugauaagaucacauucgaggccacuggcaaccuggucguuccuagguacgcuuuugccauggaacggaaugcagggagcggaauaauuaucucggacaccccagugcaugauugcaacacaaccugucaaacgccgaaaggcgcuauuaauacuucucuacccuuccagaacauccacccuaucacaauugguaagugcccaaaguauguaaaauccaccaagcuccgccuggccacugggcuuagaaaugugcccucaauacagaguaggggacuguuuggcgcgaucgccggcuucauugaagggggauggacagguauggucgacggcugguacggguaucaucaccagaacgaacaaggaagcggcuacgcagcugacuugaaauccacccagaaugccaucgaugagauaacgaacaagguaaauucuguuauugagaaaaugaacacccaguuuacagcuguggguaaggaguucaaucaccucgagaagcggaucgaaaaccugaauaaaaaggucgacgauggguucuuagacaucuggacuuacaacgccgagcugcucgugcuucuggaaaaugagcgcaccuuggauuaucaugacagcaacgugaaaaaccuauacgagaagguucgaucacagcugaaaaauaacgcaaaggaaauuggcaauggauguuuugaguucuaucacaagugcgauaacacauguauggaaagugugaaaaauggcacuuacgacuauccuaaguacuccgaggaagccaaacucaacagagaggagaucgauggggucaagcuggaaagcaccaggauuuaucaaauacuugcuaucuacucuacaguggcgucaagucuggucuuggugguuagccucggagcaauuuccuuuuggaugugcucuaaugguucgcugcagugccggaucuguaucuga

SEQ ID NO: 129491 - RNA, 1701 nt, Artificial Sequence; identical to SEQ ID NO: 129394
  derived and/or modified sequence opt3 from hemagglutinin__InfluenzaA__AEO01386

SEQ ID NO: 129492 - RNA, 1701 nt, Artificial Sequence
  derived and/or modified sequence opt3 from hemagglutinin__InfluenzaA__AEO01387
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauauccaguuuaccgcuguggguaaggaguucaaccaccucgagaagcggaucgaaaaucugaacaaaaaggucgaugacggguucuuagauauuuggacauacaaugccgagcugcucgugcuucuggaaaacgagcgcacuuuggacuaucaugauagcaauguuaaaaaccuauacgagaagguacgaucacagcugaaaaacaaugcaaaggaaaucggcaacggauguuuugaguucuaucacaagugcgacaauaccuguauggaaagugugaaaaacggcacauacgauuauccuaaguacuccgaggaagccaaacucaauagagaggagauugacggggucaagcuggaaagcacuaggauauaucaaauccuugcuauuuacucuaccguggcgucaagucuggucuuggugguuagccucggagcaaucuccuuuuggaugugcucuaacgguucgcugcagugccggaucuguauuuga

SEQ ID NO: 129493 - RNA, 1701 nt, Artificial Sequence
  derived and/or modified sequence opt3 from hemagglutinin__InfluenzaA__AEO01388
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucaugauagcaauguaaagaaccuguacgagaagguucgcucacagcucaagacaaacgcaaaagagaucggcaauggauguuuugaguucuaucacaagugcgacaacacuuguauggaaagugugaaaaauggcaccuacgauuauccuaaguacuccgaagaggccaaacugaaccgagaagagauugacggggucaaacuugagagcacaagaaucuaucaaauucuggcuauauacucuaccguggcgucaaguuugguccucgugguuagccugggagcaaucuccuuuuggaugugcucuaaugguucguuacagugcaggauuuguaucuga

SEQ ID NO: 129494 - RNA, 1701 nt, Artificial Sequence
  derived and/or modified sequence opt3 from hemagglutinin__InfluenzaA__AEO01389
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcagggacgaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaagucgaugacggguuccuggauaucuggaccuacaaugcugaacuccuugugcuguuggagaacgaacgcacacuagacuaucaugauagcaauguaaagaaccuguacgagaaaguucgaucacagcucaagaacaaugccaaggagaucggcaacggauguuuugaguucuaucacaaaugcgacaauacuuguauggaaagugugaagaacggcaccuacgauuauccuaaauacuccgaagaggcaaagcugaauagagaagagauugacggggucaaacuugagagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 129495 - RNA, 1701 nt, Artificial Sequence
  derived and/or modified sequence opt3 from hemagglutinin__InfluenzaA__AEO01390
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggaacucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgagacgucucgcuauuccaagaaagugaagccugagaucgcaauucgaccacgugugagagaucaggaagggaggaugaauuacuauuggacucuggucgagcccggagacaaaaucaccuuugaagccacagguaaccuaguugugccucgguacgcuuucgccauggagcgcaacgcaggcagcgggauaauuaucucggauacuccaguacaugacugcaauaccacaugucaaaccccgaagggagcuauuaacacgucucuccccuuucagaauauccacccuaucacuauuggcaaaugcccaaaguaugugaaguccacaaaacugagacuugccaccggucugaggaacguccccucaauacagagucggggguuguucggagcgaucgccggcuuuauugaaggcggguggacuggaaugguggacgguugguacggcuaucaucaccagaaugagcaagggagcggauacgcagcugaucucaaguccacacagcacgccaucgacgagauaaccaacaaaguuaauucugugauugaaaagaugaacacgcaguucaccgcugucggcaaagaguuuaaucaucuggaaaagcgcaucgagaacuuaaauaagaaaguggaugacgguuuccuggauaucuggacauacaacgccgaacuccuuguacuguuggagaaugagcgaacucuagacuaucacgauagcaacguuaagaaucuguacgaaaaagugagaucacagcucaagaacaacgcaaaagagauugggaauggcuguuucgaauuuuaucauaagugcgacaacaccuguauggagagugucaagaauggaacauacgauuauccuaaauacuccgaaguggccaagcugaacagggaggagaucaauggcgucaaacuugaaagcacucggauuuaucaaauacuggcuaucuacucuaccguggcgucaaguuugguucucgugguaagccugggggcaauuuccuucuggaugugcucuaacggaucguuacagugccguaucuguaucuga

SEQ ID NO: 129496 - RNA, 1701 nt, Artificial Sequence; identical to SEQ ID NO: 129394
  derived and/or modified sequence opt3 from hemagglutinin__InfluenzaA__AEO01391

SEQ ID NO: 129497 - RNA, 1701 nt, Artificial Sequence; identical to SEQ ID NO: 129403
  derived and/or modified sequence opt3 from hemagglutinin__InfluenzaA__AEO01392

SEQ ID NO: 129498 - RNA, 1701 nt, Artificial Sequence; identical to SEQ ID NO: 126282
  derived and/or modified sequence opt3 from hemagglutinin__InfluenzaA__AEO01393

SEQ ID NO: 129499 - RNA, 1701 nt, Artificial Sequence; identical to SEQ ID NO: 125786
  derived and/or modified sequence opt3 from hemagglutinin__InfluenzaA__AEO01394

SEQ ID NO: 129500 - RNA, 1701 nt, Artificial Sequence
  derived and/or modified sequence opt3 from hemagglutinin__InfluenzaA__AEO01395
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuucucgacuacgaagaacugagggagcagcugagcaguguguccucuuucgaacgguuugagaucuucccgaagacaagcuccuggcccaaucacgauucaaacaagggugucaccgccgcuuguccucaugcaggggccaaaaguuuuuauaagaaucucauuugguuagugaaaaagggaaacagcuacccaaaacugucuaaguccuauaucaaugacaagggcaaagaaguacuuguuuuguggggcauacaccaccccucaacgagcgcugaucaacagagucuguaccagaacgccgacgcguacguguucgucgggacuucucgcuauuccaagaaauuuaagccugagaucgcaauucgaccaaaagugcgugagcaggaaggaagaaugaauuacuauuggacccuaguggagcccggugauaagaucacauucgaagccacuggcaaccucgucguuccuagguacgcuuuugccauggagcggaacgcagggagcggaauuaucauaucggacaccccagugcaugauugcaauacaaccugucaaacgccgaaaggcgcuauuaacacuucucugcccuuccagaauauccacccuauuacaaucgguaagugcccaaaguauguaaaauccaccaaacuucgccuggccacuggguugagaaacgugcccucaauccagaguaggggacucuuuggcgcgauugccggcuucauagaagggggauggacagguauggucgacggcugguacggguaucaucaccagaaugagcaaggaagcggcuacgcagcugaccugaaauccacccagaacgccaucgaugagauuacgaauaaggugaacucuguuaucgaaaagaugaauacccaguuuacagcuguggguaaggaguucaaccacuuagaaaagcggauagagaaucugaacaaaaaggucgacgauggguuccucgacauuuggacuuacaaugccgaacuucugguguugcuagagaacgagcgcacccuggauuaucaugacagcaauguuaaaaaccucuacgaaaagguacgaucacagcugaaaaacaaugcaaaggagaucggcaacggauguuuugaguucuaucacaagugcgauaauacauguauggagagugugaaaaacggcacuuacgacuauccuaaguacuccgaagaggccaaacuuaauagagaggaaaucgauggggucaagcuggagagcaccaggauuuaucaaaucuuggcuauuuacucuacaguggcgucaagucucguccuggugguuagcuuaggagcaauauccuuuuggaugugcucuaacgguucgcugcagugccggaucuguauuuga

SEQ ID NO: 129501 - RNA, 1701 nt, Artificial Sequence; identical to SEQ ID NO: 125786
  derived and/or modified sequence opt3 from hemagglutinin__InfluenzaA__AEO01396

SEQ ID NO: 129502 - RNA, 1701 nt, Artificial Sequence
  derived and/or modified sequence opt3 from hemagglutinin__InfluenzaA__AEO01397
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacacugacgccuacguguucgucgggaccucucgcuauuccaagaaauuuaagccugagaucgcgauucgaccaaaagugcgugaucaggagggaagaaugaauuacuauuggacauugguggaacccggugacaagaucacuuucgaggcaaccggcaaccuggucguuccuagguacgccuuugcuauggaacggaacgccgggagcggaauaauuaucucggauacaccagugcaugacugcaauaccacgugucaaacuccgaaaggcgcaauuaacacaucucuacccuuccagaauauccacccuaucaccauugguaagugcccaaaguauguaaaauccacuaagcuccgccuggcuacagggcuuagaaacgugcccucaauacagaguaggggacuguuuggcgccaucgcgggcuucauugaagggggauggaccgguauggucgacggcugguacggguaucaucaccagaaugaacaaggaagcggcuacgccgcagauuugaaauccacgcagaacgcuaucgacgagauaaccaauaaggugaacucuguuauugagaaaaugaauacacaguuuacugccguggguaaggaguucaaccaccucgagaagcggaucgaaaaucugaacaaaaaggucgaugacggguucuuagauaucuggaccuacaaugcugagcugcucgugcuucuggaaaacgagcgcacauuggacuaucaugauagcaauguuaaaaaccuauacgagaagguacgaucacagcugaaaaacaaugccaaggaaauuggcaacggauguuuugaguucuaucacaagugcgacaauacuuguauggaaagugugaaaaacggcaccuacgauuauccuaaguacuccgaggaagcaaaacucaauagagaggagaucgacggggucaagcuggaaagcacaaggauuuaucaaauacuugccaucuacucuaccguggcuucaagucuggucuuggugguuagccucggagcgauuuccuuuuggaugugcucuaacgguucgcugcagugccggaucuguaucuga

SEQ ID NO: 129503 - RNA, 1701 nt, Artificial Sequence
  derived and/or modified sequence opt3 from hemagglutinin__InfluenzaA__AEO01398
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcgaauguguucgucgggacuucucgcuacuccaagaaauuuaagccugagauugcaauccgaccaaaagugcguggacaggaggguagaaugaacuauuacuggacccugguggaacccggcgauaagauuacauucgaggccacugggaaccuagucguuccuagguaugcuuuugccauggaacggaaugcaggaagcggcaucauaauuucggacaccccagugcaugauugcaacacaaccugucaaacgccgaaaggugcuaucaauacuucucuccccuuccagaacauucacccuaucacaaucgggaagugcccaaaguacguaaaauccaccaagcugcgccuugccacuggacugagaaaugugcccucaauucagaguaggggcuuguuuggcgcgauagccggguucaucgagggagguuggacaggcauggucgacgggugguauggauaccaucaccagaacgaacaaggcagcgguuaugcagcugaccucaaauccacccagaaugccauugaugagaucacgaacaagguaaauucuguuauagagaaaaugaacacccaguuuacagcuguggggaaggaguucaaucaccuggagaagcggauugaaaacuuaaauaaaaaggucgacgauggcuuccuggacaucuggacuuacaacgccgagcuccuugugcuguuggaaaaugagcgcacccuagauuaccaugacagcaacgugaaaaaccuguaugagaagguucgaaaucagcucaaaaacaaugcaaaggaaaucggaaacggcuguuuugaguucuaccacaagugcgauaauacauguauggaaucagugaaaaacgggacuuaugacuacccuaaguauagugaggaagccaaacugaauagagaggagauugauggagucaaacuugaauccaccaggaucuaccaaauucuggcuauauauagcacaguggcgucuucauugguccucgugguuagucugggugcaaucagcuuuuggaugugcuccaacggcucuuuacagugccggauuuguaucuga

SEQ ID NO: 129504 - RNA, 1701 nt, Artificial Sequence; identical to SEQ ID NO: 129403
  derived and/or modified sequence opt3 from hemagglutinin__InfluenzaA__AEO01399

SEQ ID NO: 129505 - RNA, 1701 nt, Artificial Sequence; identical to SEQ ID NO: 124685
  derived and/or modified sequence opt3 from hemagglutinin__InfluenzaA__AEO01402

SEQ ID NO: 129506 - RNA, 1701 nt, Artificial Sequence; identical to SEQ ID NO: 125849
  derived and/or modified sequence opt3 from hemagglutinin__InfluenzaA__AEO01403

SEQ ID NO: 129507 - RNA, 1701 nt, Artificial Sequence; identical to SEQ ID NO: 124685
  derived and/or modified sequence opt3 from hemagglutinin__InfluenzaA__AEO01404

SEQ ID NO: 129508 - RNA, 1701 nt, Artificial Sequence
  derived and/or modified sequence opt3 from hemagglutinin__InfluenzaA__AEO01405
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaugaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 129509 - RNA, 1701 nt, Artificial Sequence
  derived and/or modified sequence opt3 from hemagglutinin__InfluenzaA__AEO01407
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagcacgccauugacgagaucacgaacaagguaaauucuguuauagagaaaaugaacacccaguuuacagcuguggguaaggaguucaaucaucuggaaaagcggauugaaaacuuaaauaaaaaggucgaugacggguuccuggauaucuggacuuacaacgccgagcuccuugugcuguuggaaaaugagcgcacccuagacuaucacgauagcaacgugaaaaaucuguacgagaagguucgaucacagcucaaaaacaacgcaaaggaaaucggcaauggauguuuugaguucuaucauaagugcgacaacacauguauggaaagugugaaaaauggcacuuacgauuauccuaaguacuccgaggaagccaaacugaacagagaggagauuaauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129510 - RNA, 1701 nt, Artificial Sequence
  derived and/or modified sequence opt3 from hemagglutinin__InfluenzaA__AEO01408
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaagaucgacgauggguuccuggacaucuggacuuacaaugccgaacuccuuguccuguuggagaacgagcgcacccuagauuaucaugacagcaaugugaaaaaccuguacgaaaagguacgaucacagcucaaaaacaaugcaaaggagauuggcaacggauguuuugaguucuaucacaagugcgauaauacauguauggagaguguuaaaaacggcacuuacgacuauccuaaguacuccgaagaggccaaacugaauagagaggaaaucgauggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 129511 - RNA, 1701 nt, Artificial Sequence; identical to SEQ ID NO: 125787
  derived and/or modified sequence opt3 from hemagglutinin__InfluenzaA__AEO01409

SEQ ID NO: 129512 - RNA, 1701 nt, Artificial Sequence; identical to SEQ ID NO: 129403
  derived and/or modified sequence opt3 from hemagglutinin__InfluenzaA__AEO01410

SEQ ID NO: 129513 - RNA, 1701 nt, Artificial Sequence; identical to SEQ ID NO: 128104
  derived and/or modified sequence opt3 from hemagglutinin__InfluenzaA__AEO01411

SEQ ID NO: 129514 - RNA, 1701 nt, Artificial Sequence; identical to SEQ ID NO: 125038
  derived and/or modified sequence opt3 from hemagglutinin__InfluenzaA__AEO01412

SEQ ID NO: 129515 - RNA, 1701 nt, Artificial Sequence
  derived and/or modified sequence opt3 from hemagglutinin__InfluenzaA__AEO01413
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaguaacgcaaaggagaucggcaauggauguuuugaguucuaucacaaaugcgacaacacauguauggaauccgugaagaauggcacuuacgauuauccuaaauacagcgaagaggccaagcugaacagagaagagauugacggggucaaacuugagucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 129516 - RNA, 1701 nt, Artificial Sequence
  derived and/or modified sequence opt3 from hemagglutinin__InfluenzaA__AEO01414
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacaccgggagcggaaucauaauuucggauacaccagugcaugacugcucuaccacgugucaaacuccgaaaggcgcaaucaauacaucccuccccuuccagaacguacacccuauuaccaucgguaagugcccaaaguaugugaaaucaacuaagcugcgccuugcuacagggcugagaaauguccccaguauccagagcaggggauuguuuggcgccauugcgggcuucauagaagggggauggaccgguaugguggacggcugguacggguaucaucaccagaacgaacaaggauccggcuacgccgcagaucucaaaucuacgcagaaugcuaucgacgagauuaccaacaagguuaauagcgugaucgagaaaaugaacacacaguuuacugccgucgguaaggaguucaaucaccuggaaaagcggauagaaaacuuaaauaaaaagguggaugacggguuccuggauauuuggaccuacaacgcugagcuccuuguacuguuggaaaaugagcgcacacuagacuaucaugauucaaacguuaaaaaucuguacgagaaggugcgaagucagcucaaaaacaacgccaaggaaaucggcaauggauguuuugaguucuaucacaagugcgacaacacuuguauggaauccgucaaaaauggcaccuacgauuauccuaaguacagcgaggaagcaaaacugaacagagaggagaucgacggggugaaacuugaaucuacaaggauuuaucaaauccuggccauuuacucaaccgucgcuaguagcuuggugcucguugugucccugggagcgauaucuuuuuggaugugcucgaaugguagcuuacagugccggaucuguauuuga

SEQ ID NO: 129517 - RNA, 1701 nt, Artificial Sequence; identical to SEQ ID NO: 128316
  derived and/or modified sequence opt3 from hemagglutinin__InfluenzaA__AEO01416

SEQ ID NO: 129518 - RNA, 1701 nt, Artificial Sequence; identical to SEQ ID NO: 125849
  derived and/or modified sequence opt3 from hemagglutinin__InfluenzaA__AEO01418

SEQ ID NO: 129519 - RNA, 1701 nt, Artificial Sequence; identical to SEQ ID NO: 125849
  derived and/or modified sequence opt3 from hemagglutinin__InfluenzaA__AEO01419

SEQ ID NO: 129520 - RNA, 1701 nt, Artificial Sequence
  derived and/or modified sequence opt3 from hemagglutinin__InfluenzaA__AEO01420
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaauacaagcacaaugggaaacuauguaagcucagaggaguggcuccccugcaucuugguaaaugcaacauagccggcuggauccuggggaauccugagugugaaucuuugucaacagcaaguagcugguccuauauuguugagaccucuaacucggauaauggaacuugcuacccaggcgacuuuaucgauuaugaggagcucagggagcagcugucaagcgugaguuccuucgaacgguuugagauuuucccgaagacaucuagcuggcccaaccacgacuccaauaagggugucaccgccgcuuguccucaugcaggggccaaaucauuuuacaagaaccugaucuggcucgugaaaaagggaaauaguuauccaaaauuaagcaagucuuacauaaacgauaagggcaaagaaguacugguucuuuggggcauccaccaccccuccacgucagcugaccaacagagcuuguaccagaaugccgaugcguauguguucgucgggacuucccgcuacucuaagaaauuuaagccugagauugcaauccgaccaaaagugcgugaccaggagggaagaaugaacuauuacuggacccugguggaacccggugauaagauuacauucgaggccacuggcaaccuagucguuccuagguaugcuuuugccauggaacggaaugcaggguccggaaucauaauuagcgacaccccagugcaugauugcaacacaaccugucaaacgccgaaaggcgcuaucaauacuucgcuccccuuccagaacauucacccuaucacaaucgguaagugcccaaaguacguaaaaucuaccaagcugcgccuugccacugggcugagaaaugugcccuccauucagucaaggggauuguuuggcgcgauagccggcuucaucgaagggggauggacagguauggucgacggcugguauggguaccaucaccagaacgaacaaggaaguggcuacgcagcugaccucaaaagcacccagaaugccauugaugagaucacgaacaaggugaauaguguuauagagaaaaugaacacccaguuuacagcuguggguaaggaguucaaucaccuggaaaagcggauugaaaacuuaaauaaaaaggucgacgauggguuccuggacaucuggacuuauaacgccgagcuccuugugcuguuggaaaaugagcgcacccuagauuaccaugacucuaacguaaagaaccuguaugagaagguucgaagccagcucaaaaauaacgcaaaggaaaucggcaauggauguuuugaguucuaccacaagugcgauaacacauguauggaaucagugaaaaauggcacuuaugacuacccuaaguauagugaggaagccaaacugaacagagaggagauugauggggucaaacuugaauccaccaggaucuaccaaauucuggcuauauacagcacaguggcgucuucauugguccucgugguuagucugggagcaaucagcuuuuggaugugcuccaaugguucuuuacagugccggauuuguaucuga

SEQ ID NO: 129521 - RNA, 1701 nt, Artificial Sequence
  derived and/or modified sequence opt3 from hemagglutinin__InfluenzaA__AEO01421
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucaugauagcaauguaaagaaccuguacgagaagguucgcucacagcucaagaacaaugcaaaagagaucggcaacggauguuuugaguucuaucacaagugcgacaauacauguauggaaagugugaaaaacggcacuuacgauuauccuaaguacuccgaagaggccaaacugaaucgagaagagauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 129522 - RNA, 1701 nt, Artificial Sequence
  derived and/or modified sequence opt3 from hemagglutinin__InfluenzaA__AEO01422
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacuuauacccaaaacugagcaagucuuauaucaaugacaagggcaaagaaguacuuguuuuguggggcauucaccaccccuccaccucagcugaucaacagagccuguaccagaacgccgacgcguacguguucgucgggacgagucgcuauucuaagaaauuuaagccugagaucgcaauucgaccaaaagugcgugaucaggagggaagaaugaauuacuauuggacucuaguggaacccggugacaagaucaccuucgaggccacaggcaaccucgucguuccuagguacgcuuuugccauggaacggaacgcaggguccggaauaauuaucagcgauacuccagugcaugacugcaauaccacaugucaaaccccgaaaggcgcuauuaacacgucgcugcccuuccagaauauccacccuaucacuauugguaagugcccaaaguauguaaaaucuacaaaacuucgccuggccaccggguugagaaacgugcccuccauacagucaaggggacucuuuggcgcgaucgccggcuucauugaagggggauggacugguauggucgacggcugguacggguaucaucaccagaaugaacaaggaaguggcuacgcagcugaucugaaaagcacacagcacgccaucgacgagauaaccaacaagguuaauuccgugauugagaaaaugaacacgcaguuuaccgcuguggguaaggaguucaaucauuuagaaaagcggaucgaaaaccugaauaaaaaggucgaugacggguuccucgauaucuggacauacaacgccgagcuucugguguugcuagaaaaugagcgcacucuggacuaucacgauucuaacguaaagaaucucuacgagaagguucgaagccagcugaaaaacaacgcaaaggaaauuggcaauggauguuuugaguucuaucauaagugcgacaacaccuguauggaaucagugaaaaauggcacauacgauuauccuaaguacagugaggaagccaaacuuaacagagaggagaucaauggggucaagcuggaauccacuaggauuuaucaaauauuggcuaucuacagcaccguggcgucuucacucguccuggugguuaguuuaggagcaauuagcuuuuggaugugcuccaacgguucucugcagugccggaucuguaucuga

SEQ ID NO: 129523 - RNA, 1701 nt, Artificial Sequence
  derived and/or modified sequence opt3 from hemagglutinin__InfluenzaA__AEO01423
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucaccauucgaccaaaaguccgugaucaggagggaagaaugaauuacuauuggacacugguggaacccggugacaagaucacuuucgaggcaaccggcaaccuaguggucccuagguacgccuuugcuauggaacggaacgccgggagcggaauaauuaucucggauacaccaguucaugacugcaauaccacgugucaaacuccgaaaggcgcaauuaacacaucucuccccuuccagaauauccacccuaucaccauugguaagugcccaaaguaugugaaauccacuaagcugcgccuugcuacagggcugagaaacguacccucaauacagaguaggggauuguuuggcgccaucgcgggcuucauugaagggggauggaccgguaugguggacggcugguacggguaucaucaccagaaugaacaaggaagcggcuacgccgcagaucucaaauccacgcagaacgcuaucgacgagauaaccaauaaggucaacucugugauugagaaaaugaauacacaguuuacugccguugguaaggaguucaaccaccuggaaaagcggaucgaaaauuuaaacaaaaagguggaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucgacggggugaaacuugaaagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 129524 - RNA, 1701 nt, Artificial Sequence; identical to SEQ ID NO: 129521
  derived and/or modified sequence opt3 from hemagglutinin__InfluenzaA__AEO01424

SEQ ID NO: 129525 - RNA, 1701 nt, Artificial Sequence; identical to SEQ ID NO: 129521
  derived and/or modified sequence opt3 from hemagglutinin__InfluenzaA__AEO01425

SEQ ID NO: 129526 - RNA, 1701 nt, Artificial Sequence; identical to SEQ ID NO: 124685
  derived and/or modified sequence opt3 from hemagglutinin__InfluenzaA__AEO01426

SEQ ID NO: 129527 - RNA, 1701 nt, Artificial Sequence
  derived and/or modified sequence opt3 from hemagglutinin__InfluenzaA__AEO01427
augaaggccauccuggugguccuccuuuacaccuucgcuacagcaaacagcgacacucugugcauuggcuaucacgccaauaacuccacggauaccguugacacaguguuggagaaaaauguaacugugacccauucugucaacuuacuggaagauaagcacaaugggaaacuauguaagcucagaggaguggcgccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaaaaaucugaucuggcucgugaaaaagggaaacucuuacccaaaauuauccaagucauauauaaaugacaagggcaaagaaguacugguucuuuggggcauccaccaccccagcacgagugccgaucaacagucuuuguaccagaacgcugacgccuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacaagaucacgaauaaagugaacagcguuauagagaagaugaauacccaguuuacagccguggguaaggaguucaaccaccuggaaaaacggauugagaauuuaaacaagaaagucgaugacggguuccuggauaucuggacuuacaaugcugaacuccuugugcuguuggagaacgaacgcacccuagacuaucaugauucaaauguaaagaaccuguacgagaaaguucgaagucagcucaagaacaaugccaaggagaucggcaacggauguuuugaguucuaucacaaaugcgacaauacauguauggaauccgugaagaacggcacuuacgauuauccuaaauacagcgaagaggcaaagcugaauagagaagagauugacggggucaaacuugagucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 129528 - RNA, 1701 nt, Artificial Sequence
  derived and/or modified sequence opt3 from hemagglutinin__InfluenzaA__AEO01428
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccgaucacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgcauggccacugggcuuagaaaugugcccucaauucagaguaggggacuguuuggcgcgauagccggcuucaucgaagggggauggacagguauggucgauggcugguacggguaucaucaccagaacgaacaaggaagcggcuacgcagcugacuugaaauccacccagaaugccauugaugagaucacgaacaagguaaauucuguuauagagaaaaugaacacccaguuuacagcuguggguaaggaguucaaucaccucgaaaagcggauugaaaaccugaauaaaaaggucgacgauggguucuuagacaucuggacuuacaacgccgagcugcucgugcuucuggaaaaugagcgcaccuuggauuaucaugacagcaacgugaaaaaucuauacgagaagguucgaucacagcugaaaaacaacgcaaaggaaaucggcaauggauguuuugaguucuaucacaagugcgauaacacauguauggaaagugugaaaaauggcacuuacgacuauccuaaguacuccgaggaagccaaacucaacagagaggagauugauggggucaagcuggaaagcaccaggaucuaucaaauucuugcuauauacucuacaguggcgucaagucuggucuuggugguuagccucggagcaaucuccuuuuggaugugcucuaaugguucgcugcagugccggauuuguaucuga

SEQ ID NO: 129529 - RNA, 1701 nt, Artificial Sequence; identical to SEQ ID NO: 125849
  derived and/or modified sequence opt3 from hemagglutinin__InfluenzaA__AEO01429

SEQ ID NO: 129530 - RNA, 1701 nt, Artificial Sequence
  derived and/or modified sequence opt3 from hemagglutinin__InfluenzaA__AEO01430
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugacggggcaaaaaguuuuuauaagaaucugaucuggcucgugaaaaagggaaacagcuacccaaaauuaucuaaguccuauauaaaugauaagggcaaagaaguacugguucuuuggggcauccaccaccccucaacgagcgccgaccaacagaguuuguaccagaacgcugaugccuacguguucgucgggacuucucgcuauuccaagaaauuuaagccugagauugcgauccgaccaaaagugcgugaccaggagggaagaaugaauuacuauuggacccugguggaacccggugauaagauuacauucgaggcaacuggcaaccuagucguuccuagguacgccuuugcuauggaacggaacgccgggagcggaaucauaauuucggacaccccagugcaugacugcaauacaaccugucaaacgccgaaaggcgcaaucaacacuucucuccccuuccagaauauucacccuaucacaaucgguaagugcccaaaguauguaaaauccaccaagcugcgccuugcuacugggcugagaaacgugcccucaauucagaguaggggauuguuuggcgccauagcgggcuucaucgaagggggauggacagguauggucgauggcugguacggguaucaucaccagaaugaacaaggaagcggcuacgccgcagaccucaaauccacccagaacgcuauugaugagaucacgaauaaggugaacucuguuauagagaaaaugaauacccaguuuacagccguggguaaggaguucaaccaccuggaaaagcggauugaaaauuuaaacaaaaaggucgacgauggguuccuggacaucuggacuuacaaugcugagcuccuugugcuguuggaaaacgagcgcacccuagauuaucaugacagcaauguaaagaaccuguacgagaagguucgaucacagcucaaaaacaaugccaaggaaaucggcaacggauguuuugaguucuaucacaagugcgauaauacauguauggaaagugugaaaaacggcacuuacgacuauccuaaguacuccgaggaagcaaaacugaauagagaggagauugauggggucaaacuugaaagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 129531 - RNA, 1701 nt, Artificial Sequence; identical to SEQ ID NO: 129403
  derived and/or modified sequence opt3 from hemagglutinin__InfluenzaA__AEO01431

SEQ ID NO: 129532 - RNA, 1701 nt, Artificial Sequence; identical to SEQ ID NO: 124685
  derived and/or modified sequence opt3 from hemagglutinin__InfluenzaA__AEO01432

SEQ ID NO: 129533 - RNA, 1701 nt, Artificial Sequence
  derived and/or modified sequence opt3 from hemagglutinin__InfluenzaA__AEO01434
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuuggugagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaaauaaaucuuauauaaacgacaagggcaaggagguacugguucuuuggggcauccaccaccccuccacgucagcugaucaacagagcuuguaccagaaugccgacgcguacguguucgucgggacuucccgcuauucuaaaaaguuuaaaccugagauugcaauccgaccaaaggugcgugaucaggaaggaagaaugaacuacuauuggacccugguggagcccggugacaaaauuacauucgaagccacuggcaaccuagucguuccuagguacgcuuuugccauggagcggaaugcaggguccggaaucauaauuagcgauaccccagugcaugacugcaacacaaccugucaaacgccgaagggcgcuaucaauacuucgcuccccuuccagaacauucacccuaucacaaucggugaaugcccaaaauauguaaagucuaccaagcugcgccuugccacugggcugagaaaugugcccuccauucagucaaggggauuguuuggcgcgauagccggcuucaucgaagggggauggacagguauggucgacggcugguacggguaucaucaccagaacgagcaaggaaguggcuacgcagcugaucucaaaagcacccagaaugccauugacaagaucacgaacaaagugaauaguguuauagaaaagaugaacacccaguuuacagcuguggguaaagaguucaaucaccuggaaaagcggauugagaacuuaaauaagaaagucgaugacggguuccuggauaucuggacuuacaacgccgaacuccuugugcuguuggagaaugagcgcacccuagacuaucaugauucuaacguaaagaaccuguacgaaaaaguucgaagccagcucaagaauaacgcaaaagagaucggcaauggauguuuugaguucuaucacaagugcgacaacacauguauggagucagugaagaauggcacuuacgauuauccuaaauacagugaagaggccaagcugaacagagaggaaauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 129534 - RNA, 1701 nt, Artificial Sequence
  derived and/or modified sequence opt3 from hemagglutinin__InfluenzaA__AEO01435
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccaguguaugacugcaauacaaccugucaaacgccgaaaggcgcuaucaacacuucucuccccuuccagaauauucauccuaucacaaucgguaagugcccaaaguacguaaaauccaccaagcugcgccuugccacugggcugagaaacgugcccucaauucagaguaggggauuguuuggcgcgauagccggcuucaucgaagggggauggacagguauggucgacggcugguauggguaccaccaucagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuauaaugccgaacuccuugugcuguuggagaacgaacgcacccuagacuaccacgauagcaauguaaagaaccuguaugagaaaguucgaaaccagcucaagaauaacgcaaaggagaucggcaauggauguuuugaguucuaccauaaaugcgacaacacauguauggaaucagugaagaauggcacuuaugauuacccuaaauauagugaagaggccaagcugaacagagaagagauugacggggucaaacuugaguccaccaggaucuaccaaauucuggcuauauacagcacaguggcgucuucauugguccucgugguuagucugggagcaaucagcuuuuggaugugcuccaaugguucuuuacagugccggauuuguaucuga

SEQ ID NO: 129535 - RNA, 1701 nt, Artificial Sequence; identical to SEQ ID NO: 129521
  derived and/or modified sequence opt3 from hemagglutinin__InfluenzaA__AEO01436

SEQ ID NO: 129536 - RNA, 1701 nt, Artificial Sequence; identical to SEQ ID NO: 129403
  derived and/or modified sequence opt3 from hemagglutinin__InfluenzaA__AEO01437

SEQ ID NO: 129537 - RNA, 1701 nt, Artificial Sequence; identical to SEQ ID NO: 129454
  derived and/or modified sequence opt3 from hemagglutinin__InfluenzaA__AEO01438

SEQ ID NO: 129538 - RNA, 1701 nt, Artificial Sequence; identical to SEQ ID NO: 125038
  derived and/or modified sequence opt3 from hemagglutinin__InfluenzaA__AEO01440

SEQ ID NO: 129539 - RNA, 1701 nt, Artificial Sequence
  derived and/or modified sequence opt3 from hemagglutinin__InfluenzaA__AEO01441
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgaugggagcggaaucauaauuucggacaccccagugcaugacugcaauacaaccugucaaacgccgaaaggcgcaaucaacacuucucuccccuuccagaauauucacccuaucacaaucgguaagugcccaaaguauguaaaauccaccaagcugcgccuugcuacugggcugagaaacgugcccucaauucagaguaggggauuguuuggcgccauagcgggcuucaucgaagggggauggacagguauggucgauggcugguacggguaucaucaccagaaugaacaaggaagcggcuacgccgcagaccucaaauccacccagaacgcuauugauaagaucacgaauaaagugaacucuguuauagagaagaugaauacccaguuuacagccguggguaaggaguucaaccaccuggaaaaacggauugagaauuuaaacaagaaagucgacgauggguuccuggacaucuggacuuacaaugcugaacuccuugugcuguuggagaacgaacgcacccuagauuaucaugacagcaauguaaagaaccuguacgagaaaguucgaucacagcucaagaacaaugccaaggagaucggcaacggauguuuugaguucuaucacaaaugcgauaauacauguauggaaagugugaagaacggcacuuacgacuauccuaaauacuccgaagaggcaaagcugaauagagaagagauugauggggucaaacuugagagcaccaggaucuaucaaauucuggccauauacucuacaguggcuucaaguuugguccucgugguuagccugggagcgaucuccuuuuggaugugcucuaacgguucguuacagugccggauuuguaucuga

SEQ ID NO: 129540 - RNA, 1701 nt, Artificial Sequence; identical to SEQ ID NO: 126105
  derived and/or modified sequence opt3 from hemagglutinin__InfluenzaA__AEO01442

SEQ ID NO: 129541 - RNA, 1701 nt, Artificial Sequence
  derived and/or modified sequence opt3 from hemagglutinin__InfluenzaA__AEO01443
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaaggaaaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacaagaucacgaauaaagugaacucuguuauagagaagaugaauacccaguuuacagcugugggcaaggaguucaaccaccuggagaaacggauugaaaauuuaaacaagaaagucgaugacgguuuccuggauaucuggacuuacaaugccgagcuccuugugcuguuggaaaacgagcgcacccuagacuaucaugauagcaauguaaagaaccuguacgagaaaguucgaucacagcucaagaacaaugcaaaggaaaucgggaacggcuguuuugaguucuaucacaaaugcgacaauacauguauggaaagugugaagaacggaacuuacgauuauccuaaauacuccgaggaagccaagcugaauagagaggagauugacggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 129542 - RNA, 1701 nt, Artificial Sequence
  derived and/or modified sequence opt3 from hemagglutinin__InfluenzaA__AEO01444
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagacaucuagcuggcccaaccacgauuccgacaagggugucaccgccgcuuguccucaugcaggggccaaaucauuuuauaagaaucugaucuggcucgugaaaaagggaaacaguuacccaaaauuaagcaagucuuauauaaaugauaagggcaaagaaguacugguucuuuggggcauccaccaccccuccacgucagcugaccaacagagcuuguaccagaacgccgaugcguacguguucgucgggaccagucgcuauucuaagaaauuuaagccugagauugcaauccgaccaaaagugcgugaccaggagggaagaaugaauuacuauuggacucugguggaacccggugauaagauuacauucgaggccacuggcaaccuagucguuccuagguacgcuuuugccauggaacggaacgcaggguccggaaucauaauuagcgacaccccagugcaugacugcaauacaaccugucaaacgccgaaaggcgcuaucaacacuucgcuccccuuccagaauauucacccuaucacaaucgguaagugcccaaaguauguaaaaucuaccaagcugcgccuugccacugggcugagaaacgugcccuccauucagucaaggggauuguuuggcgcgauagccggcuucaucgaagggggauggacagguauggucgauggcugguacggguaucaucaccagaaugaacaaggaaguggcuacgcagcugaccucaaaagcacccagaacgccauugauaagaucacgaauaaagugaacuccguuauagagaagaugaauacccaguuuacagcuguggguaaggaguucaaccaccuggaaaaacggauugagaauuuaaacaagaaagucgacgauggguuccuggacaucuggacuuacaaugccgaacuccuugugcuguuggagaacgaacgcacccuagauuaucaugacucuaauguaaagaaccuguacgagaaaguucgaagccagcucaagaacaaugcaaaggagaucggcaacggauguuuugaguucuaucacaaaugcgauaauacauguauggaaucagugaagaacggcacuuacgacuauccuaaauacagugaagaggccaagcugaauagagaagagauugauggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129543 - RNA, 1701 nt, Artificial Sequence; identical to SEQ ID NO: 126853
  derived and/or modified sequence opt3 from hemagglutinin__InfluenzaA__AEO01445

SEQ ID NO: 129544 - RNA, 1701 nt, Artificial Sequence; identical to SEQ ID NO: 129403
  derived and/or modified sequence opt3 from hemagglutinin__InfluenzaA__AEO01446

SEQ ID NO: 129545 - RNA, 1701 nt, Artificial Sequence
  derived and/or modified sequence opt3 from hemagglutinin__InfluenzaA__AEO01447
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaaucgcgucaaguuuggugcucgucgugagccugggagcaauuuccuuuuggaugugcucuaacgguucguuacagugccggaucuguaucuga

SEQ ID NO: 129546 - RNA, 1701 nt, Artificial Sequence; identical to SEQ ID NO: 125038
  derived and/or modified sequence opt3 from hemagglutinin__InfluenzaA__AEO01448

SEQ ID NO: 129547 - RNA, 1701 nt, Artificial Sequence; identical to SEQ ID NO: 129521
  derived and/or modified sequence opt3 from hemagglutinin__InfluenzaA__AEO01449

SEQ ID NO: 129548 - RNA, 1701 nt, Artificial Sequence
  derived and/or modified sequence opt3 from hemagglutinin__InfluenzaA__AEO01450
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcacugaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagcacgcuauugacgagaucaccaacaagguaaauucuguuauagagaaaaugaacacacaguuuacugccguggguaaggaguucaaucaucuggaaaagcggauugaaaacuuaaauaaaaaggucgaugacggguuccuggauaucuggaccuacaacgcugagcuccuugugcuguuggaaaaugagcgcacacuagacuaucacgauagcaacgugaaaaaucuguacgagaagguucgaucacagcucaaaaacaacgccaaggaaaucggcaauggauguuuugaguucuaucauaagugcgacaacacuuguauggaaagugugaaaaauggcaccuacgauuauccuaaguacuccgaggaagcaaaacugaacagagaggagauugacggggucaaacuugaaagcacaaggaucuaucaaauucuggccauauacucuaccguggcuucaaguuugguccucgugguuagccugggagcgaucuccuuuuggaugugcucuaaugguucguuacagugccggauuuguaucuga

SEQ ID NO: 129549 - RNA, 1701 nt, Artificial Sequence; identical to SEQ ID NO: 124685
  derived and/or modified sequence opt3 from hemagglutinin__InfluenzaA__AEO01451

SEQ ID NO: 129550 - RNA, 1701 nt, Artificial Sequence
  derived and/or modified sequence opt3 from hemagglutinin__InfluenzaA__AEO01452
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcagaagccaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagcucaugacugcaauacaaccugucaaacgccgaaaggagccaucaacacuucucuccccuuccagaauauucacccuaucacaaucggcaagugcccaaaguaugugaaauccaccaagcugcgccuugcgacuggucugagaaacguacccucaauucagaguaggggguuguuuggagccauagcaggcuucaucgaaggcggguggacaggaaugguggacgguugguacggcuaucaucaccagaaugagcaagggagcggauacgcugccgaucucaaauccacccagaacgcuauugacgagaucacgaauaaggucaacucugugauagagaaaaugaauacccaguuuacagccguuggcaaggaguucaaccaccuggaaaagcggauugagaauuuaaacaaaaagguggaugacgguuuccuggauaucuggacuuacaaugcagaacuccuuguccuguuggagaacgagcgcacccuagacuaucaugauagcaaugugaaaaagcuguacgaaaaaguacgaucacagcucaagaacaacgccaaggagaucgggaauggcuguuuugaguucuaucacaaaugcgacaacacauguauggaaaguguuaagaauggaacuuacgauuauccuaaauacuccgaagaggcuaagcugaacagagaggaaauugacggcgugaaacuugagagcaccaggaucuaucaaauucuggcgauauacucuacagucgcaucaaguuuggugcucgucgugagccugggggccaucuccuuuuggaugugcucuaauggaucguuacagugccggauuuguaucuga

SEQ ID NO: 129551 - RNA, 1701 nt, Artificial Sequence
  derived and/or modified sequence opt3 from hemagglutinin__InfluenzaA__AEO01453
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcgugcaccaccccucaaccagcgcugaucaacagaguuuguaccagaacgccgacgcguacgucuucguggggacgucucgcuauuccaagaaauuuaagcgagagauugcaauccguccuaaagugagagaucaggagggaaggaugaauuacuauuggacucuggucgaaccaggugacaagauuaccuucgaggccacaggcaaccuaguugugccccgguacgcuuuugccauggaacgcaacgcagggagcggaaucauaauuucggauacuccuguacaugacugcaauaccacaugucaaaccccaaaaggcgcuaucaacacgucucucccguuccagaauauucaccccaucacuaucgguaagugcccuaaguaugugaaauccacaaagcugagacuugccaccgggcugaggaacgucccaucaauucagagucggggauuguuuggcgcgauagccggcuucaucgaagggggauggacugguaugguggacggcugguacggguaucaucaccagaaugaacaaggaagcggcuacgcagcugaucucaaauccacacagcacgccauugacgagaucaccaacaagguuaauucugugauagagaaaaugaacacgcaguuuaccgcugucgguaaggaguucaaucaucuggaaaagcgcauugaaaacuuaaauaaaaagguggaugacggguuccuggauaucuggacauacaacgccgagcuccuuguacuguuggaaaaugagcgaacucuagacuaucacgauagcaacguuaaaaaucuguacgagaaggugagaucacagcucaaaaacaacgcaaaggaaaucggcaauggauguuuugaguucuaucauaagugcgacaacaccuguauggaaagugucaaaaauggcacauacgauuaucccaaguacuccgaggaagccaaacugaacagggaggagauuaauggggugaaacuugaaagcacucggaucuaucaaauucuggcuauauacucuaccgucgcgucaaguuuggugcucguugugagccugggagcaaucuccuuuuggaugugcucuaacgguucguuacagugccguauuuguaucuga

SEQ ID NO: 129552 - RNA, 1701 nt, Artificial Sequence
  derived and/or modified sequence opt3 from hemagglutinin__InfluenzaA__AEO01454
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuacaaccaucgguaagugcccaaaguauguaaaauccacuaagcuccgccuggccacagggcuuagaaacgugcccucaauucagaguaggggacuguuuggcgcgauagccggcuucaucgaagggggauggaccgguauggucgacggcugguacggguaucaucaccagaaugaacaaggaagcggcuacgcagcugauuugaaauccacgcagaacgccauugacgagaucaccaauaaggugaacucuguuauagagaaaaugaauacacaguuuacugcuguggguaaggaguucaaccaccucgagaagcggauugaaaaucugaacaaaaaggucgaugacggguucuuagauaucuggaccuacaaugccgagcugcucgugcuucuggaaaacgagcgcacauuggacuaucaugauagcaauguuaaaaaccuauacgagaagguacgaucacagcugaaaaacaaugcaaaggaaaucggcaacggauguuuugaguucuaucacaagugcgacaauacuuguauggaaagugugaaaaacggcaccuacgauuauccuaaguacuccgaggaagccaaacucaauagagaggagauugacggggucaagcuggaaagcacaaggaucuaucaaauucuugcuauauacucuaccguggcgucaagucuggucuuggugguuagccucggagcaaucuccuuuuggaugugcucuaacgguucgcugcagugccggauuuguaucuga

SEQ ID NO: 129553 - RNA, 1701 nt, Artificial Sequence
  derived and/or modified sequence opt3 from hemagglutinin__InfluenzaA__AEO01455
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacauucccucaauacagaguaggggauuguuuggcgcgaucgccggcuucauugaagggggauggacagguaugguggacggcugguacggguaucaucaccagaaugagcaaggaagcggcuacgcagcugaccucaaauccacccagaacgccaucgaugagauaacgaauaaggucaacucugugauugaaaagaugaauacccaguuuacagcuguugguaaggaguucaaccaccuggaaaagcggaucgagaauuuaaacaaaaagguggacgauggguuccuggacaucuggacuuacaaugccgaacuccuuguccuguuggagaacgagcgcacccuagauuaucaugacagcaaugugaaaaaccuguacgaaaagguacgaucacagcucaaaaacaaugcaaaggagauuggcaacggauguuuugaguucuaucacaagugcgauaauacauguauggagaguguuaaaaacggcacuuacgacuauccuaaguacuccgaagaggccaaacugaauagagaggaaaucgauggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 129554 - RNA, 1701 nt, Artificial Sequence
  derived and/or modified sequence opt3 from hemagglutinin__InfluenzaA__AEO01456
augaaggccauccugauugugcuccuuuacaccuucgcuacagcaaacgccgacacucugugcauaggcuaucacgcgaauaacagcacggauaccgucgacacauuguuagagaaaaauguuacugugacccauuccguaaaccugcuagaagauaagcacaaugggaaacucuguaagcugagaggaguggcuccccuucaucuggguaaaugcaacaucgccggcuggauuuuggggaauccugagugugaaucucucucaacagcaaguagcugguccuacaucgucgagaccucuucgucagacaacggaacuugcuauccaggcgauuuuauugacuacgaagaacugagggagcagcugagcaguguguccucuuucgaacgguuugagaucuucccgaagacaagcuccuggcccaaucacgauucaaacaaggguguuaccgccgcuuguccucaugcaggggccaaaaguuuuuauaagaaucucauaugguuagugaaaaagggaaacagcuacccaaaacugucuaaguccuauaucaaugacaagggcaaagaaguccuuguguuguggggcauucaccaccccucaacgagcgcugaucaacagagucuguaccagaacgccgacgcguacguauucguugggacuucucgcuauuccaagaaauuuaagccugagaucgcaauucgaccaaaagugcgugaucaggagggaagaaugaauuacuauuggacccuagucgaacccggugacaagaucacauucgaggccacuggcaaccucguggugccuagguacgcuuuugccauggaucggaacgcagggagcggaauaauuaucucggacgcuccaguccaugacugcaauaccacaugucaaaccccgaaaggcgccauuaacacgucucugcccuuccagaauauccacccuaucacuauugguaagugcccaaaguauguuaaauccacaaaacuucgccuggcgaccggguugagaaacgugcccucaauacagaguaggggacucuuuggcgccaucgcaggcuucauugaagggggauggacugguaugguagauggcugguacggguaucaucaccagaaugagcaaggaagcggcuacgcugccgaccugaaauccacacagaacgcuaucgaugaaauaaccaauaaggugaacucugucauugagaaaaugaauacgcaguuuaccgccguggguaaggaguucaaccacuuagaaaagcggaucgagaaucugaacaaaaagguugacgauggguuccucgacaucuggacauacaaugcagaacuucugguguugcuagagaacgaacgcacucuggauuaucaugacagcaaugucaaaaaccucuacgagaaggugcgaucacagcugaaaaacaaugccaaggagauuggcaacggauguuuugaguucuaucacaagugcgauaauaccuguauggagaguguaaagaacggcacauacgacuauccuaaguacuccgaagaggcuaaacuuaauagagaagagaucgaugggguuaagcuggagagcacuaggauuuaucaaauauuggcgaucuacucuaccguggcaucaagucucguccugguggucagcuuaggagccauuuccuuuuggaugugcucuaacgguucgcugcagugccggaucuguaucuga

SEQ ID NO: 129555 - RNA, 1701 nt, Artificial Sequence; identical to SEQ ID NO: 129454
  derived and/or modified sequence opt3 from hemagglutinin__InfluenzaA__AEO01457

SEQ ID NO: 129556 - RNA, 1701 nt, Artificial Sequence; identical to SEQ ID NO: 129450
  derived and/or modified sequence opt3 from hemagglutinin__InfluenzaA__AEO01458

SEQ ID NO: 129557 - RNA, 1701 nt, Artificial Sequence; identical to SEQ ID NO: 129450
  derived and/or modified sequence opt3 from hemagglutinin__InfluenzaA__AEO01459

SEQ ID NO: 129558 - RNA, 1701 nt, Artificial Sequence; identical to SEQ ID NO: 126105
  derived and/or modified sequence opt3 from hemagglutinin__InfluenzaA__AEO01461

SEQ ID NO: 129559 - RNA, 1701 nt, Artificial Sequence; identical to SEQ ID NO: 125786
  derived and/or modified sequence opt3 from hemagglutinin__InfluenzaA__AEO01462

SEQ ID NO: 129560 - RNA, 1701 nt, Artificial Sequence; identical to SEQ ID NO: 125038
  derived and/or modified sequence opt3 from hemagglutinin__InfluenzaA__AEO01463

SEQ ID NO: 129561 - RNA, 1701 nt, Artificial Sequence
  derived and/or modified sequence opt3 from hemagglutinin__InfluenzaA__AEO01464
augaaggccauccuggugguccuccuuuacaccuucgcuacagcaaacgccgacacucugugcauuggcuaucacgcgaauaacagcacggauaccguugacacauuguuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaagaacugagggagcagcugagcaguguuuccucuuucgaacgguuugagauuuucccgaagacaagcuccuggcccaaucacgauucaaacaagggugugaccgccgcuuguccucaugcaggggccaaaaguuuuuauaagaaucucaucugguuagucaaaaagggaaacagcuacccaaaacugucuaaguccuauauaaaugacaagggcaaagaagugcuuguauuguggggcauccaccaccccucaacgagcgcugaucaacagagucuguaccagaacgccgacgcguacguuuucguggggacuucucgcuauuccaagaaauuuaagccugagauugcaauccgaccaaaaguccgugaucaggagggaagaaugaauuacuauuggacccuaguggaacccggugacaagauuacauucgaggccacuggcaaccucguggucccuagguacgcuuuugccauggaucggaacgcagggagcggaaucauaauuucggacaccucuguucaugacugcaauacaaccugucaaacgccaaaaggcgcuaucaacacuucccugccguuccagaauauucaccccaucacaaucgguaagugcccuaaguaugugaaaucaaccaaacuucgccuggccacuggguugagaaacguaccaaguauucagagcaggggacucuuuggcgcgauagccggcuucaucgaagggggauggacagguaugguggauggcugguacggguaucaucaccagaaugagcaaggauccggcuacgcagcugaccugaagucuacccagaacgccauugaugaaaucacgaauaaggucaacagcgugauagagaaaaugaauacccaguuuacagcuguugguaaggaguucaaccacuuagaaaagcggauugagaaucugaacaaaaagguggacgauggguuccucgacaucuggacuuacaaugccgaacuucuggucuugcuagagaacgaacgcacccuggauuaucaugacucaaaugugaaaaaccucuacgagaagguacgaagucagcugaaaaacaaugcaaaggagaucggcaacggauguuuugaguucuaucacaagugcgauaauacauguauggaguccguuaaaaacggcacuuacgacuaucccaaguacagcgaagaggccaaacuuaauagagaagagauugauggggugaagcuggagucuaccaggaucuaucaaauuuuggcuauauacucaacagucgcgaguagccucgugcuggucguguccuuaggagcaaucucuuuuuggaugugcucgaacgguagccugcagugccggauuuguaucuga

SEQ ID NO: 129562 - RNA, 1701 nt, Artificial Sequence; identical to SEQ ID NO: 129541
  derived and/or modified sequence opt3 from hemagglutinin__InfluenzaA__AEO01465

SEQ ID NO: 129563 - RNA, 1701 nt, Artificial Sequence; identical to SEQ ID NO: 126557
  derived and/or modified sequence opt3 from hemagglutinin__InfluenzaA__AEO01466

SEQ ID NO: 129564 - RNA, 1701 nt, Artificial Sequence; identical to SEQ ID NO: 125038
  derived and/or modified sequence opt3 from hemagglutinin__InfluenzaA__AEO01467

SEQ ID NO: 129565 - RNA, 1701 nt, Artificial Sequence; identical to SEQ ID NO: 125849
  derived and/or modified sequence opt3 from hemagglutinin__InfluenzaA__AEO01468

SEQ ID NO: 129566 - RNA, 1701 nt, Artificial Sequence; identical to SEQ ID NO: 124685
  derived and/or modified sequence opt3 from hemagglutinin__InfluenzaA__AEO01469

SEQ ID NO: 129567 - RNA, 1701 nt, Artificial Sequence
  derived and/or modified sequence opt3 from hemagglutinin__InfluenzaA__AEO01470
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucaucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 129568 - RNA, 1701 nt, Artificial Sequence; identical to SEQ ID NO: 129394
  derived and/or modified sequence opt3 from hemagglutinin__InfluenzaA__AEO01471

SEQ ID NO: 129569 - RNA, 1701 nt, Artificial Sequence; identical to SEQ ID NO: 126312
  derived and/or modified sequence opt3 from hemagglutinin__InfluenzaA__AEO01472

SEQ ID NO: 129570 - RNA, 1701 nt, Artificial Sequence
  derived and/or modified sequence opt3 from hemagglutinin__InfluenzaA__AEO01473
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccggagggcgcuaucaauacuucgcuccccuuccagaacauucacccuaucacaaucggugaaugcccaaaauauguaaagucuaccaagcugcgccuugccacugggcugagaaaugugcccuccauucagucaaggggauuguuuggcgcgauagccggcuucaucgaagggggauggacagguauggucgacggcugguacggguaucaucaccagaacgagcaaggaaguggcuacgcagcugaucucaaaagcacccagaaugccauugacaagaucacgaacaaagugaauaguguuauagaaaagaugaacacccaguuuacagcuguggguaaagaguucaaucaccuggaaaagcggauugagaacuuaaauaagaaagucgaugacggguuccuggauaucuggacuuacaacgccgaacuccuugugcuguuggagaaugagcgcacccuagacuaucaugauucuaacguaaagaaccuguacgaaaaaguucgaagccagcucaagaauaacgcaaaagagaucggcaauggauguuuugaguucuaucacaagugcgacaacacauguauggaaucagugaagaauggcacuuacgauuauccuaaauacagugaagaggccaagcugaacagagaggaaauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 129571 - RNA, 1701 nt, Artificial Sequence
  derived and/or modified sequence opt3 from hemagglutinin__InfluenzaA__AEO01474
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucagacaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugauaagaucacgaacaaaguuaauucugugauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacagcaacguaaagaaucuguacgagaaaguucgaucacagcucaagaacaacgcaaaggagaucggcaauggauguuuugaguucuaucacaaaugcgauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129572 - RNA, 1701 nt, Artificial Sequence
  derived and/or modified sequence opt3 from hemagglutinin__InfluenzaA__AEO01475
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggaccagucgcuauucuaagaaauuuaagccugagauugcaauccgaccaaaagugcgugaucaggagggaagaaugaacuacuauuggacucugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagcacgccauugacgagaucacgaauaaggugaacuccguuauagagaaaaugaauacccaguuuacagcuguggguaaggaguucaaccaucuggaaaagcggauugaaaauuuaaacaaaaaggucgaugacggguuccuggauaucuggacuuacaaugccgagcuccuugugcuguuggaaaacgagcgcacccuagacuaucacgauucuaauguaaagaaccuguacgagaagguucgaagccagcucaaaaacaaugcaaaggaaaucggcaacggauguuuugaguucuaucauaagugcgacaauacauguauggaaucagugaaaaacggcacuuacgauuauccuaaguacagugaggaagccaaacugaauagagaggagauugacggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129573 - RNA, 1701 nt, Artificial Sequence
  derived and/or modified sequence opt3 from hemagglutinin__InfluenzaA__AEO01476
augaaggccauccuggugguccuccuuuacaccuucagcacagcuaacgcagacacucugugcauuggcuaucacgccaauaacuccacggauaccguugacacaguguuggagaaaaauguaacugugacccauucugucaacuuacuggaagauaagcacaaugggaaacuauguaagcucagaggaguggcgccccugcaucuugguaaaugcaacauagcuggcuggauccuggggaauccugagugugaaucauugaguacagccagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuauccaagucauauauaaaugacaagggcaaagaaguacugguucuuuggggcauccaccaccccagcacgagugccgaucaacagucuuuguaccagaacgcugacgccuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguuaaaaaccuguacgagaagguacgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 129574 - RNA, 1701 nt, Artificial Sequence
  derived and/or modified sequence opt3 from hemagglutinin__InfluenzaA__AEO01477
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacgcauucguggggacuucucgcuauuccaagaaauuuaagccugagauugccauccgaccaaaaguccgugagcaggaaggaagaaugaauuacuauuggacccugguggagcccggugauaagauuacauucgaagcuacuggcaaccuaguggucccuagguacgccuuugcaauggagcggaacgcugggagcggaaucauaauuucggacaccccaguucaugauugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugagcaaggaagcggcuacgcugccgaccucaaauccacccagaacgcuauugaugagaucacgaauaaggucaacucugugauagaaaagaugaauacccaguuuacagccguugguaaggaguucaaccaccuggaaaagcggauugagaauuuaaacaaaaagguggacgauggguuccuggacaucuggacuuacaaugcagaacuccuuguccuguuggagaacgagcgcacccuagauuaucaugacagcaaugugaaaaaccuguacgaaaagguacgaucacagcucaaaaacaaugccaaggagaucggcaacggauguuuugaguucuaucacaagugcgauaauacauguauggagaguguuaaaaacggcacuuacgacuauccuaaguacuccgaagaggcuaaacugaauagagaggaaauugauggggugaaacuugagagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 129575 - RNA, 1701 nt, Artificial Sequence; identical to SEQ ID NO: 126013
  derived and/or modified sequence opt3 from hemagglutinin__InfluenzaA__AEO01478

SEQ ID NO: 129576 - RNA, 1701 nt, Artificial Sequence; identical to SEQ ID NO: 129403
  derived and/or modified sequence opt3 from hemagglutinin__InfluenzaA__AEO01479

SEQ ID NO: 129577 - RNA, 1701 nt, Artificial Sequence; identical to SEQ ID NO: 129450
  derived and/or modified sequence opt3 from hemagglutinin__InfluenzaA__AEO01480

SEQ ID NO: 129578 - RNA, 1701 nt, Artificial Sequence
  derived and/or modified sequence opt3 from hemagglutinin__InfluenzaA__AEO01482
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcaauaacacauguauggaaagugugaagaauggcacuuacgacuauccuaaauacuccgaagaggccaagcugaacagagaagagauugauggggucaaacuugagagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129579 - RNA, 1701 nt, Artificial Sequence
  derived and/or modified sequence opt3 from hemagglutinin__InfluenzaA__AEO01483
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucgacuacgaggagcucagggagcagcugucaagcgugaguuccuucgaacgguuugagauuuucccgaagacaucuagcuggcccaaccacgauuccaauaagggugucaccgccgcuuguccucaugcaggggccaaaucauuuuauaagaaccugaucuggcucgugaaaaagggaaauaguuacccaaaauuaagcaagucuuauauaaacgacaagggcaaagaaguacugguucuuuggggcauccaccaccccuccacgucagcugaucaacagagcuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacaagaucacgaacaaagugaauaguguuauagagaagaugaacacccaguuuacagcuguggguaaggaguucaaucaccuggaaaaacggauugagaacuuaaauaagaaagucgaugacggguuccuggauaucuggacuuacaacgccgaacuccuugugcuguuggagaaugaacgcacccuagacuaucaugauucuaacguaaagaaccuguacgagaaaguucgaagccagcucaagaauaacgcaaaggagaucggcaauggauguuuugaguucuaucacaaaugcgacaacacauguauggaaucagugaagaauggcacuuacgauuauccuaaauacagugaagaggccaagcugaacagagaagagauugacggggucaaacuugaguccaccaggaucuaucaaauucuggcuauauacagcacagcggcaucuucauuggugcucgucgugagucugggagccaucagcuuuuggaugugcuccaaugguucuuuacagugccggauuuguaucuga

SEQ ID NO: 129580 - RNA, 1701 nt, Artificial Sequence
  derived and/or modified sequence opt3 from hemagglutinin__InfluenzaA__AEO01484
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcgacauagccggcuggauccuggggaacccugagugugaaucuuugucaacagcaaguagcugguccuacauuguugagaccucuucgucagauaauggaacuugcuauccaggcgacuuuaucgauuacgaggagcucagagagcagcugagcaguguguccucuuucgaaagguuugagauuuucccgaagacaagcuccuggcccaaccacgacucaaauaaaggugucaccgccgcuuguccucaugcaggggccaagaguuuuuauaaaaaccugaucuggcucgugaagaaaggaaauagcuacccaaaguuaucuaaguccuauauaaacgauaaaggcaaggaaguacugguucuuuggggcauccaccaccccucaacgagcgcugaccaacagaguuuguaccagaaugccgaugcguacguguucgucgggacuucucgguauuccaaaaaguuuaaaccugagauugcaauccgcccaaaggugcgagaccaggagggacguaugaacuacuauuggacccugguggaacccggugauaaaauuacauucgaggccacuggcaaucuagucguuccuagauacgcuuuugccauggaaaggaacgcagggagcggaaucauaauuucggacaccccagugcaugacugcaacacaaccugucaaacgccgaagggcgcuaucaauacuucucuccccuuccagaacauucacccuaucacaaucgguaagugcccaaaauauguaaaguccaccaaacugcggcuugccacugggcugcgcaaugugcccucaauucagaguagaggauuguuuggcgcgauagccggcuucaucgaagggggauggacagguauggucgauggcugguacggguaucaucaccagaacgaacaaggaagcggcuacgcagcugaccucaaguccacccagcacgccauugaugagaucacgaauaaagugaacucuguuauagagaagaugaauacccaguuuacagcuguggguaaggaauuuaaccaucuggagaaaaggauugaaaauuuaaacaagaaagucgacgauggguuccuggacaucuggacuuacaaugccgagcuccuugugcuguuggaaaacgagcggacccuagauuaucacgacagcaauguaaagaaccuguacgagaaaguucgcucacagcucaagaauaacgcaaaggaaaucggcaacggauguuucgaguucuaucauaaaugcgauaauacauguauggaaagugugaagaacggcacuuacgacuauccuaaauacuccgaggaagccaagcugaaucgagaggagauugauggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 129581 - RNA, 1701 nt, Artificial Sequence
  derived and/or modified sequence opt3 from hemagglutinin__InfluenzaA__AEO01485
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauuaccauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 129582 - RNA, 1701 nt, Artificial Sequence
  derived and/or modified sequence opt3 from hemagglutinin__InfluenzaA__AEO01487
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguacgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucacccuugaaagcacaaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 129583 - RNA, 1701 nt, Artificial Sequence
  derived and/or modified sequence opt3 from hemagglutinin__InfluenzaA__AEO01488
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuuaccauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgguaucaccaauaaggugaacucuguuauagagaaaaugaauacacaguuuacugccguggggaaggaguucaaccaccuggaaaagcggauugagaauuuaaacaaaaaggucgaugacggcuuccuggauaucuggaccuacaaugcugaacuccuugugcuguuggagaacgaacgcacacuagacuaucaugauagcaauguaaagaaccuguacgagaagguucgaucacagcucaaaaacaaugccaaggagaucggaaacggcuguuuugaguucuaucacaagugcgacaauacuuguauggaaagugugaaaaacgggaccuacgauuauccuaaguacuccgaagaggcaaaacugaauagagaagagauugacggagucaaacuugagagcacaaggaucuaucaaauucuggccauauacucuaccguggcuucaaguuugguccucgugguuagccugggugcgaucuccuuuuggaugugcucuaacggcucguuacagugccggauuuguaucuga

SEQ ID NO: 129584 - RNA, 1701 nt, Artificial Sequence
  derived and/or modified sequence opt3 from hemagglutinin__InfluenzaA__AEO01489
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuucgaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 129585 - RNA, 1701 nt, Artificial Sequence
  derived and/or modified sequence opt3 from hemagglutinin__InfluenzaA__AEO01490
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgcauggccacugggcuuagaaacgugcccucaauucagaguaggggacuguuuggcgcgauagccggcuucaucgaagggggauggacagguauggucgacggcugguacggguaucaucaccagaaugaacaaggaagcggcuacgcagcugauuugaaauccacccagaacgccauugacgagaucacgaauaaggugaacucuguuauagagaaaaugaauacccaguuuacagcuguggguaaggaguucaaccaccucgaaaagcggauugaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaaaccagcugaaaaauaacgcaaaggaaaucggcaauggauguuuugaguucuaucacaagugcgacaacacauguauggaaucagugaaaaauggcacuuacgauuauccuaaguacagugaggaagccaaacucaacagagaggagauugacggggucaagcuggaauccaccaggaucuaucaaauucuugcuauauacagcacaguggcgucuucacuggucuuggugguuagucucggagcaaucagcuuuuggaugugcuccaaugguucucugcagugccggauuuguaucuga

SEQ ID NO: 129586 - RNA, 1701 nt, Artificial Sequence
  derived and/or modified sequence opt3 from hemagglutinin__InfluenzaA__AEO01491
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaaguacaaugggaaacuauguaagcucagaggaguggcuccccugcaccuugguaaaugcaacauagccggcuggauccuggggaauccugagugugaaucuuugucaacagcaaguagcugguccuauauuguugagaccucuucgucagacaacggaacuugcuacccaggcgauuuuaucgacuaugaggagcucagggagcagcugagcaguguguccucuuucgaacgguuugagauuuucccgaagacaagcuccuggcccaaucaugauucaaacaagggugucaccgccgcuuguccucacgcaggggccaaaaguuuuuacaagaaucugaucuggcucgugaaaaagggaaacagcuauccaaaauuaucuaaguccuacauaaaugacaagggcaaagaaguacugguucuuuggggcauccaucaccccucaacgagcgcugaucaacagaguuuguaccagaacgccgacgcguauguguucgucgggacuucucgcuacuccaagaaauuuaagccugagauugcaauccgaccaaaagugcgugaucaggagggaagaaugaauuaucacuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129587 - RNA, 1701 nt, Artificial Sequence; identical to SEQ ID NO: 129454
  derived and/or modified sequence opt3 from hemagglutinin__InfluenzaA__AEO01492

SEQ ID NO: 129588 - RNA, 1701 nt, Artificial Sequence
  derived and/or modified sequence opt3 from hemagglutinin__InfluenzaA__AEO01493
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggagcgcagggucgggaauaauuaucucugauaccccagugcaugacugcaacacaaccugucaaacgccgaaaggcgcuauuaauacuucccuacccuuccagaacauccacccuaucacaauugguaagugcccaaaguauguaaaaucaaccaagcuccgccuggccacugggcuuagaaaugugcccaguauacagagcaggggacuguuuggcgcgaucgccggcuucauugaagggggauggacagguauggucgacggcugguacggguaucaucaccagaacgaacaaggauccggcuacgcagcugauuugaaaucuacccagaaugccaucgacgagauaacgaacaaggugaauagcguuauugagaaaaugaacacccaguuuacagcuguggguaaggaguucaaucaccucgagaagcggaucgaaaaccugaauaaaaaggucgaugacggguucuuagauaucuggacuuacaacgccgagcugcucgugcuucuggaaaaugagcgcaccuuggacuaucaugauucaaacguuaaaaaucuauacgagaagguacgaagucagcugaaaaacaacgcaaaggaaauuggcaauggauguuuugaguucuaucacaagugcgacaacacauguauggaauccgugaaaaauggcacuuacgauuauccuaaguacagcgaggaagccaaacucaacagagaggagaucgacggggucaagcuggaaucuaccaggauuuaucaaauacuugcuaucuacucaacaguggcgaguagccuggucuuggugguuucccucggagcaauuucuuuuuggaugugcucgaaugguagccugcagugccggaucuguaucuga

SEQ ID NO: 129589 - RNA, 1701 nt, Artificial Sequence
  derived and/or modified sequence opt3 from hemagglutinin__InfluenzaA__AEO01494
augaaggccauccuggugguccuccuuuacaccuucgcuacagcaaacgccgacacucugugcacgggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauugacuacgaggagcucagggagcagcugagcaguguguccucuuucgaacgguuugagaucuucccgaagaccagcuccuggcccaaucacgauucaaacaagggugucacggccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacuagcgcugaucaacagaguuuguaccagaacgccgacgcguacguguucgucgggaccucucgcuauuccaagaaauuuaagccugagaucgcaauucgaccaaaagugcgugaucaggagggaagaaugaauuacuauuggacacugguggaacccggugacaagaucacuuucgaggccaccggcaaccuagucguuccuagguacgcuuuugccauggaacggaacgcagggagcggaauuaucauaucggauacaccagugcaugacugcaauaccacgugucaaacuccgaaaggcgcuauuaacacaucucuccccuuccagaauauccacccuauuaccaucgguaagugcccaaaguauguaaaauccacuaagcugcgccuugccacagggcugagaaacgugcccucaauccagaguaggggauuguuuggcgcgauugccggcuucauagaagggggauggaccgguauggucgacggcugguacggguaucaucaccagaaugaacaaggaagcggcuacgcagcugaucucaaauccacgcagaacgccaucgacgagauuaccaauaaggugaacucuguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauagcaauguaaagaaccuguacgagaagguucgaaaccagcucaaaaauaacgcaaaggaaaucggcaauggauguuuugaguucuaucacaagugcgacaacacuuguauggaaucagugaaaaauggcaccuacgauuauccuaaguacagugaggaagccaaacugaacagagaggagaucgacggggucaaacuugaauccacaaggauuuaucaaauccuggcuauuuacagcaccguggcgucuucauugguccucgugguuagucugggagcaaucagcuuuuggaugugcuccaaugguucuuuacagugccggauauguauuuga

SEQ ID NO: 129590 - RNA, 1701 nt, Artificial Sequence; identical to SEQ ID NO: 126282
  derived and/or modified sequence opt3 from hemagglutinin__InfluenzaA__AEO01496

SEQ ID NO: 129591 - RNA, 1701 nt, Artificial Sequence; identical to SEQ ID NO: 125038
  derived and/or modified sequence opt3 from hemagglutinin__InfluenzaA__AEO01497

SEQ ID NO: 129592 - RNA, 1701 nt, Artificial Sequence; identical to SEQ ID NO: 126282
  derived and/or modified sequence opt3 from hemagglutinin__InfluenzaA__AEO01498

SEQ ID NO: 129593 - RNA, 1701 nt, Artificial Sequence
  derived and/or modified sequence opt3 from hemagglutinin__InfluenzaA__AEO01499
augaaggccauccuggugguccuccuuuacaccuucgcuauugcaaacgccgacacacugugcauaggcuaucacgcgaauaacagcacugauacgguugacaccguguuggagaagaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccuacaccucagcugaucaacagagcuuguaccagaacgccgacgcguauguguucgucgggacgagucgcuacucuaagaaauuuaagccugagaucgcaauucgaccaaaagugcgugaucaggagggaagaaugaauuauuacuggacucugguggaacccggugacaagaucaccuucgaggccacaggcaaccuagucguuccuagguaugcuuuugccauggaacggaacgcaggguccggaauaauuaucagcgauacuccagugcaugacugcaauaccacaugucaaaccccgaaaggcgcuauuaacacgucgcuccccuuccagaauauccacccuaucacuauugguaagugcccaaaguacguaaaaucuacaaagcugcgccuugccaccgggcugagaaacgugcccuccauacagucaaggggauuguuuggcgcgaucgccggcuucauugaagggggauggacugguauggucgacggcugguauggguaccaucaccagaaugaacaaggaaguggcuacgcagcugaucucaaaagcacacagcacgccaucgacgagauaaccaacaagguaaauuccguuauugagaaaaugaacacgcaguuuaccgcuguggguaaggaguucaaucaucuggaaaagcggaucgaaaacuuaaauaaaaaggucgaugacggguuccuggauaucuggacauauaacgccgagcuccuugugcuguuggaaaaugagcgcacucuagacuaccacgauucuaacgugaaaaaucuguaugagaagguucgaagccagcucaaaaacaacgcaaaggaaauuggcaauggauguuuugaguucuaccauaagugcgacaacaccuguauggaaucagugaaaaauggcacauaugauuacccuaaguauagugaggaagccaaacugaacagagaggagaucaauggggucaaacuugaauccacuaggauuuaccaaauacuggcuaucuacagcaccguggcgucuucauugguccucgugguuagucugggagcaauuagcuuuuggaugugcuccaacgguucuuuacagugccggaucuguaucuga

SEQ ID NO: 129594 - RNA, 1701 nt, Artificial Sequence; identical to SEQ ID NO: 125786
  derived and/or modified sequence opt3 from hemagglutinin__InfluenzaA__AEO01500

SEQ ID NO: 129595 - RNA, 1701 nt, Artificial Sequence; identical to SEQ ID NO: 125849
  derived and/or modified sequence opt3 from hemagglutinin__InfluenzaA__AEO01501

SEQ ID NO: 129596 - RNA, 1701 nt, Artificial Sequence; identical to SEQ ID NO: 125849
  derived and/or modified sequence opt3 from hemagglutinin__InfluenzaA__AEO01502

SEQ ID NO: 129597 - RNA, 1701 nt, Artificial Sequence; identical to SEQ ID NO: 126105
  derived and/or modified sequence opt3 from hemagglutinin__InfluenzaA__AEO01503

SEQ ID NO: 129598 - RNA, 1701 nt, Artificial Sequence; identical to SEQ ID NO: 126282
  derived and/or modified sequence opt3 from hemagglutinin__InfluenzaA__AEO01505

SEQ ID NO: 129599 - RNA, 1701 nt, Artificial Sequence; identical to SEQ ID NO: 125786
  derived and/or modified sequence opt3 from hemagglutinin__InfluenzaA__AEO01506

SEQ ID NO: 129600 - RNA, 1701 nt, Artificial Sequence; identical to SEQ ID NO: 129394
  derived and/or modified sequence opt3 from hemagglutinin__InfluenzaA__AEO01507

SEQ ID NO: 129601 - RNA, 1701 nt, Artificial Sequence; identical to SEQ ID NO: 126282
  derived and/or modified sequence opt3 from hemagglutinin__InfluenzaA__AEO01508

SEQ ID NO: 129602 - RNA, 1701 nt, Artificial Sequence; identical to SEQ ID NO: 126013
  derived and/or modified sequence opt3 from hemagglutinin__InfluenzaA__AEO01510

SEQ ID NO: 129603 - RNA, 1701 nt, Artificial Sequence
  derived and/or modified sequence opt3 from hemagglutinin__InfluenzaA__AEO01511
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccacaaguagcugguccuacauuguugagacuucuucgucagacaacggaaccugcuauccaggcgauuuuaucgacuacgaagaacucagggagcagcugagcaguguguccucuuucgaacgguuugagauuuucccgaagacgagcuccuggcccaaucacgauucaaacaagggugucacugccgcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgcagaucaacagaguuuguaccagaacgccgacgcuuacguguucgucgggacaucucgcuauuccaagaaauuuaagccugagauugccauccgaccaaaagugcgugagcaggaaggaagaaugaauuacuauuggacucugguggagcccggugauaagauuaccuucgaagcgacaggcaaccuagucguuccuagguacgcauuugccauggagcggaacgcugggagcggaaucauaauuucggacaccccagugcaugauugcaauacgacuugucaaacaccgaaaggcgccaucaacaccucucuccccuuccagaauauucacccuaucacuaucgguaagugcccaaaguauguaaaauccacaaagcugcgccuugcaaccgggcugagaaacgugcccucaauucagaguaggggauuguuuggcgcuauagccggcuucaucgaagggggauggacggguauggucgacggcugguacggguaucaucaccagaaugagcaaggaagcggcuacgcggccgaccucaaauccacccagaacgcaauugauaagaucacaaauaaagugaacucuguuauagagaagaugaauacucaguuuaccgcuguggguaaggaguucaaccaccuggagaaacggauugaaaauuuaaacaagaaagucgacgauggguuccuggacaucuggacauacaaugccgagcuccuugugcuguuggaaaacgagcgcacucuagauuaucaugacagcaauguaaagaaccuguacgagaaaguucgaucacagcucaagaacaaugcuaaggaaaucggcaacggauguuuugaguucuaucacaaaugcgauaauaccuguauggaaagugugaagaacggcacauacgacuauccuaaauacuccgaggaagccaagcugaauagagaggagauugauggggucaaacuugaaagcaccaggaucuaucaaauucuggcaauauacucuacuguggccucaaguuugguccucgugguuagccugggagcuaucuccuuuuggaugugcucuaacgguucguuacagugccggauuuguaucuga

SEQ ID NO: 129604 - RNA, 1701 nt, Artificial Sequence
  derived and/or modified sequence opt3 from hemagglutinin__InfluenzaA__AEO01512
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuuugaguucuaucacaagugcgauaauaaauguauggaaagugugaagaacggcacauacgacuauccuaaauacuccgaagaggccaagcugaauagagaggaaauugauggggucaaacuugagagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 129605 - RNA, 1701 nt, Artificial Sequence
  derived and/or modified sequence opt3 from hemagglutinin__InfluenzaA__AEO01513
augaaggccauccuggcugugcuccuuuacaccuucgcaacagccaacgcggacacucugugcauuggcuaucacgcuaauaacagcacggauaccgucgacacaguuuuggagaaaaaugugacuguaacccauuccgugaacauauuagaagauaagcacaaugggaaacuguguaagcuaagaggagucgcaccccuccaucuggguaaaugcaacaucgccggcuggauucuugggaauccugagugugaaucucugucaacagccaguagcugguccuacaucguggagaccucuucgucagacaacggaacuugcuauccaggcgauuuuauugacuacgaagaguugagggagcagcucagcaguguuuccucuuucgaacgguuugagaucuucccgaagacaagcuccuggcccaaucacgauucaaacaagggugugaccgcugcauguccucaugccggggcuaaaaguuuuuauaagaaucugauauggcuggucaaaaagggaaacagcuacccaaaacucucuaaguccuauaucaaugacaagggcaaagaaguguuaguacuguggggcauucaccaccccucaacgagcgccgaucaacagagucuuuaccagaacgcggacgcauacguuuucguggggucuucccgcuauagcaagaaauuuaagccugagaucgccauucgaccaaaaguccgugaucaggagggaagaaugaauuacuauuggacuuugguggaacccggugacaagaucaccuucgaggcuacaggcaaccugguggucccuagguacgccuuugcaauggaacggaacgcugggucgggaauaauuaucucugauacuccaguucaugacugcaauaccacaugucaaaccccgaaaggcgccauuaacacgucccuacccuuccagaauauccacccugugacuaucgguaagugcccaaaguauguaaaaucaacaaagcuccgccuggcgaccgggcuuagaaacgugcccaguauucagagcaggggacuguuuggcgccauagcaggcuucaucgaagggggauggacugguauggucgacggcugguacggguaucaucaccagaaugaacaaggauccggcuacgcugccgauuugaaaucuacacagaacgcuauugacgagaucaccaauaaggugaacagcguuauagagaaaaugaauacgcaguuuaccgccguggguaaggaguucaaccaccucgagaagcggauugaaaaucugaacaaaaaggucgaugacggguucuuagauaucuggacauacaaugcagagcugcucgugcuucuggaaaacgagcgcacuuuggacuaucaugauucaaauguuaaaaaccuauacgagaagguacgaagucagcugaaaaacaaugccaaggaaaucggcaacggauguuuugaguucuaucacaagugcgacaauaccuguauggaauccgugaaaaacggcacauacgauuauccuaaguacagcgaggaagcuaaacucaauagagaggagauugacggggucaagcuggaaucuacuaggaucuaucaaauucuugcgauauacucaaccguggcaaguagccuggucuuggugguuucccucggagccaucucuuuuuggaugugcucgaacgguagccugcagugccggauuuguaucuga

SEQ ID NO: 129606 - RNA, 1701 nt, Artificial Sequence
  derived and/or modified sequence opt3 from hemagglutinin__InfluenzaA__AEO01514
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaugcacaaugggaagcuauguaaacucagaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugagcaggaaggaagaaugaauuacuauuggacccugguggagcccggugauaaaauuacauucgaagccacuggcaaccuagucguuccuagguacgcuuuugccauggagcggaacgcagggagcggaaucauaauuucggacaccccagugcaugauugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaguccacccagaacgccauugauaaaaucacgaauaaggugaacucuguuauagagaaaaugaauacccaguuuacagcuguggguaaggaguucaaccaccuggagaagcggauugaaaauuuaaacaaaaaggucgacgauggguuccuggacaucuggacuuacaaugccgagcuccuugugcuguuggaaaacgagcgcacccuagauuaucaugacagcaauguaaagaaccuguacgagaagguucgaucacagcucaaaaacaaugcaaaggaaaucggcaacggauguuuugaguucuaucacaagugcgauaauacauguauggaaagugugaaaaacggcacuuacgacuauccuaaguacuccgaggaagccaaacugaauagagaggagauugauggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129607 - RNA, 1701 nt, Artificial Sequence; identical to SEQ ID NO: 126872
  derived and/or modified sequence opt3 from hemagglutinin__InfluenzaA__AEO01515

SEQ ID NO: 129608 - RNA, 1701 nt, Artificial Sequence; identical to SEQ ID NO: 129454
  derived and/or modified sequence opt3 from hemagglutinin__InfluenzaA__AEO01516

SEQ ID NO: 129609 - RNA, 1701 nt, Artificial Sequence
  derived and/or modified sequence opt3 from hemagglutinin__InfluenzaA__AEO01517
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaaggaaaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccggaaggagcuaucaacacuucucuccccuuccagaauauucacccuaucacaaucggcaaaugcccaaaguauguaaaguccaccaaacugcgccuugccacuggucugagaaacgugcccucaauucagaguaggggguuguuuggagcgauagccggcuucaucgagggcggguggacaggaauggucgacgguugguacggcuaucaucaccagaaugagcaagggagcggauacgcagcugaucucaaguccacccagaacgccauugacgaaaucacgaauaaagugaacucuguuauagagaagaugaauacccaguuuacagcugugggcaaagaguucaaccaccuggagaagcggauugaaaauuuaaacaagaaagucgaugacgguuuccuggauaucuggacuuacaaugccgagcuccuugugcuguuggagaacgaacgcacccuagacuaucaugauagcaauguaaagaaccuguacgagaaaguucgaucacagcucaagaacaaugcaaaagaaaucgggaacggcuguuuugaguucuaucacaagugcgacaauacauguauggaaagugugaagaacggaacuuacgauuauccuaaauacuccgaggaggccaagcugaauagagaagagauugacggcgucaaacuugaaagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 129610 - RNA, 1701 nt, Artificial Sequence
  derived and/or modified sequence opt3 from hemagglutinin__InfluenzaA__AEO01518
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggauagugaaaaagggaaacagcuacccaaaacucaauaagucuuauaucaacgacaagggcaaagaaguauuaguucuguggggcauucaccaccccuccacgucagcugaucaacagagccuuuaccagaaugccgacgcguacguguucgucgggacuucccgcuauucuaagaaauuuaagccugagaucgcaauucgaccaaaagugcgugaucaggagggaagaaugaacuacuauuggaccuugguggaacccggugacaagaucacauucgaggccacuggcaaccuggucguuccuagguacgcuuuugccauggaacggaaugcaggguccggaauaauuaucagcgauaccccagugcaugacugcaacacaaccugucaaacgccgaaaggcgcuauuaauacuucgcuacccuuccagaacauccacccuaucacaauuggugagugcccaaaguauguaaagucuaccaaacuccgccuggccacugggcuuagaaaugugcccuccauacagucaaggggacuguuuggcgcgaucgccggcuucauugaagggggauggacagguauggucgacggcugguacggguaucaucaccagaacgagcaaggaaguggcuacgcagcugauuugaaaagcacccagaaugccaucgacaaaauaacgaacaaggugaauaguguuauugagaaaaugaacacccaguuuacagcuguggguaaggaguucaaucaccucgagaagcggaucgaaaaccugaauaaaaaggucgaugacggguucuuagauaucuggacuuacaacgccgagcugcucgugcuucuggaaaaugagcgcaccuuggacuaucaugauucuaacguaaagaaccuauacgagaagguucgaagccagcugaaaaauaacgcaaaggaaauuggcaauggauguuuugaguucuaucacaagugcgacaacacauguauggaaucagugaaaaauggcacuuacgauuauccuaaguacagugaggaagccaaacucaacagagaggagaucgacggggucaagcuggaauccaccaggauuuaucaaauacuugcuaucuacagcacaguggcgucuucacuggucuuggugguuagucucggagcaauuagcuuuuggaugugcuccaaugguucucugcagugccggaucuguaucuga

SEQ ID NO: 129611 - RNA, 1701 nt, Artificial Sequence
  derived and/or modified sequence opt3 from hemagglutinin__InfluenzaA__AEO01519
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuucgaccugagauugcaauccguccaaaggugagagagcaggaaggaaggaugaauuacuauuggacccugguggagcccggugauaaaauuacauucgaagccacuggcaaccuagucguuccucgguacgcuuuugccauggagcgcaacgcagggagcggaaucauaauuucggacaccccagugcaugauugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacauucccucaauacagagucggggauuguuuggcgcgaucgccggcuucauugaagggggauggacagguaugguggacggcugguacggguaucaucaccagaaugagcaaggaagcggcuacgcagcugaccucaaguccacccagaacgccaucgaugagauaacgaauaaagucaacucugugauugaaaagaugaauacccaguuuacagcuguugguaaagaguucaaccaccuggaaaagcgcaucgagaauuuaaacaagaaaguggacgauggguuccuggacaucuggacuuacaaugccgaacuccuuguccuguuggagaacgagcgaacccuagauuaucaugacagcaaugugaagaaccuguacgaaaaaguaagaucacagcucaagaacaaugcaaaagagauuggcaacggauguuuugaguucuaucacaagugcgauaauacauguauggagaguguuaagaacggcacuuacgacuauccuaaauacuccgaagaggccaagcugaauagggaggaaaucgauggggugaaacuugagagcacccggauuuaucaaauacuggcuaucuacucuacagucgcgucaaguuuggugcucgucgugagccugggagcaauuuccuuuuggaugugcucuaacgguucguuacagugccguaucuguaucuga

SEQ ID NO: 129612 - RNA, 1701 nt, Artificial Sequence; identical to SEQ ID NO: 127590
  derived and/or modified sequence opt3 from hemagglutinin__InfluenzaA__AEO01520

SEQ ID NO: 129613 - RNA, 1701 nt, Artificial Sequence; identical to SEQ ID NO: 126312
  derived and/or modified sequence opt3 from hemagglutinin__InfluenzaA__AEO01521

SEQ ID NO: 129614 - RNA, 1701 nt, Artificial Sequence; identical to SEQ ID NO: 128104
  derived and/or modified sequence opt3 from hemagglutinin__InfluenzaA__AEO01522

SEQ ID NO: 129615 - RNA, 1701 nt, Artificial Sequence; identical to SEQ ID NO: 125849
  derived and/or modified sequence opt3 from hemagglutinin__InfluenzaA__AEO01523

SEQ ID NO: 129616 - RNA, 1701 nt, Artificial Sequence; identical to SEQ ID NO: 129443
  derived and/or modified sequence opt3 from hemagglutinin__InfluenzaA__AEO01524

SEQ ID NO: 129617 - RNA, 1701 nt, Artificial Sequence
  derived and/or modified sequence opt3 from hemagglutinin__InfluenzaA__AEO01525
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccacgcuuaucuaaauccuauauaaaugauaagggcaaggaaguacugguucuuugggggauccaccaccccucaacgagcgcugaccaacagaguuuguaccagaacgccgaugcguacguguucgucggaacuucucgauauuccaaaaaguuuaaaccugagauugcaauccguccaaaggugagagaccaggaggguaggaugaauuacuauuggacccugguggaacccggcgauaaaauuacauucgaggccacugggaaccuagucguuccucgguacgcuuuugccauggaacgcaacgcaggaagcggcaucauaauuucggacaccccagugcaugauugcaauacaaccugucaaacgccgaagggugcuaucaacacuucucuccccuuccagaauauucacccuaucacaaucgggaaaugcccaaaguauguaaaguccaccaaacugagacuugccacuggacugaggaacgugcccucaauucagagucggggcuuguuuggcgcgauagccggguucaucgagggagguuggacaggcauggucgacgggugguacggauaucaucaccagaaugaacaaggcagcgguuacgcagcugaccucaaguccacccagaacgccauugaugagaucacgaauaaagugaacucuguuauagagaagaugaauacccaguuuacagcuguggggaaagaguucaaccaccuggagaagcgcauugaaaauuuaaacaagaaagucgacgauggcuuccuggacaucuggacuuacaaugccgagcuccuugugcuguuggaaaacgagcgaacccuagauuaucaugacagcaauguaaagaaccuguacgagaaaguuagaucacagcucaagaacaaugcaaaagaaaucggaaacggcuguuuugaguucuaucacaagugcgauaauacauguauggaaagugugaagaacgggacuuacgacuauccuaaauacuccgaggaagccaagcugaauagggaggagauugauggagucaaacuugaaagcacccggaucuaucaaauucuggcuauauacucuacaguggcgucaaguuugguccucgugguuagccugggugcaaucuccuuuuggaugugcucuaacggcucguuacagugccguauuuguaucuga

SEQ ID NO: 129618 - RNA, 1701 nt, Artificial Sequence; identical to SEQ ID NO: 125849
  derived and/or modified sequence opt3 from hemagglutinin__InfluenzaA__AEO01526

SEQ ID NO: 129619 - RNA, 1701 nt, Artificial Sequence; identical to SEQ ID NO: 128626
  derived and/or modified sequence opt3 from hemagglutinin__InfluenzaA__AEO01527

SEQ ID NO: 129620 - RNA, 1701 nt, Artificial Sequence
  derived and/or modified sequence opt3 from hemagglutinin__InfluenzaA__AEO01529
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaagugggcaacggauguuuugaguucuaucacaagugcgacaauaccuguauggaauccgucaaaaacggcacauacgauuauccuaaguacagcgaggaagccaaacucaauagagagaagauugacggggugaaacuggagucuacuaggaucuaucaaauucuugcuauauacucaaccgcggcaaguagccuggucuuggugguuucccucggagccaucucuuuuuggaugugcucgaacgguagccugcagugccggauuuguaucuga

SEQ ID NO: 129621 - RNA, 1701 nt, Artificial Sequence; identical to SEQ ID NO: 125849
  derived and/or modified sequence opt3 from hemagglutinin__InfluenzaA__AEO01530

SEQ ID NO: 129622 - RNA, 1701 nt, Artificial Sequence
  derived and/or modified sequence opt3 from hemagglutinin__InfluenzaA__AEO01531
augaaggccauccuggugguccuccuuuacaccuucgcuacagcaaacacugacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaagaacucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugagcaggaaggaagaaugaauuacuauuggacacugguggagcccggugauaagauuacuuucgaagcaaccggcaaccuagucguuccuagguacgccuuugcuauggagcggaacgccgggagcggaaucauaauuucggacacaccagugcaugauugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugagcaaggaagcggcuacgccgcagaccucaaauccacgcagaacgcuauugauaagaucaccaauaaagugaacucuguuauagagaagaugaauacacaguuuacugccguggguaaggaguucaaccaccuggagaaacggauugaaaauuuaaacaagaaagucgacgauggguuccuggacaucuggaccuacaaugcugagcuccuugugcuguuggaaaacgagcgcacacuagauuaucaugacagcaauguaaagaaccuguacgagaaaguucgaucacagcucaagaacaaugccaaggaaaucggcaacggauguuuugaguucuaucacaaaugcgauaauacuuguauggaaagugugaagaacggcaccuacgacuauccuaaauacuccgaggaagcaaagcugaauagagaggagauugauggggucaaacuugaaagcacaaggguguaucaaauccuggccauuuacucuaccgucgcuucaaguuuggugcucguugugagccugggagcgauauccuuuuggaugugcucuaacgguucguuacagugccggaucuguauuuga

SEQ ID NO: 129623 - RNA, 1701 nt, Artificial Sequence; identical to SEQ ID NO: 129454
  derived and/or modified sequence opt3 from hemagglutinin__InfluenzaA__AEO01532

SEQ ID NO: 129624 - RNA, 1701 nt, Artificial Sequence
  derived and/or modified sequence opt3 from hemagglutinin__InfluenzaA__AEO01533
augaaggccauccuggugguccuccuuuacaccuucgcuacagcaaacgccgacacucugugcauuggcuaucacgcgaauaacagcacggauaccguugacacaguguuggagaagaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 129625 - RNA, 1701 nt, Artificial Sequence
  derived and/or modified sequence opt3 from hemagglutinin__InfluenzaA__AEO01534
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaggaguuggagcuacauuguugagaccuccucuucggacaacggaacuugcuauccaggcgauuuuaucgacuacgaggagcuccgggagcagcugucaagcgugaguuccuucgaacgcuuugagauuuucccgaagacaucuagcuggcccaaucacgauuccaacaagggugucaccgccgcuuguccucaugcaggggccaaaucauuuuauaagaaucugaucuggcucgugaaaaagggaaacaguuacccaaaauuaagcaagucuuauauaaaugacaagggcaaagaaguacugguucuuuggggcauccaccaccccuccacgucagcugaucaacagagcuuguaccagaacgccgacgcguacguguucgucgggacuucccgauauucuaagaaauuuaagccugagauugcaauccguccaaaagugagagaucaggagggaaggaugaauuacuauuggacccugguggaacccggugacaagauuacauucgaggccacuggcaaccuagucguuccucgguacgcuuuugccauggaacgcaacgcaggguccggaaucauaauuagcgauaccccagugcaugacugcaauacaaccugucaaacgccgaaaggcgcuaucaacacuucgcuccccuuccagaauauucacccuaucacaaucgguaagugcccaaaguauguaaaaucuaccaagcugagacuugccacugggcugaggaacgugcccuccauucagucacggggauuguuuggcgcgauagccggcuucaucgaagggggauggacagguauggucgacggcugguacggguaucaucaccagaaugaacaaggaaguggcuacgcagcugaucucaaaagcacccagcacgccauugacgagaucacgaacaaggugaauaguguuauagagaaaaugaacacccaguuuacagcuguggguaaggaguucaaucaucuggaaaagcgcauugaaaacuuaaauaaaaaggucgaugacggguuccuggauaucuggacuuacaacgccgagcuccuugugcuguuggaaaaugagcgaacccuagacuaucacgauucuaacguaaagaaucuguacgagaagguuagaagccagcucaaaaacaacgcaaaggaaaucggcaauggauguuuugaguucuaucauaagugcgacaacacauguauggaaucagugaaaaauggcacuuacgauuauccuaaguacagugaggaagccaaacugaacagggaggagauugacggggucaaacuugaauccacccggaucuaucaaauucuggcuauauacagcacaguggcgucuucauugguccucgugguuagucugggagcaaucagcuuuuggaugugcuccaaugguucuuuacagugccguauuuguaucuga

SEQ ID NO: 129626 - RNA, 1701 nt, Artificial Sequence; identical to SEQ ID NO: 126334
  derived and/or modified sequence opt3 from hemagglutinin__InfluenzaA__AEO01535

SEQ ID NO: 129627 - RNA, 1701 nt, Artificial Sequence; identical to SEQ ID NO: 125849
  derived and/or modified sequence opt3 from hemagglutinin__InfluenzaA__AEO01536

SEQ ID NO: 129628 - RNA, 1701 nt, Artificial Sequence; identical to SEQ ID NO: 127590
  derived and/or modified sequence opt3 from hemagglutinin__InfluenzaA__AEO01537

SEQ ID NO: 129629 - RNA, 1701 nt, Artificial Sequence
  derived and/or modified sequence opt3 from hemagglutinin__InfluenzaA__AEO01538
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucggagguguggcuccccugcaucuuggcaaaugcaacauagccggguggauccugggaaauccugagugugaaucuuugucaacagcaaguagcugguccuacauuguugagaccucuucgucagacaacggcacuugcuauccaggugauuuuaucgacuacgaagaacucagagagcagcugagcaguguguccucuuucgaaagguuugagauuuucccgaagacaagcuccuggcccaaucacgauucaaacaagggggucaccgccgcuuguccucaugcaggagccaaaaguuuuuauaagaaucugaucuggcucgugaaaaagggcaacagcuacccaaaauuaucuaaguccuauauaaaugacaagggcaaagaaguacugguucuuugggggauccaccaccccucaacgagcgcugaucaacagaguuuguaccagaacgccgacgcguacguguucgucggaacuucucgguauuccaagaaauuuaagccugagauugcaauccgcccaaaagugcgagaucaggagggucguaugaauuacuauuggacccugguggaacccggcgacaagauuacauucgaggccacugggaaccuagucguuccuagauacgcuuuugccauggaaaggaacgcaggaagcggcaucauaauuucggauaccccagugcaugacugcaauacaaccugucaaacgccgaaaggugcuaucaacacuucucuccccuuccagaauauucacccuaucacaaucgggaagugcccaaaguauguaaaauccaccaagcugcggcuugccacuggacugcgcaacgugcccucaauucagaguagaggcuuguuuggcgcgauagccggguucaucgagggagguuggacaggcauggucgacgggugguacggauaucaucaccagaaugaacaaggcagcgguuacgcagcugaucucaaauccacccagaacgccauugacgagaucacgaauaaggugaacucuguuauagagaaaaugaauacccaguuuacagcuguggggaaggaguucaaccaccuggagaagaggauugaaaauuuaaacaaaaaggucgaugacggcuuccuggauaucuggacuuacaaugccgagcuccuugugcuguuggaaaacgagcggacccuagacuaucaugauagcaauguaaagaaccuguacgagaagguucgcucacagcucaaaaacaaugcaaaggaaaucggaaacggcuguuuugaguucuaucacaagugcgacaauacauguauggaaagugugaaaaacgggacuuacgauuauccuaaguacuccgaggaagccaaacugaaucgagaggagauugacggagucaaacuugaaagcaccagaaucuaucaaauucuggcuauauacucuacaguggcgucaaguuugguccucgugguuagccugggugcaaucuccuuuuggaugugcucuaacggcucguuacagugcaggauuuguaucuga

SEQ ID NO: 129630 - RNA, 1701 nt, Artificial Sequence; identical to SEQ ID NO: 126312
  derived and/or modified sequence opt3 from hemagglutinin__InfluenzaA__AEO01539

SEQ ID NO: 129631 - RNA, 1701 nt, Artificial Sequence
  derived and/or modified sequence opt3 from hemagglutinin__InfluenzaA__AEO01540
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugagaaacuauguaagcucagagggguggcuccccugcaucuuggaaaaugcaacaucgccgguuggauucugggcaauccugaaugugagucuuugucaaccgcaaguagcugguccuacaucguugaaacaucuucgucagacaacgggaccugcuauccaggagauuuuauugacuacgaggagcucagggaacagcugagcaguguguccucuuucgagcgguuugaaaucuucccgaagacuagcuccuggcccaaucacgauucaaacaagggcgucacagccgcuuguccucaugccggugcaaaaaguuuuuauaagaaucugauauggcucgugaaaaaggggaacagcuacccaaaauuaucuaaguccuauaucaaugacaagggaaaagagguacugguucuuuggggcauucaccaccccucaaccagcgcugaucaacagaguuuguaccagaacgccgacgcguacguguucgucggcacgucucgcuauuccaagaaauuuaagccugagaucgcaauucgaccaaaagugcgugaucaggaagggagaaugaauuacuauuggacucugguggagcccggagacaagaucaccuucgaagccacagguaaccuagucguuccuagguacgcuuuugccauggagcggaacgcaggcagcgggauaauuaucucggauacuccagugcaugacugcaauaccacaugucaaaccccgaaaggagcuauuaacacgucucuccccuuccagaauauccacccuaucacuauuggcaagugcccaaaguauguaaaauccacaaagcugcgccuugccaccggucugagaaacgugcccucaauacagaguaggggguuguuuggagcgaucgccggcuucauugaaggcggguggacuggaauggucgacgguugguacggcuaucaucaccagaaugagcaagggagcggauacgcagcugaucucaaauccacacagcacgccaucgacgagauaaccaacaagguaaauucuguuauugaaaagaugaacacgcaguuuaccgcugugggcaaggaguucaaucaucuggaaaagcggaucgagaacuuaaauaaaaaggucgaugacgguuuccuggauaucuggacauacaacgccgaacuccuugugcuguuggagaaugagcgcacucuagacuaucacgauagcaacgugaaaaaucuguacgaaaagguucgaucacagcucaaaaacaacgcaaaggagauugggaauggcuguuuugaguucuaucauaagugcgacaacaccuguauggaaagugugaaaaauggaacauacgauuauccuaaguacuccgaagaggccaaacugaacagagaggaaaucaauggcgucaaacuugagagcacuaggauuuaucaaauacuggcuaucuacucuaccguggcgucaaguuugguccucgugguuagccugggggcaauuuccuuuuggaugugcucuaacggaucguuacagugccggaucuguaucuga

SEQ ID NO: 129632 - RNA, 1701 nt, Artificial Sequence; identical to SEQ ID NO: 126105
  derived and/or modified sequence opt3 from hemagglutinin__InfluenzaA__AEO01541

SEQ ID NO: 129633 - RNA, 1701 nt, Artificial Sequence; identical to SEQ ID NO: 125849
  derived and/or modified sequence opt3 from hemagglutinin__InfluenzaA__AEO01542

SEQ ID NO: 129634 - RNA, 1701 nt, Artificial Sequence; identical to SEQ ID NO: 125786
  derived and/or modified sequence opt3 from hemagglutinin__InfluenzaA__AEO01543

SEQ ID NO: 129635 - RNA, 1701 nt, Artificial Sequence; identical to SEQ ID NO: 125786
  derived and/or modified sequence opt3 from hemagglutinin__InfluenzaA__AEO01544

SEQ ID NO: 129636 - RNA, 1701 nt, Artificial Sequence
  derived and/or modified sequence opt3 from hemagglutinin__InfluenzaA__AEO01545
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacucugggaaacuauguaagcucagaggaguggcuccccugcaucuugguaaaugcaauauagccggcuggauccuggggaacccugagugugaaucauugaguacagcaagcuccuggucuuacauuguugagaccucgucaagcgacaauggaacuugcuauccaggcgauuuuguggacuacgaggagcucagggagcagcugaguuccgucucuagcuucgaacgguuugagaucuucccgaagacauccucauggcccaaccacgauaguaauaagggugugaccgccgcuuguccucaugcaggggccaagagcuuuuauaaaaaccugauuuggcucguuaaaaagggaaauucuuacccaaaauuauccaagucauauaucaacgacaagggcaaagaaguacuggugcuuuggggcauacaccaccccagcacgagugcugaucaacagucuuuguaccagaaugccgacgcguacgucuucguggggacuucccgcuauagcaagaaauuuaagccugagaucgcaauucgaccaaaagugcgugaucaggagggaagaaugaacuacuauuggacccuggucgaacccggugacaagaucacauucgaggccacuggcaaucuaguugugccuagguacgcuuuugccauggaacggaacgcagggucgggaauuaucauaucugauaccccaguacaugacugcaacacaaccugucaaacgccgaaaggcgcuauuaauacuucccuccccuuccagaacauccacccuauuacaaucgguaagugcccaaaguaugugaaaucaaccaagcugcgccuugccacugggcugagaaauguccccaguauccagagcaggggauuguuuggcgcgauugccggcuucauagaagggggauggacagguaugguggacggcugguacggguaucaucaccagaacgaacaaggauccggcuacgcagcugaucucaaaucuacccagaaugccaucgacaagauuacgaacaaaguuaauagcgugaucgagaagaugaacacccaguuuacagcugucgguaaggaguucaaucaccuggaaaaacggauagagaacuuaaauaagaaaguggaugacggguuccuggauauuuggacuuacaacgccgaacuccuuguacuguuggagaaugaacgcacccuagacuaucaugauucaaacguuaagaaucuguacgagaaagugcgaagucagcucaagaacaacgcaaaggagaucggcaauggauguuuugaguucuaucacaaaugcgacaacacauguauggaauccgucaagaauggcacuuacgauuauccuaaauacagcgaagaggccaagcugaacagagaagagaucgacggggugaaacuugagucuaccaggauuuaucaaauccuggcuauuuacucaacagucgcgaguagcuuggugcucguugugucccugggagcaauaucuuuuuggaugugcucgaaugguagcuuacagugccggaucuguauuuga

SEQ ID NO: 129637 - RNA, 1701 nt, Artificial Sequence; identical to SEQ ID NO: 124672
  derived and/or modified sequence opt3 from hemagglutinin__InfluenzaA__AEO01546

SEQ ID NO: 129638 - RNA, 1701 nt, Artificial Sequence; identical to SEQ ID NO: 124672
  derived and/or modified sequence opt3 from hemagglutinin__InfluenzaA__AEO01547

SEQ ID NO: 129639 - RNA, 1701 nt, Artificial Sequence; identical to SEQ ID NO: 124865
  derived and/or modified sequence opt3 from hemagglutinin__InfluenzaA__AEO01548

SEQ ID NO: 129640 - RNA, 1701 nt, Artificial Sequence; identical to SEQ ID NO: 124776
  derived and/or modified sequence opt3 from hemagglutinin__InfluenzaA__AEO01549

SEQ ID NO: 129641 - RNA, 1701 nt, Artificial Sequence; identical to SEQ ID NO: 124685
  derived and/or modified sequence opt3 from hemagglutinin__InfluenzaA__AEO01550

SEQ ID NO: 129642 - RNA, 1701 nt, Artificial Sequence; identical to SEQ ID NO: 124685
  derived and/or modified sequence opt3 from hemagglutinin__InfluenzaA__AEO01551

SEQ ID NO: 129643 - RNA, 1701 nt, Artificial Sequence; identical to SEQ ID NO: 124685
  derived and/or modified sequence opt3 from hemagglutinin__InfluenzaA__AEO01552

SEQ ID NO: 129644 - RNA, 1701 nt, Artificial Sequence; identical to SEQ ID NO: 124685
  derived and/or modified sequence opt3 from hemagglutinin__InfluenzaA__AEO01553

SEQ ID NO: 129645 - RNA, 1701 nt, Artificial Sequence; identical to SEQ ID NO: 124685
  derived and/or modified sequence opt3 from hemagglutinin__InfluenzaA__AEO01554

SEQ ID NO: 129646 - RNA, 1701 nt, Artificial Sequence; identical to SEQ ID NO: 124865
  derived and/or modified sequence opt3 from hemagglutinin__InfluenzaA__AEO01555

SEQ ID NO: 129647 - RNA, 1701 nt, Artificial Sequence; identical to SEQ ID NO: 124685
  derived and/or modified sequence opt3 from hemagglutinin__InfluenzaA__AEO01557

SEQ ID NO: 129648 - RNA, 1701 nt, Artificial Sequence; identical to SEQ ID NO: 124685
  derived and/or modified sequence opt3 from hemagglutinin__InfluenzaA__AEO01558

SEQ ID NO: 129649 - RNA, 1701 nt, Artificial Sequence
  derived and/or modified sequence opt3 from hemagglutinin__InfluenzaA__AEO01559
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaagacugcaauacaaccugucagacgccgaaaggcgcuaucaacacuucucuccccuuccagaauauucauccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaccaucaaaaugaacagggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucacgauagcaauguaaagaaccuguacgagaagguucgaucacaacucaaaaacaaugcaaaggaaaucggcaacggauguuuugaguucuaucauaagugcgacaauacauguauggaaagugugaaaaacggcacuuacgauuauccuaaguacuccgaggaagccaaacugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 129650 - RNA, 1701 nt, Artificial Sequence; identical to SEQ ID NO: 124685
  derived and/or modified sequence opt3 from hemagglutinin__InfluenzaA__AEO01560

SEQ ID NO: 129651 - RNA, 1701 nt, Artificial Sequence; identical to SEQ ID NO: 124685
  derived and/or modified sequence opt3 from hemagglutinin__InfluenzaA__AEO01561

SEQ ID NO: 129652 - RNA, 1701 nt, Artificial Sequence; identical to SEQ ID NO: 124685
  derived and/or modified sequence opt3 from hemagglutinin__InfluenzaA__AEO01562

SEQ ID NO: 129653 - RNA, 1701 nt, Artificial Sequence; identical to SEQ ID NO: 124685
  derived and/or modified sequence opt3 from hemagglutinin__InfluenzaA__AEO01563

SEQ ID NO: 129654 - RNA, 1701 nt, Artificial Sequence; identical to SEQ ID NO: 124685
  derived and/or modified sequence opt3 from hemagglutinin__InfluenzaA__AEO01564

SEQ ID NO: 129655 - RNA, 1701 nt, Artificial Sequence; identical to SEQ ID NO: 124685
  derived and/or modified sequence opt3 from hemagglutinin__InfluenzaA__AEO01565

SEQ ID NO: 129656 - RNA, 1701 nt, Artificial Sequence; identical to SEQ ID NO: 124672
  derived and/or modified sequence opt3 from hemagglutinin__InfluenzaA__AEO01566

SEQ ID NO: 129657 - RNA, 1701 nt, Artificial Sequence; identical to SEQ ID NO: 124927
  derived and/or modified sequence opt3 from hemagglutinin__InfluenzaA__AEO01567

SEQ ID NO: 129658 - RNA, 1701 nt, Artificial Sequence; identical to SEQ ID NO: 124867
  derived and/or modified sequence opt3 from hemagglutinin__InfluenzaA__AEO01568

SEQ ID NO: 129659 - RNA, 1701 nt, Artificial Sequence; identical to SEQ ID NO: 124867
  derived and/or modified sequence opt3 from hemagglutinin__InfluenzaA__AEO01569

SEQ ID NO: 129660 - RNA, 1701 nt, Artificial Sequence; identical to SEQ ID NO: 124927
  derived and/or modified sequence opt3 from hemagglutinin__InfluenzaA__AEO01570

SEQ ID NO: 129661 - RNA, 1701 nt, Artificial Sequence; identical to SEQ ID NO: 124867
  derived and/or modified sequence opt3 from hemagglutinin__InfluenzaA__AEO01571

SEQ ID NO: 129662 - RNA, 1701 nt, Artificial Sequence; identical to SEQ ID NO: 124927
  derived and/or modified sequence opt3 from hemagglutinin__InfluenzaA__AEO01572

SEQ ID NO: 129663 - RNA, 1701 nt, Artificial Sequence; identical to SEQ ID NO: 124672
  derived and/or modified sequence opt3 from hemagglutinin__InfluenzaA__AEO01573

SEQ ID NO: 129664 - RNA, 1701 nt, Artificial Sequence; identical to SEQ ID NO: 124685
  derived and/or modified sequence opt3 from hemagglutinin__InfluenzaA__AEO01574

SEQ ID NO: 129665 - RNA, 1701 nt, Artificial Sequence; identical to SEQ ID NO: 124672
  derived and/or modified sequence opt3 from hemagglutinin__InfluenzaA__AEO01575

SEQ ID NO: 129666 - RNA, 1701 nt, Artificial Sequence; identical to SEQ ID NO: 124672
  derived and/or modified sequence opt3 from hemagglutinin__InfluenzaA__AEO01576

SEQ ID NO: 129667 - RNA, 1701 nt, Artificial Sequence; identical to SEQ ID NO: 124672
  derived and/or modified sequence opt3 from hemagglutinin__InfluenzaA__AEO01577

SEQ ID NO: 129668 - RNA, 1701 nt, Artificial Sequence; identical to SEQ ID NO: 124927
  derived and/or modified sequence opt3 from hemagglutinin__InfluenzaA__AEO01578

SEQ ID NO: 129669 - RNA, 1701 nt, Artificial Sequence; identical to SEQ ID NO: 124927
  derived and/or modified sequence opt3 from hemagglutinin__InfluenzaA__AEO01579

SEQ ID NO: 129670 - RNA, 1701 nt, Artificial Sequence; identical to SEQ ID NO: 124672
  derived and/or modified sequence opt3 from hemagglutinin__InfluenzaA__AEO01581

SEQ ID NO: 129671 - RNA, 1701 nt, Artificial Sequence; identical to SEQ ID NO: 124672
  derived and/or modified sequence opt3 from hemagglutinin__InfluenzaA__AEO01582

SEQ ID NO: 129672 - RNA, 1701 nt, Artificial Sequence; identical to SEQ ID NO: 124672
  derived and/or modified sequence opt3 from hemagglutinin__InfluenzaA__AEO01583

SEQ ID NO: 129673 - RNA, 1701 nt, Artificial Sequence; identical to SEQ ID NO: 124672
  derived and/or modified sequence opt3 from hemagglutinin__InfluenzaA__AEO01584

SEQ ID NO: 129674 - RNA, 1701 nt, Artificial Sequence; identical to SEQ ID NO: 124672
  derived and/or modified sequence opt3 from hemagglutinin__InfluenzaA__AEO01585

SEQ ID NO: 129675 - RNA, 1701 nt, Artificial Sequence; identical to SEQ ID NO: 124672
  derived and/or modified sequence opt3 from hemagglutinin__InfluenzaA__AEO01586

SEQ ID NO: 129676 - RNA, 1701 nt, Artificial Sequence; identical to SEQ ID NO: 124672
  derived and/or modified sequence opt3 from hemagglutinin__InfluenzaA__AEO01587

SEQ ID NO: 129677 - RNA, 1701 nt, Artificial Sequence; identical to SEQ ID NO: 124672
  derived and/or modified sequence opt3 from hemagglutinin__InfluenzaA__AEO01588

SEQ ID NO: 129678 - RNA, 1701 nt, Artificial Sequence; identical to SEQ ID NO: 124685
  derived and/or modified sequence opt3 from hemagglutinin__InfluenzaA__AEO01589

SEQ ID NO: 129679 - RNA, 1701 nt, Artificial Sequence; identical to SEQ ID NO: 124685
  derived and/or modified sequence opt3 from hemagglutinin__InfluenzaA__AEO01590

SEQ ID NO: 129680 - RNA, 1701 nt, Artificial Sequence; identical to SEQ ID NO: 124685
  derived and/or modified sequence opt3 from hemagglutinin__InfluenzaA__AEO01591

SEQ ID NO: 129681 - RNA, 1701 nt, Artificial Sequence; identical to SEQ ID NO: 124672
  derived and/or modified sequence opt3 from hemagglutinin__InfluenzaA__AEO01592

SEQ ID NO: 129682 - RNA, 1701 nt, Artificial Sequence; identical to SEQ ID NO: 124685
  derived and/or modified sequence opt3 from hemagglutinin__InfluenzaA__AEO01593

SEQ ID NO: 129683 - RNA, 1701 nt, Artificial Sequence; identical to SEQ ID NO: 124672
  derived and/or modified sequence opt3 from hemagglutinin__InfluenzaA__AEO01594

SEQ ID NO: 129684 - RNA, 1701 nt, Artificial Sequence; identical to SEQ ID NO: 124672
  derived and/or modified sequence opt3 from hemagglutinin__InfluenzaA__AEO01595

SEQ ID NO: 129685 - RNA, 1701 nt, Artificial Sequence; identical to SEQ ID NO: 124865
  derived and/or modified sequence opt3 from hemagglutinin__InfluenzaA__AEO01596

SEQ ID NO: 129686 - RNA, 1701 nt, Artificial Sequence; identical to SEQ ID NO: 124685
  derived and/or modified sequence opt3 from hemagglutinin__InfluenzaA__AEO01597

SEQ ID NO: 129687 - RNA, 1701 nt, Artificial Sequence
  derived and/or modified sequence opt3 from hemagglutinin__InfluenzaA__AEO01598
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaauggugucaccgccgcuuguccucaugcaggggccaagaguuuuuauaaaaaccugauuuggcucgugaagaaaggaaauagcuacccaaaguuaucuaaauccuauaucaacgacaagggcaaggaaguacugguucuuuggggcauacaccaccccucaacgagcgcugaucaacagaguuuguaccagaaugccgacgcguacguguucgucgggucuucccgcuauagcaaaaaguuuaaaccugagaucgcaauucgaccaaaggugcgugaucaggagggaagaaugaacuacuauuggacucugguggaacccggugacaaaaucaccuucgaggccacaggcaaccuagucguuccuagguacgcuuuugccauggaacggaaugcagggucgggaauuaucauaucugauacuccagugcaugacugcaacaccacaugucaaaccccgaagggcgcuauuaauacgucccuccccuuccagaacauccacccuauuacuaucgguaaaugcccaaaguauguaaagucaacaaaacugcgccuugccaccgggcugagaaaugugcccaguauccagagcaggggauuguuuggcgcgauugccggcuucauagaagggggauggacugguauggucgacggcugguacggguaucaucaccagaacgaacaaggauccggcuacgcagcugaucucaagucuacacagaaugccaucgacgagauuaccaacaaagugaauagcguuaucgagaagaugaacacgcaguuuaccgcuguggguaaagaguucaaucaccuggaaaagcggauagaaaacuuaaauaagaaagucgaugacggguuccuggauauuuggacauacaacgccgagcuccuugugcuguuggaaaaugagcgcacucuagacuaucaugauucaaacguaaagaaccuguacgagaaaguucgaagucagcucaagaauaacgcaaaagaaaucggcaauggauguuuugaguucuaucacaagugcgacaacaccuguauggaauccgugaagaauggcacauacgauuauccuaaauacagcgaggaagccaagcugaacagagaggagaucgacggggucaaacuugaaucuacuaggauuuaucaaauccuggcuauuuacucaaccguggcgaguagcuugguccucgugguuucccugggagcaauaucuuuuuggaugugcucgaaugguagcuuacagugccggaucuguauuuga

SEQ ID NO: 129688 - RNA, 1701 nt, Artificial Sequence; identical to SEQ ID NO: 124685
  derived and/or modified sequence opt3 from hemagglutinin__InfluenzaA__AEO01599

SEQ ID NO: 129689 - RNA, 1701 nt, Artificial Sequence; identical to SEQ ID NO: 124685
  derived and/or modified sequence opt3 from hemagglutinin__InfluenzaA__AEO01600

SEQ ID NO: 129690 - RNA, 1701 nt, Artificial Sequence; identical to SEQ ID NO: 124685
  derived and/or modified sequence opt3 from hemagglutinin__InfluenzaA__AEO01601

SEQ ID NO: 129691 - RNA, 1701 nt, Artificial Sequence; identical to SEQ ID NO: 124685
  derived and/or modified sequence opt3 from hemagglutinin__InfluenzaA__AEO01602

SEQ ID NO: 129692 - RNA, 1701 nt, Artificial Sequence; identical to SEQ ID NO: 124685
  derived and/or modified sequence opt3 from hemagglutinin__InfluenzaA__AEO01603

SEQ ID NO: 129693 - RNA, 1701 nt, Artificial Sequence; identical to SEQ ID NO: 124685
  derived and/or modified sequence opt3 from hemagglutinin__InfluenzaA__AEO01604

SEQ ID NO: 129694 - RNA, 1701 nt, Artificial Sequence; identical to SEQ ID NO: 124685
  derived and/or modified sequence opt3 from hemagglutinin__InfluenzaA__AEO01605

SEQ ID NO: 129695 - RNA, 1701 nt, Artificial Sequence
  derived and/or modified sequence opt3 from hemagglutinin__InfluenzaA__AEO01606
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguaaaaucacagcucaagaacaaugcaaaggaaaucggcaacggauguuuugaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 129696 - RNA, 1701 nt, Artificial Sequence; identical to SEQ ID NO: 124927
  derived and/or modified sequence opt3 from hemagglutinin__InfluenzaA__AEO01607

SEQ ID NO: 129697 - RNA, 1701 nt, Artificial Sequence; identical to SEQ ID NO: 127590
  derived and/or modified sequence opt3 from hemagglutinin__InfluenzaA__AEO01608

SEQ ID NO: 129698 - RNA, 1701 nt, Artificial Sequence; identical to SEQ ID NO: 129450
  derived and/or modified sequence opt3 from hemagglutinin__InfluenzaA__AEO01609

SEQ ID NO: 129699 - RNA, 1701 nt, Artificial Sequence
  derived and/or modified sequence opt3 from hemagglutinin__InfluenzaA__AEO01610
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagcacgcuauugacgagaucaccaacaagguaaauucuguuauagagaaaaugaacacacaguuuacugccguggguaaggaguucaaucaucuggaaaagcggauugaaaacuuaaauaaaaaggucgaugacggguuccuggauaucuggaccuacaacgcugagcuccuugugcuguuggaaaaugagcgcacacuagacuaucacgauagcaacgugaaaaaucuguacgagaagguucgaucacagcucaaaaacaacgccaaggaaaucggcaauggauguuuugaguucuaucauaagugcgacaacacuuguauggaaagugugaaaaauggcaccuacgauuauccuaaguacuccgaggaagcaaaacugaacagagaggagauugacggggucaaacuugaaagcacaaggaucuaucaaauucuggccauauacucuaccguggcuucaaguuugguccucgugguuagccugggagcgaucuccuuuuggaugugcucuaaugguucguuacagugccggguguguauuuga

SEQ ID NO: 129700 - RNA, 1701 nt, Artificial Sequence
  derived and/or modified sequence opt3 from hemagglutinin__InfluenzaA__AEO01611
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggccgcgaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucggugagugcccaaaauauguaaaguccaccaagcugagacuugccacugggcugaggaacgugcccucaauucagagucggggauuguuuggcgcgauagccggcuucaucgaagggggauggacagguauggucgacggcugguacggguaucaucaccagaaugagcaaggaagcggcuacgcagcugaucucaaauccacccagaacgccauugacaagaucacgaauaaagugaacucuguuauagagaagaugaauacccaguuuacagcuguggguaaagaguucaaccaccuggagaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacagcggcaucaaguuuggugcucgucgugagccugggagccaucuccuuuuggaugugcucuaacgguucguuacagugccguauuuguaucuga

SEQ ID NO: 129701 - RNA, 1701 nt, Artificial Sequence
  derived and/or modified sequence opt3 from hemagglutinin__InfluenzaA__AEO01612
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugccaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacgagaucacgaauaaggucaacucugugauagagaaaaugaauacccaguuuacagccguugguaaggaguucaaccaccuggaaaagcggauugaaaauuuaaacaaaaagguggaugacggguuccuggauaucuggacuuacaaugcagagcuccuuguccuguuggaaaacgagcgcacccuagacuaucaugauagcaaugugaaaaaccuguacgagaagguacgaucacagcucaaaaacaaugccaaggaaaucggcaacggauguuuugaguucuaucacaagugcgacaauacauguauggaaaguguuaaaaacggcacuuacgauuauccuaaguacuccgaggaagcuaaacugaauagagaggagauugacggggugaaacuugaaagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 129702 - RNA, 1701 nt, Artificial Sequence; identical to SEQ ID NO: 127282
  derived and/or modified sequence opt3 from hemagglutinin__InfluenzaA__AEO01613

SEQ ID NO: 129703 - RNA, 1701 nt, Artificial Sequence
  derived and/or modified sequence opt3 from hemagglutinin__InfluenzaA__AEO01614
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagagagcagcugagcaguguguccucuuucgaaagguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacauucccucaauacagaguagaggauuguuuggcgcgaucgccggcuucauugaagggggauggacagguaugguggacggcugguacggguaucaucaccagaaugaacaaggaagcggcuacgcagcugaucucaaguccacccagaacgccaucgacgagauaacgaauaaagucaacucugugauugagaagaugaauacccaguuuacagcuguugguaaggaauuuaaccaccuggagaaaaggaucgaaaauuuaaacaagaaaguggaugacggguuccuggauaucuggacuuacaaugccgagcuccuuguccuguuggaaaacgagcggacccuagacuaucaugauagcaaugugaagaaccuguacgagaaaguacgcucacagcucaagaacaaugcaaaggaaauuggcaacggauguuucgaguucuaucacaaaugcgacaauacauguauggaaaguguuaagaacggcacuuacgauuauccuaaauacuccgaggaagccaagcugaaucgagaggagaucgacggggugaaacuugaaagcaccagaauuuaucaaauacuggcuaucuacucuacagucgcgucaaguuuggugcucgucgugagccugggagcaauuuccuuuuggaugugcucuaacgguucguuacagugcaggaucuguaucuga

SEQ ID NO: 129704 - RNA, 1701 nt, Artificial Sequence
  derived and/or modified sequence opt3 from hemagglutinin__InfluenzaA__AEO01615
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguauuacauaaaugacaagggcaaagaaguacugguucuuuggggcauccaccaccccuccacgucagcugaucaacagagcuuguaccagaacgccgacgcguauguguucgucgggaccagucgcuacucuaagaaauuuaagccugagauugcaauccgaccaaaagugcgugagcaggaaggaagaaugaauuauuacuggacucugguggagcccggugauaagauuacauucgaagccacuggcaaccuagucguuccuagguaugcuuuugccauggagcggaacgcaggguccggaaucauaauuagcgacaccccagugcaugauugcaauacaaccugucaaacgccgaaaggcgcuaucaacacuucgcuccccuuccagaauauucacccuaucacaaucgguaagugcccaaaguacguaaaaucuaccaagcugcgccuugccacugggcugagaaacgugcccuccauucagucaaggggauuguuuggcgcgauagccggcuucaucgaagggggauggacagguauggucgacggcugguauggguaccaucaccagaaugagcaaggaaguggcuacgcagcugaccucaaaagcacccagaacgccauugauaagaucacgaauaaagugaacuccguuauagagaagaugaauacccaguuuacagcuguggguaaggaguucaaccaccuggagaaacggauugaaaauuuaaacaagaaagucgacgauggguuccuggacaucuggacuuauaaugccgagcuccuugugcuguuggaaaacgagcgcacccuagauuaccaugacucuaauguaaagaaccuguaugagaaaguucgaagccagcucaagaacaaugcaaaggaaaucggcaacggauguuuugaguucuaccacaaaugcgauaauacauguauggaaucagugaagaacggcacuuaugacuacccuaaauauagugaggaagccaagcugaauagagaggagauugauggggucaaacuugaauccaccaggaucuaccaaauucuggcuauauacagcacaguggcgucuucauugguccucgugguuagucugggagcaaucagcuuuuggaugugcuccaacgguucuuuacagugccggauuuguaucuga

SEQ ID NO: 129705 - RNA, 1701 nt, Artificial Sequence; identical to SEQ ID NO: 125038
  derived and/or modified sequence opt3 from hemagglutinin__InfluenzaA__AEO01616

SEQ ID NO: 129706 - RNA, 1701 nt, Artificial Sequence; identical to SEQ ID NO: 125849
  derived and/or modified sequence opt3 from hemagglutinin__InfluenzaA__AEO01617

SEQ ID NO: 129707 - RNA, 1701 nt, Artificial Sequence; identical to SEQ ID NO: 126282
  derived and/or modified sequence opt3 from hemagglutinin__InfluenzaA__AEO01619

SEQ ID NO: 129708 - RNA, 1701 nt, Artificial Sequence; identical to SEQ ID NO: 129394
  derived and/or modified sequence opt3 from hemagglutinin__InfluenzaA__AEO01620

SEQ ID NO: 129709 - RNA, 1701 nt, Artificial Sequence; identical to SEQ ID NO: 129541
  derived and/or modified sequence opt3 from hemagglutinin__InfluenzaA__AEO01621

SEQ ID NO: 129710 - RNA, 1701 nt, Artificial Sequence
  derived and/or modified sequence opt3 from hemagglutinin__InfluenzaA__AEO01625
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacuccccacaccaggugcuagauggcgaaaauuguacccucaucgacgcucugcuuggggauccgcagugcgacggauuccaaaacaaaaagugggaucuguuugucgagagaucuaaagccuauucgaauuguuaccccuaugacgugccugauuacgcaucauugaggagccucguugccaguuccggcacucuggaguucaacaaugaaucuuuuaacuggacaggugugacccagaaugggacgagcuccgcuugcauacggcgcucaaacaauaguuucuuuagccgacugaacuggcucacucauucuaaguucaaguauccagcauuaaaugucaccaugcccaacaacgaggaauuugacaaacuguacaucuggggagugcaccauccuggcacagauaaugaccagauuuuccuuuaugcccaggcuuccggccguaucacuguaucaaccaagagaagccaacagacaguuauuccaaacaucgggaguaggccccgggugcgcaauauaccuucuagaauuuccaucuacuggaccauugucaaaccaggagauaucuugcugaucaacagcacggguaaucuaauugccccgaggggcuacuuuaagauacggucggggaaaucuuccaucaugcgcucagacgcgcccauuggaaaguguaacagugagugcaucacuccuaauggcagcauaccaaacgacaagcccuuccagaaugugaaccgaauuacauauggugcauguccuagauacgugaaacagaauacccucaagcuggccacugggaugaggaacgucccagaaaaacaaacacggggaaucuuuggcgcuaucgccggcuucauugagaaugggugggagggaaugguugaugguugguauggcuuucgucaccagaacuccgaagggaucggacaggcagcugaccuuaagucuacccaagccgcgauugaucagauaaauggcaaacugaaccgcuugaucgguaagacgaacgagaaauuccaccagauugaaaaggaguucagcgaaguggaggggagaauccaggaccucgagaaguacguagaagauaccaaaaucgaccuguggucauauaaugccgaguuacugguggcacucgaaaaccaacauacaauugaucuuacugacagugagaugaauaagcuguuugaaaagaccaagaaacaguugagggagaacgcugaggauaugggcaauggaugcuucaagauauaccacaagugugacaacgccugcaucggcuccauucggaaugggacauaugaucaugaagucuaccgagacgaggcucuaaacaaucgcuuucagaucaaaggaguggaacugaaaagcgguuacaaagacuggauucucuggaucucuuucgccauaucaugcuuucugcuuuguguugcacuguugggcuucaucaugugggccugccagaaggggaacauuagauguaauaucugcauuuga

SEQ ID NO: 129711 - RNA, 1701 nt, Artificial Sequence
  derived and/or modified sequence opt3 from hemagglutinin__InfluenzaA__AEO01636
augaaaagcaucauugcccuguccuacauacucugccuugugucugcucagaaacugcccggcaacgacaauucaaccgcaacauuguguuuagggcaccaugccgucccuaacggaacuaucguuaagacgauuaccaaugaucaaaucgaggugacaaacgcgacugaacugguacagaguagcuccaccggugagauuugcgacucuccacaccaggugcuagauggcgaaaauuguacacucaucgacgcucugcuuggggauccgcagugcgacggauuccaaaacaaaaagugggaucuguuugucgagagaucgaaagccuauucaaauuguuaccccuaugacgugccugauuacgccagcuugaggagucucguugcauccucuggcacccuggaauuuaacaaugagagcuucaacuggacuggugugacacagaaugggaccuccucagcuugcauacggcgcaguaacaauagcuucuuuucucgacugaacuggcucacgcauuccaaguucaaguauccagcauuaaaugucacuaugcccaacaacgaggaauuugacaaacuguacaucuggggagugcaccauccuggcaccgauaaugaccagauuuuccuuuaugcccaggcuucaggccguaucacaguaagcacuaagagaagucaacagaccguuauuccaaacaucgggucuaggccccgggugcgcaauauaccuuccagaauuagcaucuacuggacaauugucaaaccaggagauaucuugcugaucaacucgaccgguaaucuaauugccccgaggggcuacuuuaagauacggucugggaaauccucaaucaugcgcagugacgcgcccauuggaaaguguaacagcgagugcaucacgccuaauggcuccauaccaaacgacaagcccuuccagaaugugaaccgaauuacuuauggugcauguccuagauacgugaaacagaauacacucaagcuggccaccgggaugaggaacgucccagaaaaacaaacucggggaaucuuuggcgcuaucgccggcuucauugagaaugggugggagggaaugguugaugguugguauggcuuucgucaccagaacucugaagggaucggacaggcagcugaccuuaagagcacacaagccgcgauugaucagauaaauggcaaacugaaccgcuugaucgguaagaccaacgagaaauuccaccagauugaaaaggaguucucagaaguggaggggagaauccaggaccucgagaaguacguagaagauacgaaaaucgaccuguggaguuauaaugccgaguuacugguggcacucgaaaaccaacauaccauugaucuuacagacuccgagaugaauaagcuguuugaaaagacuaagaaacaguugagggagaacgcugaggauaugggcaauggaugcuucaagauauaccacaagugugacaacgccugcaucggcagcauucggaaugggaccuaugaucaugacgucuaccgagacgaagcucuaaacaaucgcuuucagaucaaaggaguggagcugaagucugguuacaaagauuggauucucuggaucucauucgccauaaguugcuuucugcuuuguguugcacuguugggcuucaucaugugggccugccagaaggggaacauuagauguaauaucugcauuuga

SEQ ID NO: 129712 - RNA, 1701 nt, Artificial Sequence
  derived and/or modified sequence opt3 from hemagglutinin__InfluenzaA__AEO01642
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcaauuccccacaccagauccuagacggcgaaaacuguacccucauagaugcucugcuuggggacccgcagugcgauggauuccaaaauaaaaagugggaccuguuuguggagagaucuaaagccuauucgaacuguuaccccuaugaugucccugacuacgcaucauugaggagccucguggccaguuccggcacucuggaguucaauaacgaaucuuuuaauuggacagguguuacccagaacgggacgagcuccgcuugcauccggcgcucaaauaacaguuucuuuagccgacugaauuggcucacucauuuaaaguucaaguauccagcacugaacgugaccaugcccaacaaugaggaauuugauaaacuuuacauuuggggaguccaccauccuggcacagacaacgaucagaucuucuuguaugcccaggcuucuggccguauuacuguguccaccaagagaucacaacagacaguaaucccaaauauagggagcaggccccggguucgcaacauuccuaguagaaucucuauuuacuggaccaucgugaaaccaggagacauccugcuaauuaauuccacggguaaccucauagccccgaggggcuacuuuaagauccggagcgggaaaucgucuauuaugcgcuccgaugcgcccaucggaaaguguaauucaaagugcauaacuccuaacggcaguauuccaaaugacaaacccuuccagaacgucaaucgagugacauauggugcauguccuagauacgugaagcagaacacccugaaacuugccacugggaugaggaaugucccagagaagcaaacacggggaaucuuuggcgcuaucgccggcuucauugaaaacgggugggagggaaugguugacgguugguauggcuuucgucaccagaauagcgaggggaucggacaggcagcugaucugaaauccacccaagccgcgauugaccagauaaacggcaaguugaaccgccucaucgguaaaacgaaugaaaaguuccaccagauugagaaggaguucucugaaguggaagggagaauccaggaucuggagaaauacguagaggacaccaagaucgauuuauggagcuauaacgccgaacugcucguggcacuugagaaucaacauacaauugaccugacugauucagaaaugaacaaauuguuugagaagaccaaaaagcagcuaagggaaaaugcugaggacaugggcaacggaugcuucaagauauaccacaaaugugauaaugccugcaucggcaguauucggaacgggacauaugaccaugaugucuaccgagacgaggcucugaauaaccgcuuucagaucaagggaguggaacucaaauccgguuacaaggacuggauucuguggaucagcuucgccauaucuugcuuucuucuguguguugcauugcucggcuucaucaugugggccugccagaaagggaauauuagauguaacaucugcauuuga

SEQ ID NO: 129713 - RNA, 1698 nt, Artificial Sequence
  derived and/or modified sequence opt3 from hemagglutinin__InfluenzaA__AEO01663
augaaggugaaacugcucguccuucugugcaccuucgccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuaucggaacuuacuguggcuuacaggcaaaaauggauuguaccccaaccugagcaagucuuaugccaauaacaaagagaaggaaguucuaguacucuggggcgugcaccacccuccaaacaucggggaccagaaagcucuguaccauaccgagaaugcauacgucuccguggugucaagccacuauagucgcaaguucacgcccgaaauagccaagcgaccuaaaguccgugaucaggagggaagaaucaacuacuauuggacucuucuggagccaggugacaccauuaucuuugaagcuaauggcaacuugagggccccgcgguacgcguucgcacucucucgcggguuuggauccggcauuaucaauagcaacgcccccauggauaagugugacgcuaaaugccagacaccucaaggugccauaaauucgucucugccauuccagaacguucaucccgugccuauuggggaguguccaaaguauguaagauccgcaaaauuaaggauggugacuggacugcggaauauccccucaauucagagucgcggccucuuuggcgcuaucgccggguucaucgaaggagguuggaccggcauggucgaugggugguacggauaucaccaccagaacgagcaaggcagcgguuacgcggccgaccagaaguccacacagaaugcaauuaacgggauaaccaauaaagugaacucuguuaucgaaaagaugaauacgcaguuuacugcugugggcaaggaguucaacaaacuugagcgaagaauggaaaaccugaauaagaaagucgaugacggauucauugauaucuggacauacaacgccgaguugcuagugcugcucgaaaaugagaggacccuggacuuucaugacagcaacguaaagaaucuuuaugaaaaaguuaagucacaacugaagaacaaugcuaaagagauaggcaacgggugcuucgaguuuuaccacaaguguaaugaugaaugcauggagagugugaaaaacggaacuuaugacuacccgaaguauuccgaagagagcaaauugaaucgggagaagauugaugguguccgucucgaaucuaugggcguguaccagauccuggccaucuauucaacagucgcaaguagcuuagugcugcuaguuucccucggggccauuucuuucuggaugugcucgaacggaagccugcagugucgcaucugcauuuga

SEQ ID NO: 129714 - RNA, 1698 nt, Artificial Sequence
  derived and/or modified sequence opt3 from hemagglutinin__InfluenzaA__AEO01674
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaaugagaacuugaaggcuccgagguacgccuucgcgcucucucggggcuuuggguccggaauuaucaauagcaaagcacccauggauaagugugacgccaaaugccagacuccucaaggcgcuauaaacucgucucugccauuccagaauguucaucccgugaccauuggugaauguccuaaguauguacgcuccgccaaauuaagaauggugacagggcugaggaacaucccaucaauucagagucggggacucuuuggcgcaaucgcuggcuucaucgaagggggauggaccgguauggucgauggcugguacggguaucaccaccagaaugaacaaggaagcggcuacgccgcggaccagaaguccacgcagaacgccauuaaugguauaacuaacaagguaaauucuguuaucgagaaaaugaacacacaguuuaccgcaguggggaaggaguucaauaaacuugaacgccgaauggagaaccugaacaagaaagucgaugacggcuucauugauaucuggacuuacaaugcugaauugcuagugcugcucgagaacgaaagaacacuggacuuucaugacagcaauguaaagaaccuuuaugagaagguuaaaucacaacugaagaauaacgccaaagagauaggaaauggcugcuucgaauuuuaccacaaguguaacgaugagugcauggaaagugugaaaaaugggaccuaugacuaccccaaguauuccgaggagagcaaguugaacagggagaaaauugauggaguccggcucgagucuauggguguguaccagauccuggcuaucuauucaacggucgccaguagcuuagugcugcuaguuucccucggcgcaauuucuuucuggaugugcucgaaugggagccugcagugucguaucugcauuuga

SEQ ID NO: 129715 - RNA, 1701 nt, Artificial Sequence; identical to SEQ ID NO: 129710
  derived and/or modified sequence opt3 from hemagglutinin__InfluenzaA__AEO01691

SEQ ID NO: 129716 - RNA, 1698 nt, Artificial Sequence
  derived and/or modified sequence opt3 from hemagglutinin__InfluenzaA__AEO01699
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaagggacacaauuaucuuugaagccaaugguaacuugauugcuccgcgguacgccuucgcgcucucucgcggcuuuggguccggaaucauaaauagcaacgcacccauggauaagugugacgccaaaugccagacuccucaaggcgcuauuaauucgucucugccauuccagaacguucaucccgugaccaucggugaguguccuaaguauguaagauccgccaaauuaaggauggugacagggcugcggaauauuccaucaauccccagucgcggacucuuuggcgcaaucgcuggcuucauugaagggggauggaccgguauggucgauggcugguacggguaucaccaccagaacgagcagggaagcggcuacgccgcggaccaaaaguccacgcagaaugccauaaacgguaucacuaauaaagugaacucuguuauugaaaagaugaauacacaguuuaccgcaguggggaaggaguucaacaaacuugagcgaagaauggaaaaccugaauaagaaagucgaugacggcuucaucgauauauggacuuacaacgcugaguugcuagugcugcucgaaaaugagaggacacuggacuuucaugacagcaacguaaagaaucuuuaugaaaaaguuaagucacagcugaagaacaaugccaaagagauuggaaacggcugcuucgaguuuuaccacaaguguaaugaugaaugcauggagagugugaaaaacgggaccuaugacuacccgaaguauuccgaagagagcaaauugaaucgggagaagaucgauggagucaagcucgaaucuaugggugcuuaccaaauccuggccauuuauucaacgggcgcaaguagcuuagugcugcuagucucccucggggccaucucuuucuggaugugcucgaacggaagccugcagcgucgcauuuguauauga

SEQ ID NO: 129717 - RNA, 1698 nt, Artificial Sequence
  derived and/or modified sequence opt3 from hemagglutinin__InfluenzaA__AEO01709
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaacuucgugaucaggacggaagaaucaacuacuauuggacccuguuggagccaggugauacaacuauuuuugaggccaauggcaaccucaucgcuccgagguacgccuucgcgcugucucggggguuuggauccggcauuaucaauagcaacgcacccauggacaagugugaugccaaaugccagaccccucaaggugcuauaaauucgucuuuaccauuccagaacguccaucccguuacaauuggggaauguccuaaguaugugcgcuccgccaaacugagaaugguaaccggacucaggaauaucccaucaauucagagucggggccuuuuuggcgcaaucgcuggguucaucgagggagguuggacgggcaugguggacgggugguacggauaucaccaccagaacgaacaaggcagcgguuacgccgcggaucagaaguccacucagaaugccauuaacgggauaacaaauaaagucaacucugugaucgagaagaugaauacccaguuuacugcaguuggcaaggaguucaacaaacuggaacgccgaauggagaacuugaauaagaaaguggacgauggauucauugacaucuggacauacaacgcugaacuacugguccuccuggagaaugaaagaacccuugacuuucaugauagcaacgugaagaaucuguaugagaaaguaaagucacaauugaagaacaaugccaaagaaauaggcaacgggugcuucgagcucuaccugaaguguaauggagagugcauggaaaguguuaaaaacgguacguaugacuaccccaaguauuccgaggaaagcaaauuaaauagggagaagauugauggcgugaagcuggagucuaugggggucuaccagauccuagcuaucuauucaaccguggccaguagccucguccugcuuguguccuugggagcaauuucuuuuuggaugugcucgaacggcagccugcagugucggaucugcauuuga

SEQ ID NO: 129718 - RNA, 1701 nt, Artificial Sequence; identical to SEQ ID NO: 125849
  derived and/or modified sequence opt3 from hemagglutinin__InfluenzaA__AEO37530

SEQ ID NO: 129719 - RNA, 1701 nt, Artificial Sequence
  derived and/or modified sequence opt3 from hemagglutinin__InfluenzaA__AEO72176
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaucggcaauggauguuuugaguucuaucacaaaugcgacaacaccuguauggaaagcgugaagaauggcacauacgauuauccuaaauacucagaagaggcaaagcugaacagagaagagauugacggggucaaacuugagaguaccaggaucuaucaaauucuggccauauacuccacuguggcuagcucuuugguccucgcggugucacugggagcaaucaguuuuuggaugugcagcaaugguuccuuacagugccggauuuguaucuga

SEQ ID NO: 129720 - RNA, 1704 nt, Artificial Sequence
  derived and/or modified sequence opt3 from hemagglutinin__InfluenzaA__AEO88980
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcagcuacaacaauacaaaccaagaggaccucuuaauucugugggguauccaccacuccaacgaugccgcugagcagaccaaacuuuaucagaauccaacuacauacauuucaguugggaccaguacguugaaccagcgacuggugcccaagaucgcaacucguagcaaagucaauggacaaucuggcagaauggacuuuuucuggaccauccuaaagccuaacgaugccauuaauuuugaauccaacggcaauuucauagcuccagaguacgccuauaaaaucgugaagaaaggggacucagcgauuaugaagucugaaguggaguacggaaacugcaauacaaaaugucagacuccgaucggugcaauaaacaguucuaugcccuuucauaauauucacccucucaccaucggcgaaugcccaaaguaugucaaguccaacaaacugguucuugccacagggcugaggaauagccccuugcgggagcgcagaaggaagcggggacucuucggcgcuaucgccgguuuuauugaagggggauggcagggcaugguggacggcugguacggguaucaucacucgaacgaacagggaucugguuacgcagcugauaaagaguccacccaaaaggccaucgacggcguaacgaauaaagugaacucaauuauagauaagaugaacacucaguucgaagcggucgggcgcgaguuuaauaaccuggaacgaagaaucgagaauuuaaacaagaaaauggaggacggauuccuggauguguggacauauaaugccgaacuccuuguucugauggagaacgaaaggaccuuggacuuccacgauaguaaugugaagaaccuauacgacaaaguccggcugcagcuccgugauaaugcaaaggagcugggcaacgguuguuuugaguucuaccauaaaugcgacaaugaguguauggagagcgugcgcaacgggacuuaugauuacccucaauauuccgaagaggcuagacuuaagagggaagagauuucuggcguaaagcuggagagcaucggaacauaccagaucuugucaauuuauaguaccguugccuccagccucgcucuggccauaaugguggcaggcuuaucucuguggaugugcucaaaugggagucuacagugccggaucuguauuuga

SEQ ID NO: 129721 - RNA, 1704 nt, Artificial Sequence
  derived and/or modified sequence opt3 from hemagglutinin__InfluenzaA__AEO89021
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauuccuaucauuccaaaguccucuuggucggaucaugaagccucaagcggagucaguuccgcaugucccuaccagggcacaccuagcuuuuuccggaaugugguauggcugaucaaaaagaacaauacuuauccaaccauaaaacgcagcuacaacaauacaaaccaggaggaccucuuaauucugugggguauccaccacuccaacaaugccgcugagcaaaccaagcuauaucagaaccccacuacauacauuucaguugggaccaguacguugaaucugcgacuugugccuaagaucgcaacucguagcaaagucaacggacagucuggcagaauggauuucuucuggaccauccucaagccaaaugacgccauuaacuuugaauccaauggcaacuucauagcuccggaguacgccuauaaaaucgugaagaaaggggauucagcgauuaugaagucugaaguggaguacggaaauugcaacacaaaaugucagacucccaucggugcaauaaauaguucuaugccuuuucauaacauucacccacugaccaucggcgaaugccccaaguaugucaaguccaauaaacuuguucuggccacaggguugaggaacagcccucuccgggagcgcagaaggaagcggggacuguucggcgcuaucgccgguuuuauugaagggggauggcaaggcaugguggacggcugguacggguaucaucacucgaaugaacagggaucugguuacgcagcugacaaagaguccacccagaaggccaucgauggcguaacgaacaaagugaacucaauuauagacaagaugaauacucaguucgaagcggucgggcgcgaguuuaacaauuuagaacgaagaaucgagaaccugaauaagaaaauggaggauggauuccucgacguguggacauauaacgccgaacuucugguuuugauggagaaugaaaggacccuagauuuccacgacaguaacgugaagaaucuguacgauaaaguccggcuccaacugcgugacaacgcaaaggagcuuggcaaugguuguuuugaauuuuaccauaaaugcgauaacgaguguauggagagcgugcgcaaugggacuuaugacuacccacaguauuccgaagaggcuagacugaagagggaagagauuucuggcguaaaguuggagagcaucggaacauaccagauccucucaauuuauaguaccguugccuccagccuggcuuuagccauaaugguggcaggccugucucuauggaugugcucaaacgggagucuccaaugccggaucuguauuuga

SEQ ID NO: 129722 - RNA, 1704 nt, Artificial Sequence
  derived and/or modified sequence opt3 from hemagglutinin__InfluenzaA__AEO89030
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccguguguccauaccagggcacacccagcuuuuuccggaauguaguuuggcugaucaaaaagaacaauacuuauccuaccauaaaacgcagcuacaacaauacaaaccaagaggaccucuuaauucugugggguauccaccacuccaacgaugcagccgagcagaccaaacuuuaucagaauccaacuacauacauuucaguggggaccaguacguugaaccagcgacugguccccaagaucgcuacucguagcaaagugaauggacaaucuggcagaauggacuuuuucuggaccgugcuaaagccuaacgaugcaaucaauuuugaauccaacggcaauuucauugccccagaguacgcuuauaaaauagucaagaaaggggacucagccaucaugaagucugaaguugaguacggaaacugcaauacaaaaugucagacuccgauuggugcgaucaacaguucuaugcccuuucauaauauacacccucucaccauuggcgaaugcccaaaguaugugaaguccaacaaacugguacuugcaacagggcugaggaauagccccuugcgggagcgcagaaggaagcggggacucuucggcgccaucgcugguuuuaucgaagggggauggcagggcaugguggacggcugguacggguaucaucacucgaacgaacagggaucugguuacgccgcagauaaagaguccacccaaaaggcuauugacggcgucacgaauaaagugaacucaaucauugauaagaugaacacucaguucgaagccguugggcgcgaguuuaauaaccuggaacgaagaauagagaauuuaaacaagaaaauggaggacggauuccuggauguguggacauauaaugcggaacuccuuguccugauggagaacgaaaggaccuuggacuuccacgauaguaaugugaagaaccuauacgacaaaguacggcugcagcuccgugauaaugccaaggagcugggcaacgguuguuuugaguucuaccauaaaugcgacaaugaguguauggagagcguucgcaacgggacuuaugauuacccucaauauuccgaagaggcaagacuuaagagggaagagaucucuggcgugaagcuggagagcauuggaacauaccagaucuugucaaucuauaguaccgucgcuuccagccucgcccuggcuauuaugguggccggcuuaucucuguggaugugcucaaaugggagucuacagugccggauauguaucuga

SEQ ID NO: 129723 - RNA, 1704 nt, Artificial Sequence
  derived and/or modified sequence opt3 from hemagglutinin__InfluenzaA__AEO89048
auggagaagaucguguuccugcucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggcuaaugaucuuugcuaccccgggaacuucaaugacuaugaggaacugaagcauuugcucagcaggaucaaccacuuugagaaaauucagaucauuccuaaguccucuuggucggaucaugaagccucaagcggagucaguuccgcauguccauaccagggcacacccucuuucuuucggaaugugaucuggcugauuaaaaagaacaauacuuauccuaccauaaaacgcagcuacaacaauacaaaccaagaggaccugcucaucuuaugggguauucaccacuccaacgaugccgcugagcagaccaagcuguaucagaauccaacuacauacaucucaguagggaccaguacgcuuaaccagcgauugguucccaagaucgcaacucguagcaaagugaauggacaaucuggcagaauggacuucuuuuggaccauucugaagccuaacgaugccauaaauuucgaauccaacggcaauuuuaucgcuccagaguacgccuauaaaauugucaagaaaggggacucagcgauccuaaagagcgaaguggaguacggaaacugcaauacaaaaugucagacuccgauaggugcaauuaacaguucuaugcccuuccauaauauccacccucucaccaucggcgaaugcccaaaguaugugaaguccaacaaacugguccuugccacagggcugaggaauagccccuugcgggagcgcagaaggaagcggggacucuuuggcgcuauugccgguuucaucgaagggggauggcagggcaugguugacggcugguacggguaucaucacucgaacgaacagggaucugguuacgcagcugauaaagaguccacccaaaaggccauugacggcgugacgaauaaaguaaacucaauaaucgauaagaugaacacucaguuugaagcgguggggcgcgaguucaauaaccuggaacgaagaauugagaauuuaaacaagaaaauggaggacggauuccuggaugucuggacauauaaugccgaacuccuugugcugauggagaacgaaaggaccuuggacuuucacgauaguaauguuaagaaccuauacgacaaagugcggcugcagcuccgugauaaugcaaaggagcugggcaacgguuguuucgaauuuuaccauaaaugcgacaaugaguguauggagagcguccgcaacgggacuuaugauuacccucaauauuccgaagaggcuagacuuaagagggaagagaucucuggcgugaagcuggagagcaucggaacauaccagauuuugucaauauauaguaccguagccuccagccucgcucuggccaucaugguugcaggcuuaucucuguggaugugcucaaaugggagucuacagugccggauuuguaucuga

SEQ ID NO: 129724 - RNA, 1704 nt, Artificial Sequence
  derived and/or modified sequence opt3 from hemagglutinin__InfluenzaA__AEO89065
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccguguguccauaccagggcacacccucuuucuuccggaauguaguuuggcugaucaaaaagaacaauacuuauccuaccauaaaacgcagcuacaacaauacaaaccaagaggaccucuuaauucugugggguauccaccacuccaacgaugcagccgagcagaccaagcuauaucagaauccaacuacauacauuucaguggggaccaguacguugaaccugcgacuuguccccaagaucgcuacucguagcaaagugaauggacagucuggcagaauggacuuuuucuggaccauccucaagccuuccgaugcaauuaacuuugaaucaaauggcaacuucauagccccagaguacgcuuauaaaaucgugaagaaaggggacagcgccauuaugaagagugaagucgaguacggaaauugcaacacaaaaugucaaacuccgaucggugcgauaaauucuuccaugcccuuucauaacauucacccucugaccaucggcgaaugcccaaaguauguuaagagcaauaaacuugugcuggcaacaggguugaggaacucgccccuccgggagcgcagaaggaagcggggacuguucggcgccaucgcugguuuuauugaagggggauggcagggcaugguagacggcugguacggguaucaucacucuaaugaacagggauccgguuacgccgcagauaaagagucaacccagaaggcuaucgacggcgugacgaacaaagucaauaguauuauagauaagaugaacacucaauucgaagccguggggcgcgaguuuaacaauuuagaacgaagaaucgagaaccugaauaagaaaauggaggacggauuccucgauguuuggacauauaacgcggaacuucugguguugauggagaaugaaaggacccuagacuuccacgauagcaacgucaagaaucuguacgacaaagugcggcuccagcugcgugauaacgccaaggagcuuggcaaugguuguuuugaauuuuaccauaaaugcgacaacgaguguauggaguccguacgcaaugggacuuaugauuacccucaguauucugaagaggcaagacugaagagggaagagauuagcggcguuaaguuggagucaaucggaacauaccaaauccucaguauuuauuccaccguggcuagcucucuggccuuagcuauaauggucgccggccugucacuauggaugugcaguaacgggagccuccagugccggaucuguauuuga

SEQ ID NO: 129725 - RNA, 1704 nt, Artificial Sequence
  derived and/or modified sequence opt3 from hemagglutinin__InfluenzaA__AEO89082
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggagaaaacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugacacaucaagcggagucaguuccgccuguccauaccagggcacucccagcuuuuuccggaaugugguauggcugaucaaaaagaacaauaccuauccuacaauaaaacgcucuuacaacaauaccaacaaggaagaucucuuaauucugugggguauccaccacuccaacgacgcagccgagcaaacuaaacuuuaucagaauccaacaaccuacauuucaguugggacgaguacuuugaaccagcgacuggugcccaagaucgcuacccguagcaaggucaauggacagucuggcagaauggacuuuuucuggacaauccuaaaaccuaacgaugcaauuaauuuugaguccaacggcaauuucauagccccagaauacgcuuauaagaucgugaaaaagggggacucagccauuaugaaaagcgagguggaauacggaaacugcaauacuaagugucaaaccccgaucggugcgauaaacaguucuaugcccuuucauaauauucacccucucacaaucggcgagugcccaaaguaugucaaauccaacaagcugguucuugcaaccgggcugaggaauagccccuugcgggaacgcagaaggaaacggggacucuucggcgccaucgcugguuuuauugaagggggauggcagggcaugguggauggcugguacggguaucaucacucgaacgagcagggaucugguuacgccgcagacaaggaauccacgcagaaagcuaucgauggcguaacuaauaaggugaacucaauuauagacaagaugaacacacaauucgaggccgucgggcgcgaauuuaauaaccuggagcgaagaaucgaaaauuuaaacaaaaagauggaggauggauuccuggacguguggaccuauaaugcggagcuccuuguucugauggaaaacgagaggacuuuggauuuccacgacaguaaugugaaaaaccuauacgauaagguccggcugcagcuccgugacaaugccaaagaacugggcaacgguuguuuugaguucuaccauaagugcgauaaugaauguauggagagcgugcgcaacgggacauaugacuacccucaguauuccgaggaagcaagacuuaagagggaggaaauuucuggcguaaaacuggagagcaucggaaccuaccaaaucuugucaauuuauaguacgguugcuuccagccucgcccuggcuauaaugguggccggcuuaucucuguggaugugcucaaaugggagucuacagugccggaucuguauuuga

SEQ ID NO: 129726 - RNA, 1704 nt, Artificial Sequence
  derived and/or modified sequence opt3 from hemagglutinin__InfluenzaA__AEO89091
auggagaagaccguguuccugcucgccaucgucagccuuguuaaauccgaccagauuugcauaggcuaccacgcuaacaauucuacagaacaaguggauacuaucauggagaagaacguaacggugacccaugcacagaauauucuggagaaaacacacaacgggaaguugugugacaucgauggagucaaacccuuaauucugaaggacugcucaguggccgguuggcuacucggcaauccuaugugugaugaauuuaucaacguuccagaauggaguuauauaguggagaaggcgaauccggcuaacgaccugugcuaccccgggaauuucaacgauuaugaggaacuuaaacaucuguugagcagaaucaaucacuuugagaagauucagaucauuccuaaauccucuuggucggaccaugaagccucaagcggagucaguuccacuuguccauaccagggcacccccucuuucuuuaggaacgugguauggcucaucaagaaaaauaacacauauccuaccauaaagcggagcuacaauaacacuaaccaagaggaucugcugauucucugggguauccaccacuccaaugacgaggcagaacaggccaaguuauaucagaacccaacaaccuacauuucaguugggacgaguacucugaaucagcgccuugugcccaaaaucgcuacccgaagcaaggucaacggacaaucuggccguauggauuucuuuuggacaaucuugaaaccuaaugacgcaauuaacuucgaguccaauggcaacuuuauagccccagaauacgcuuauaagaucgugaaaaagggggauucagccauuaugaaaagcgagguggaauacggaaauugcaacacuaagugucagaccccgaucggugcgauaaauaguucuaugcccuuccauaacauucacccucugacaaucggcgagugcccaaaguaugucaaauccaauaagcuaguucucgcaaccgggcugagaaacagcccccuuagggagcggcgcagaaaaaggggacuguuuggcgccaucgcugguuucauugaagggggauggcagggcaugguggacggcugguacggguaucaucacucgaaugagcagggaucugguuacgccgcagacaaggaauccacgcaaaaagcuaucgauggcguaacuaacaaggugaacucaauuauagacaagaugaauacacaguuugaggccgucgggcgggaguucaacaauuuggaacgccgaaucgagaaccucaauaaaaagauggaagauggauuccuggacguguggaccuauaacgcggaguuacugguucucauggaaaaugagagaacucuugauuuucacgacaguaacgugaaaaaucuguacgauaaggucagguugcagcuacgggacaacgccaaagaacugggcaaugguuguuucgaguuuuaccauaagugcgaugacgaguguauggaaagcgugcguaacgggacauaugauuacccucaauauuccgaggaagcacgccucaagagagaggagauuucuggcguaaaacuggaaagcaucggaaccuaccagauccuuucaauuuauaguacgguugcuuccagccuggccuuggcuauaaugauggccggccucucucuguggaugugcucaaaugggaguuuacagugcaggaucuguauuuga

SEQ ID NO: 129727 - RNA, 1704 nt, Artificial Sequence
  derived and/or modified sequence opt3 from hemagglutinin__InfluenzaA__AEO89100
auggagaagaucgugcccuuccuggccauuauaagccucgucaaauccgaccagaucugcauuggcuaccacgcuaacaauucuaccgaacaaguugauacaaucauggagaagaacgugacuguaacgcaugcacaggacauucuugagaaaacccacaaugggaagcugugugauuuggacggagugaaaccuuuaauccugagagauugcucagucgccgguuggcuacucggcaacccaaugugugacgaguuuauaaaugugccggaauggaguuauaucguugagaaggcgaaccccgcuaaugaucugugcuacccugggaacuucaaugacuaugaggaacuuaagcaucuguugagcaggauuaaccacuuugagaaaauccagauuaucccaaagaacuccuggucugaucaugaagccucgucaggagugagcagugcaugucccuaccagggcacaccuuccuucuuucggaaugucguguggcucauuaaaaagaauaacacuuauccaaccauaaaacgcucuuacaauaacacaaaccaagaggaccugcugauccucugggguauucaccacagcaaugaugccgcugagcagaccaaguuauaucagaaccccacuacauacaucuccguagggaccucaacgcugaaucagcgacuuguuccuaagaucgcaacucguaguaaagugaacggacaaagcggcagaauggacuucuuuuggaccauuuugaagccaaaugaugccauaaacuucgaaucuaauggcaacuuuaucgcuccggaguacgccuauaaaauugucaagaaaggggacuccgcgaucaugaagucagaaguggaguacggaaauugcaacacaaaaugucagacucccauaggugcaauuaauagcaguaugccuuuccauaacauccacccacugaccaucggcgaaugccccaaguaugugaagucuaauaagcuaguccucgccacagggcugaggaacuccccucuucgggagcgcagaaggaaacggggacuguuuggcgcuauugccgguuucaucgaagggggauggcagggcaugguugacggcugguacggguuucaucacagcaaugaacagggaucggguuaugcagcugauaaagagucuacccaaaaggccauugacggcgugacgaacaaaguaaacuccauaaucgauaagaugaauacucaguucgaagcgguggggcgcgaguucaacaauuuggaacgaagaauugagaaccucaauaagaaaauggaggacggauuucuggaugucuggacauacaacgccgaauuacuggugcucauggagaaugaaaggacccuugacuuccacgauucaaacguuaagaaucuguaugacaaagugcgguugcagcuacgugauaacgcaaaggagcugggcaaugguuguuuugaguucuaccauaaaugcgacgaugaauguauggagagugucaagaacgggacuuacgacuauccacaauacagcgaagaggcucgccucaagagagaagagaucuccggcgugaaacuggagucuaucggaacauaucagauucuuagcauauacucaaccguagccaguucccuggcuuuggccaucaugguugcaggccucagccuguggaugugcucuaaugggucauuacagugcaggauuuguaucuga

SEQ ID NO: 129728 - RNA, 1704 nt, Artificial Sequence
  derived and/or modified sequence opt3 from hemagglutinin__InfluenzaA__AEO89109
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagagaaccucuuaauucugugggguauccaccacuccaaugacgccgcugagcagauuaaacuuuaucagaacccaaccacuuacaucucaguugggacaaguaccuugaaucagcgacuggugacgaagaucgcaacucgucccaaagucaacggacaaagcggcagaauggacuuuuucuggaccauucuaaagccuaaugaugccauaaacuuugaaucuaauggcaacuucaucgcuccagaguacgccuauaaaauugugaaggaaggggauuccgcgaucaugaaaucagagguggaauacggaaauugcaacacaaagugucagacuccgauaggugcaauuaauagcaguaugcccuuucauaacauccacccucucaccaucggcgagugcccaaaauaugucaagucuaauaagcugguucuugccacagggcugaggaacucccccuugcgggagcgcagaaggaaacggggacucuucggcgcuauugccgguuuuaucgaagggggauggcagggcaugguggacggcugguacggguaucaucacagcaaugagcagggaucggguuacgcagcugacaaggaaucuacccaaaaagccauugauggcguaacgaacaaggugaacuccauaaucgacaaaaugaauacucaguucgaggcggucgggcgcgaauuuaacaaucuggagcgaagaauugagaacuuaaauaagaagauggaagauggauuccuggacguguggacauauaacgccgagcuccuuguucugauggaaaaugagaggaccuuggauuuccacgacucaaacgugaaaaaucuauacgauaagguccggcugcagcuccgugacaacgcaaaagaacugggcaaugguuguuuugaguucuaccauaagugcgauaacgaguguauggaaagugugcgcaaugggacuuaugacuacccucaauauagcgaggaagcuagacuuaaaagggaggagaucuccggcguaaagcuggaaucuaucggaacauaccagauuuugagcauauauucaaccguugccaguucccucgcucuggccaucaugguggcaggcuuaagccuguggaugugcucuaacgggucacuacagugccggauuuguaucuga

SEQ ID NO: 129729 - RNA, 1704 nt, Artificial Sequence
  derived and/or modified sequence opt3 from hemagglutinin__InfluenzaA__AEO89127
auggagaagaucgugcugcuccuugccauuauaagccuggucaaauccgaccagaucugcauuggcuaccacgcuaacaauucuaccgaacaaguugauacaaucauggagaagaacgugacuguaacgcaugcacaggacauuuuggaaaagacccacaaugggaaguuaugugaucuggacggagugaaaccccuaauccucagagauugcucagucgccgguuggcugcuuggcaacccuaugugugacgaguucauaaaugugccagaauggaguuauaucguugagaaggcgaacccggcuaaugaucugugcuaccccgggaacuuuaaugacuaugaggaauugaagcaucuccugagcaggauuaaccacuucgagaaaauccagauuaucccuaaguccucuuggucggaucaugaagccucaagcggagugaguuccgcauguccauaccagggcacacccagcuuuuuccggaaugucguguggcugauuaaaaagaacaauacuuauccuaccauaaaacgcucuuacaacaauacaaaccaagagaaccucuuaauccugugggguauucaccacuccaaugacgccgcugagcagaucaaacuuuaucagaacccaaccacuuacaucucaguagggacaaguaccuugaaucagcgacugguucccaagauugcaacgcguagcaaagugaacggacaaucuggcagaauggacuuuuucuggacuauacuaaagccuaaugaugccaucaacuuugaauccaauggcaacuucauugcuccagaguacgccuauaaaaucgucaaggaaggggauucagcgauaaugaaaagcgagguggaauacggaaauugcaacaccaagugucagacaccgauuggugcaaucaauaguucuaugcccuuucauaacauccacccucucacuauuggcgagugcccaaaauaugugaaguccaauaagcugguccuugccaccgggcugaggaacagccccuugcgggagcgcagaaggcggcgcggacucuucggcgcuaucgccgguuuuauugaagggggauggcagggcaugguugacggcugguacggguaucaucacucgaaugagcagggaucugguuacgcagcugacaaagaauccacacaaaaggccauagauggcgugaccaacaaaguaaacucaaucauugacaagaugaauacgcaguucgaggcgguggggcgagaauuuaacaaucuggagagaaggaucgagaacuuaaauaaaaagauggaagauggauuccuggacgucuggacuuauaacgccgagcuccuugugcugauggaaaaugagcggacauuggauuuccacgacaguaacguuaagaaucuauacgauaaagugcgucugcagcuccgcgacaacgcaaaggaacugggcaaugguuguuuugaguucuaccauaaaugcgauaacgaguguauggaaagcgucagaaaugggaccuaugacuacccucaauauuccgaggaagcuaggcuuaagcgggaggagaucucuggcauuaaacuggaaagcaugggaacuuaccagauauugucaaucuauaguacaguggccuccagccucgcucuggccauuaugguagcaggcuuaucucuguggaugugcucaaacgggagucuacagugccgaaucuguauuuga

SEQ ID NO: 129730 - RNA, 1704 nt, Artificial Sequence
  derived and/or modified sequence opt3 from hemagglutinin__InfluenzaA__AEO89145
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucggugauugcucaguggccggcuggcugcuugggaacccuaugugugacaaguucaucaauguuccagaguggaguuauauaguggaaaaggcgaacccggcuaaugaucugugcuaccccggaaacuuuaaugacuaugaggaguugaaacaucuccugagcagaaucaaccacuucgaaaagauucagaucauuccuaaauccucuuggucggaucaugaggccucaagcggcgucaguuccgcauguccauaccaggguacacccagcuuuuucaggaaugugguauggcugacuaagaaaaacaauaccuauccuacaaucaagcggucuuacaacaauaccaaccaagaagaccucuuaauacugugggggauucaccacuccaacaaugccgcugagcaggagaaacuuuaucagaacccaacuacauacaucucaguuggaaccaguacguugaaucagcgccuggugcccaaaauugcaacucgaagcaaggucaacggccaaucuggccguauggacuuuuucuggaccauccuaaaaccuaaugaugccaucaacuuugaauccaaugggaacuucauugcuccagaguacgccuauaagauagugaaaaagggagauucagcgaucaugaaaagcgguguggaauacggcaauugcaacacaaagugucagacuccgauuggggcaaucaauaguucuaugcccuuucauaacauacacccucucaccauuggagagugcccaaaguaugucaaauccaauaagcugguucuugccacaggccugagaaacagccccuugagggaacggcgcagaaaaaggggucucuucggggcuaucgccggauuuaucgagggcggcuggcaggggaugguggacggaugguacgguuaucaucacucgaaugagcagggcucuggguacgcagcugacaaggaauccacccaaaaagccauugauggaguaacgaacaaggugaacucaaucauugacaagaugaauacucaguucgaggcggucggccgggaauuuaacaaucuggagcgccgaauagaaaacuuaaauaaaaagauggaggaugguuuccuggacguguggacauauaacgccgagcuccuuguucugauggaaaaugagagaaccuuggauuuccacgacaguaacgugaaaaaucuauacgauaaggucaggcugcagcuccgggacaacgcaaaagaacuggggaauggcuguuuugaguucuaccauaagugcgauaacgaauguauggagagcgugcguaauggaacuuaugacuacccucaauauuccgaggaagcucgccuuaagagagaggaaaucucuggcguaaaacuggagagcauugggacauaccagaucuugucaaucuauaguaccgccgcuuccagccucgcccuggcaauuaugguugccggauuaucucuguggaugugcucaaacgguagucuacagugcaggauauguaucuga

SEQ ID NO: 129731 - RNA, 1707 nt, Artificial Sequence
  derived and/or modified sequence opt3 from hemagglutinin__InfluenzaA__AEO89163
auggagaagaucgugcuucucuucgccauugucagccuuguuaaauccgaccacauaugcaucggcuaccaugcuaacaauucuaccgaacagguggauacaauuauggagaagaacguaacugugacgcacgcacaagacauccuggaaaagacccauaaugggaaguugugugauuuaaacggagucaaaccccugauucuaaaggacugcucaguggccgguuggcuccugggcaauccuaugugugaugaguuuaucgacguuccagaauggaguuauauaguggagaaggcgaacccggcuaaugaucuuugcuaccccgggaacuucaaugacuaugaggaacugaaacacuugcucagcagaaucaaccauuuugagaagauucagaucauuccuaaagauuccuggccagaccacgaagccucucugggagucucgucagcaugucccuaccagggcaauagcaguuucuuuaggaacgugguauggcugaucaagaaagguaaugccuauccuacaauaaagaaguccuacaacaauacuaacaaagaggaucucuuaauucugugggggauccaccauccaaacgacgaggcugaacagacccggcuuuaucaaaaucccacaaccuacauuucuaucggaacuagcacauugaaccagcgccugguuccucgaaucgcaacccguuccaaggugaauggccagucaggcagaauugauuucuuuuggacgauacuaaaaccaaacgacgccaucaauuucgagaguaacgggaauuuuauugcuccggaauacgccuauaagaucgucaaaaagggagacagcacuauaaugaaaucugagguggaauacgguaacugcaauaccaggugucagacacccaugggcgcgauuaacuccucaaugccuuuccacaauauccauccacucacuaucggggagugccccaaguaugugaaaagcaacaaacugguccuugcaaccggacugcggaauaguccucaacgcgagagaaggcggcgcaagcgaggcuuguuuggugccauugcuggguucaucgaaggaggcuggcagggcaugguugaugggugguacggauaucaccacucuaacgagcaggguuccggcuacgccgcagacaaagaaagcacacagaaggcuauugauggggugaccaauaaaguaaacucgauaaucgacaagaugaacacgcaauuugaggccgugggaagagaguucaauaaccucgaaaggcggauugagaaucugaacaagaaaauggaagauggcuucuuagacgucuggacuuauaaugcggagcugcucgugcuuauggaaaacgagcguacacuggauuuucaugacucuaauguuaagaacuuguacgauaaagugcgccuacagcugagagacaaugccaaggaacucgguaacggguguuucgaguuuuaccacaaaugcgauaaugaguguauggaauccgucaggaacggcaccuaugacuacccacaguauucagaggaagcacggcugaagcgagaggagaucaguggagugaagcuggaaagcaucggcacuuaccaaauucuguccauauauucuacaguagcuagcucauugguucucgccaucaugguggcugggcugaguuuauggaugugcuccaauggaagccugcagugccgcauuuguaucuga

SEQ ID NO: 129732 - RNA, 1704 nt, Artificial Sequence
  derived and/or modified sequence opt3 from hemagglutinin__InfluenzaA__AEO89172
auggagaagaucgugcugcuccuugccauugucagccugguuagauccgaccagauaugcaucggcuaccacgcuaacaauucuaccgaacaaguggauacaauuauggagaaaaacguaacugugacgcaugcacagaauaucuuggaaaagacccacaacgggaaauuaugugaccuggauggagucaagccccuaauucucagggacugcucaguggccgguuggcugcuuggcaauccuaugugugaugaguucaucaacguuccagaauggaguuauauaguggagaaagcgaauccggcuaacgaccugugcuaccccgggaauuuuaacgauuaugaggaauugaagcaucuccugagccggaucaaucacuucgagaagauucagaucauuccuaaauccucuuggucggaccaugaagccucaagcggagucaguuccgcauguccauaccagggcacacccagcuuuuuccgcaacgugguauggcugaucaagaaaaauaacacuuauccuaccauaaagcgaucuuacaauaacacaaaccaagaggaucucuuaguucugugggguauucaccacuccaaugacgccaccgagcagaucaaacuuuaucagaacccaacuacauacgugucagucgggaccaguacguugaaucagcgucuggugcccaagauugcuacuagaagcaaggugaacggacaaucuggcaggauggacuuuuucuggaccauccuaaaauccaaugaugcaaucaacuuugaaucaaauggcaacuucauugccccugaguacgcuuauaagauagucaaaaagggggauagcgccaucaugaaaagugaaguugaguacggaaauugcucuacaaagugucagacuccaauuggugcgaucaacuccagcaugccguuucauaauauacacccccucaccauuggcgaaugcccuaaauaugugaagucgaacaagcugguacuugcaacagggcugcgcaauucuccauugcgggagagaaggcggaaacgcggacucuucggcgccaucgcugguuuuaucgaagggggauggcagggcaugguggacggcugguacggguaucaucacuccaacgaacagggaucagguuacgccgcagacaaggagaguacccaaaaagcuauugauggcgucacgaauaaggugaacagcaucauugacaaaaugaacacucaguucgaagccguugggcgagaguuuaauaaccuggaaagaaggauagagaauuuaaacaagaagauggaggauggauuccuggacguguggacauauaaugcggaacuccuuguccugauggagaacgaacggaccuuggauuuccacgacuccaaugugaaaaaccuauacgauaagguacgucugcagcuccgcgacaaugccaaagagcugggcaacgguuguuuugaguucuaccauaagugcgauaaugaguguauggagucuguuagaaacgggacuuaugacuacccccaauauagcgaagaggcaaggcuuaaacgggaagagaucucaggcgugaagcuggagaguauuggaacauaccagaucuuguccaucuauagcaccgucgcuucuucacucgcccuggcuauuaugguggccggcuuaagucuguggaugugcagcaaugggucccuacagugccgaauauguaucuga

SEQ ID NO: 129733 - RNA, 1704 nt, Artificial Sequence
  derived and/or modified sequence opt3 from hemagglutinin__InfluenzaA__AEO89181
auggagaagaucgugcuccuguucgccaccauuagccuugucaaauccgaccacauaugcaucggcuaccaugcuaacaauucuacagaacagguugauacuauuauggagaagaacgugacgguaacccacgcacaagacauccuggaaaagacacauaaugggaaguugugugauuuaaacggagugaaaccccugauucuaaaggacugcucagucgccgguuggcuccugggcaauccuaugugugaugaguuuaucaacgugccagaauggaguuauauaguugagaaggcgaauccggcuaacgaccuuugcuaccccgggaauuucaacgauuaugaggaacugaaacacuugcucagcagaaucaaucauuuugagaagauucagaucauuccuaaaaacuccuggucugaccacgaagccucgcugggagugucagcagccuguccauaccagggcaagagcaguuucuuuaggaaugucguguggcugaucaaaaaggauaacgcuuaucccacuauaaagaaagguuacaauaacaccaaccaggaggaccucuuaguacugugggggauucaccauccuaaugaugaggcagaacaaacacggcuuuaucagaacccaaccacuuacaucuccauuggaacaucuaccuugaaucagcgccugguucccaagaucgccacgcgaagcaaaaucaacggccaguccggccguauugacuucuuuuggacuauacuaaagccuaaugaugcuauccacuucgagucaaacgggaauuuuauugccccagaauacgcguauaaaaucgugaagaaaggagacaguaccauaaugaaaagcgaggucgaauacgguaacugcaauacaagaugucaaacuccgauuggcgcaaucaacucuuccaugcccuuccauaauauccacccucucaccauuggggagugcccaaaguaugugaaaucaaacaagcuggugcuugccacaggacugaggaauagcccccagcgggagcgcagaaggaaacggggcuuguuuggugcuaucgccggguucauugaaggaggcuggcagggcauggucgacgggugguacggauaucaccauaguaacgagcaggguucuggcuacgcagcugauaaggaauccacccaaaaagccauagacgggguuacgaauaaggugaacagcaucauugauaagaugaacacucaguuugaggcgguaggacgcgaguucaauaaccucgaacgaagaaucgagaaucugaacaaaaagauggaagacggcuucuuagauguguggacauauaaugccgagcugcucguccuuauggaaaacgagaggacccuggacuuucacgauucgaaugugcggaacuuguacgacaaaguucgucuacagcugaaggauaaugcaaaagaacucgguaacggguguuucgaguuuuaccauaagugcgacaaugaguguauggaaucugugcgcaacggcacuuaugauuacccucaauauuccgaggaagcuagacugaagagggaggagaucucaggagucaaacuugaaaguauuggcauauaccagauccugagcauuuauuccacaguggccucuagcuugguacucgcuaucaugauggccgggcugucauuauggaugugcaguaauggaucccugcagugccggauuuguaucuga

SEQ ID NO: 129734 - RNA, 1704 nt, Artificial Sequence
  derived and/or modified sequence opt3 from hemagglutinin__InfluenzaA__AEO89192
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagagaaccucuuaauucugugggguauccaccacuccaaugacgccgcugagcagauuaaacuuuaucagaacccaaccacuuacguuucaaucgggacaaguaccuugaaucagcgacuggugcccaagaucgcaacgcguagcaaagucaacggacaaucuggcagaauggacuuuuucuggacuauucuaaagccuaaugaugccauaaacuuugaauccaauggcaacuucaucgcuccagaguacgccuauaaaauugugaaggaaggggauucagcgaucaugaaaagcgagguggaauacggaaauugcaacaccaagugucagacaccgauaggugcaauuaauaguucuaugcccuuucauaacauccacccucucacuaucggcgagugcccaaaauaugucaaguccaauaagcugguucuugccaccgggcugaggaacagccccuugcgggagcgcagaaggaaacggggacucuucggcgcuauugccgguuuuaucgaagggggauggcagggcaugguggacggcugguacggguauccucauucgaaugagcagggaucugguuacgcagcugacaaggaauccacacaaaaagccauugauggcguaaccaacaaggugaacucaauaaucgacaaaaugaauacgcaguucgaggcggucgggcgcgaauuuaacaaucuggagcgaagaauugagaacuuaaauaagaagauggaagauggauuccuggacguguggacuuauaacgccgagcuccuuguucugauggaaaaugagaggacauuggauuuccacgacaguaacgugaaaaaucuauacgauaagguccggcugcagcuccgugacaacgcaaaagaacugggcaaugguuguuuugaguucuaccacaagugcgauaacgaguguauggaaagcgugcgcaaugggaccuaugacuacccacaauauuccgaggaagcuagacuuaaaagggaggagaucaacggcguaaagcuggaaucuaucggaacuuaccagauuuugagcauauauucaacaguugccaguucccucgcucuggccaucaugguggcaggcuuaagccuguggaugugcucuaaugggucacuacagugccggauuuguaucuga

SEQ ID NO: 129735 - RNA, 1704 nt, Artificial Sequence
  derived and/or modified sequence opt3 from hemagglutinin__InfluenzaA__AEO89203
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagagaaccucuuaauucugugggguauccaccacuccaaugacgccgcugagcagauuaaacuuuaucagaacccaaccacuuacguuucaaucgggacaaguaccuugaaucagcgacuggugcccaagaucgcaacgcguagcaaagucaacggacaaucuggcagaauggacuuuuucuggacuauucuaaagccuaaugaugccauaaacuuugaauccaauggcaacuucaucgcuccagaguacgccuauaaaauugugaaggaaggggauucagcgaucaugaaaagcgagguggaauacggaaauugcaacaccaagugucagacaccgauaggugcaauuaauaguucuaugcccuuucauaacauccacccucucacuaucggcgagugcccaaaauaugucaaguccaauaagcugguucuugccaccgggcugaggaacagccccuugcgggagcgcagaaggaaacggggacucuucggcgcuauugccgguuuuaucgaagggggauggcagggcaugguggacggcugguacggguaucaucacucgaaugagcagggaucugguuacgcagcugacaaggaauccacacaaaaagccauugauggcguaaccaacaaggugaacucaauaaucgacaaaaugaauacgcaguucgaggcggucgggcgcgaauuuaacaaucuggagcgaagaauugagaacuuaaauaagaagauggaagauggauuccuggacguguggacuuauaacgccgagcuccuuguucugauggaaaaugagaggacauuggauuuccacgacaguaacgugaaaaaucuauacgauaagguccggcugcagcuccgugacaacgcaaaagaacugggcaaugguuguuuugaguucuaccauaagugcgauaacgaguguauggaaagcgugcgcaaugggaccuaugacuacccucaauauuccgaggaagcuagacuuaaaagggaggagaucaacggcguaaagcuggaaucuaucggaacuuaccagauuuugagcauauauucaacaguugccaguucccucgcucuggccaucaugguggcaggcuuaagccuguggaugugcucuaaugggucacuacagugccggauuuguaucuga

SEQ ID NO: 129736 - RNA, 1704 nt, Artificial Sequence; identical to SEQ ID NO: 129735
  derived and/or modified sequence opt3 from hemagglutinin__InfluenzaA__AEO89213

SEQ ID NO: 129737 - RNA, 1704 nt, Artificial Sequence; identical to SEQ ID NO: 129735
  derived and/or modified sequence opt3 from hemagglutinin__InfluenzaA__AEO89224

SEQ ID NO: 129738 - RNA, 1704 nt, Artificial Sequence
  derived and/or modified sequence opt3 from hemagglutinin__InfluenzaA__AEO89235
auggagaagaucgugcugcuccuugccauggucagccugguuagauccgaccagauuugcauaggcuaccacgcuaacaauucuaccgaacaaguggauacaaucauggagaaaaacguaacugugacgcaugcacaggacauuuuggaaaagacccacaaugggaaauuaugugaucuggacggagucaagccccuaauccucagggauugcucaguggccgguuggcugcuuggcaacccuaugugugacgaguucauuaauguuccagaauggaguuauaucguggagaaagcgaacccggcuaaugaucugugcuaccccgggaacuugaaugacuaugaggaacucaagcaucugcugagccggauaaaccacuuugagaagauccagauuaucccuaaauccucuuggucggaucaugaagccucacucggagucagcagugcauguccauaccagggcacacccuccuucuuucgcaaugugauuugguuaaucaagaaaaacaauacuuauccuaccauaaagcgaucuuacaacaauacaaaccaagaggaccugcuuauuuugugggguauccaccacagcaacgaugaggccgaacagauuaaacuguaucagaauccaaccacuuacaucuccguagggacaucaacccuaaaccagcgucucguucccaagaucgcuacgagaaguaaggugaauggacaaagcggcaggauggacuucuuuuggacuauucugaaaccugaugacgcaauaaacuucgagucuaauggcaacuuuaucgccccagaauacgcuuauaagauugucaaaaagggggacuccgccaucaugaaaucagagguggaauacggaaauugcaacaccaagugucagacaccgauaggugcgauuaauagcaguaugcccuuccauaacauccacccucuuacuaucggcgagugcccaaaauaugugaagucuaauaagcuggucuuggcaaccgggcuccggaacagcccccugcgcgagaaaagaaggaagcggggauuauuuggcgccauugcugguuucaucgaagggggauggcagggcaugguugauggcugguacggguaucaucacuccaaugagcagggaucggguuacgccgcagacaaagaaucuacacaaaaggcuauugauggcgugaccaacaaaguaaauuccauaaucgacaagaugaacacgcaguuugaggccguggggcgcgaguucaacaaucuggaacgaagaauugagaaccucaauaagaaaauggaagauggauuucuugacgucuggacuuauaacgcggagcuguuggugcuaauggaaaaugagaggacacuggauuuccacgacucaaacguuaagaaucucuacgauaaagugcggcugcagcuucgugacaacgccaaggaacugggcaaugguuguuucgaguuuuaccauaaaugcgauaacgaguguauggaaaguguccgcaaugggaccuaugacuacccucaauauagcgaggaagcaagauugaagagggaggagaucuccggcgugaagcucgaaucuaucggaacuuaccagauucugagcauauauucaacaguagcuaguuccuuagcccuggcuaucaugguugccggccuaagccucuggaugugcucuaacgggucacugcagugccggauuuguaucuga

SEQ ID NO: 129739 - RNA, 1704 nt, Artificial Sequence
  derived and/or modified sequence opt3 from hemagglutinin__InfluenzaA__AEO89246
auggagaagaucgugccccugcucgccauggucagccuuguuaaauccgaccagauuugcauaggcuaccacgcuaacaauucuaccgaacaaguggauacaaucauggagaagaacguaacugugacgcaugcacaggacauucuggaaaagacccacaaugggaaauugugugauuuagacggagucaaaccucugauccuaagagauugcucaguggccgguuggcuccugggcaacccaaugugugacgaguucauuaauguuccggaauggaguuauaucguggagaaggcgaaccccgcuaaugaucuuugcuacccugggaaccugaaugacuaugaggaauugaagcaucuccugagcaggauaaaccacuuugagaaaauccagauuaucccaaaguccucuuggucggaucaugaagccucacugggagucagcagugcaugucccuaccagggcacaccuuccuucuuucggaaugugguauggcucauuaaaaagaacaauacuuauccaaccaucaaacgcucuuacaacaauacaaaccaagaggacuuacugauacuuugggguauucaccacagcaacgaugaggccgaacagaucaaguuguaucagaaucccaccacuuacauuuccguugggacaucaacccugaaccagcgucuagugccuaagaucgcuacgcgaaguaaagucaauggacaaagcggcagaauggacuucuuuuggacuauccucaagccagaugacgcaauuaacuucgagucuaauggcaacuuuauagccccggaauacgcuuauaaaaucgugaagaaaggggacuccgccauuaugaagucagagguggaauacggaaauugcaacaccaaaugucagacacccaucggugcgauaaauagcaguaugccuuuccauaacauucacccacugacuaucggcgagugccccaaguaugucaagucuaauaaacuuguucuggcaaccggguugaggaacuccccucuccgggagcgcagaaggaagcggggacuguuuggcgccaucgcugguuucauugaagggggauggcagggcaugguggauggcugguacggguaucaucacagcaaugagcagggaucggguuacgccgcagacaaagaaucuacacaaaaggcuaucgauggcguaaccaacaaagucaauuccauuauagacaagaugaacacgcaguuugaggccguggggcgcgaguucucaaacuuagaacgaagaaucgagaaucugaacaagaaaauggaagauggauuucucgacguguggacuuauaaugcggagcuucugguuuugauggaaaacgagaggacacuagauuuccacgacaguaaugugaagaaccuguacgauaaaguccggcuccagcugcgugacaaugccaaggaacuuggcaacgguuguuucgaguuuuaccauaaaugcgauaaugaguguauggaaagcgugcgcaacgggaccuaugacuacccacaauauuccgaggaagcaagacugaagagggaggagauuucuggcguaaaguuggaaagcaucggaacuuaccagauccucucaauuuauaguacaguugcuuccagccuggccuuagcuauaaugguggccggccugucucuauggaugugcucaaaugggagucuccagugccggaucuguauuuga

SEQ ID NO: 129740 - RNA, 1704 nt, Artificial Sequence
  derived and/or modified sequence opt3 from hemagglutinin__InfluenzaA__AEO89257
auggagaagaucgugcugcuccuugccauugucagccugguuagauccgaccagauaugcaucggcuaccacgcuaacaauucuaccgaacaaguggauacaauuauggagaaaaacguaacugugacgcaugcacaggacaucuuggaaaagacccacaaugggaaauuaugugaucuggacggagucaagccccuaauucucagggauugcucaguggccgguuggcugcuuggcaacccuaugugugacgaguucaucaauguuccagaauggaguuauauaguggagaaagcgaacccggcuaaugaucugugcuaccccgggaacuuuaaugacuaugaggaauugaagcaucuccugagccggaucaaccacuucgagaagauucagaucauuccuaaauccucuuggucggaucaugaagccucaagcggagucaguuccgcauguccauaccagggcacacccagcuuuuuccgcaaugugguauggcugaucaagaaaaacaauacuuauccuaccauaaagcgaucuuacaacaauacaaaccaagaggaccucuuaguucugugggguauucaccacuccaacgaugccgcugagcagaucaaacuuuaucagaauccaaccacuuacgugucagucgggacaaguaccuugaaccagcgucuggugcccaagauugcaacgagaagcaaggugaauggacaaucuggcaggauggacuuuuucuggacuauccuaaaauccaacgaugccaucaauuuugaaucaaacggcaauuucauugcuccugaguacgccuauaagauagucaaaaagggggacagcgcgaucaugaaaagugaaguugaguacggaaacugcucuaccaagugucagacaccaauuggugcaaucaauuccagcaugccguuucauaacauacacccccucacuauuggcgaaugcccuaaauaugugaagucgaauaagcugguacuugccaccgggcugcggaacucuccauugcgcgagagaaggcggaaacgcggacucuucggcgcuaucgccgguuuuaucgaagggggauggcagggcaugguggacggcugguacggguaucaucacuccaaugaacagggaucagguuacgcagcugauaaggagaguacacaaaaagccauugacggcgucaccaacaaggugaauagcaucauugauaaaaugaacacgcaguucgaagcgguugggcgagaguuuaacaaucuggaaagaaggauagagaacuuaaauaagaagauggaggacggauuccuggauguguggacuuauaacgccgaacuccuuguccugauggagaaugaacggacauuggacuuccacgauuccaacgugaaaaaucuauacgacaagguacgucugcagcuccgcgauaacgcaaaagagcugggcaaugguuguuuugaguucuaccauaagugcgacaacgaguguauggagucuguuagaaaugggaccuaugauuacccccaauauagcgaagaggcuaggcuuaaacgggaagagaucucaggcgugaagcuggagaguauuggaacuuaccagaucuuguccaucuauagcacagucgccucuucacucgugcuggcuauuauggucgccggcuuaagucuguggaugugcagcaacgggucccuacagugccgaauauguaucuga

SEQ ID NO: 129741 - RNA, 1704 nt, Artificial Sequence; identical to SEQ ID NO: 129740
  derived and/or modified sequence opt3 from hemagglutinin__InfluenzaA__AEO89268

SEQ ID NO: 129742 - RNA, 1704 nt, Artificial Sequence
  derived and/or modified sequence opt3 from hemagglutinin__InfluenzaA__AEO89279
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucggugauugcucaguggccggcuggcugcuugggaacccuaugugugacaaguucaucaauguuccagaguggaguuauauaguggaaaaggcgaacccggcuaaugaucugugcuaccccggaaacuuuaaugacuaugaggaguugaaacaucuccugagcagaaucaaccacuucgaaaagauucagaucauuccuaaauccucuuggucggaucaugaggccucaagcggcgucaguuccgcauguccauaccaggguacacccucuuucuucaggaaugugguauggcugaucaagaaaaacaauacuuauccuaccauaaagcggagcuacaacaauacaaaccaagaagaccucuuaauucugugggggauccaccacuccaacaaugccgcugagcaggagaaacuuuaucagaacccaaccacuuacauuucaguuggaacaaguaccuugaaucagcgccuggugcccaaaaucgcaacgcgaagcaaggucaacggccaaucuggccguauggacuuuuucuggacuauccuaaaaccuaaugaugccauuaacuuugaauccaaugggaacuucauagcuccagaguacgccuauaagaucgugaaaaagggagauucagcgauuaugaaaagcggugugaaguacggcaauugcaacaccaagugucagacaccgaucggggcaauaaauaguucuaugcccuuucauaacauucacccucucacuaucggagaaugcccaaaauaugucaaguccaauaaacugguucuugccaccggccugagaaacagccccuugagggagcggcgcagaaagaggggucucuucggggcuaucgccggauuuauugaaggcggcuggcaggggaugguggacggaugguacgguuaucaucacucgaaugagcagggcucuggguacgcagcugacaaagaguccacacaaaaggccaucgauggaguaaccaacaaggugaacucaauuauagacaaaaugaauacgcaguucgaagcggucggccgggaguuuaacaaucuggaacgccgaaucgagaacuuaaauaagaaaauggaagaugguuuccuggacguguggacuuauaacgccgagcuccuuguucugauggagaaugaaagaacauuggauuuccacgacaguaacgugaagaaucuauacgauaaagucaggcugcagcuccgggacaacgcaaaggagcuggggaauggcuguuuugaauuuuaccauaagugcgauaacgaguguauggaaagcgugcguaauggaaccuaugacuacccucaauauuccgaggaggcucgccuuaaaagagaagagauuucuggcguaaagcuggaaagcaucgggacuuaccagaucuugucaauuuauaguacagccgcuuccagccucgcccuggcaauaaugguugccggauuaucucuguggaugugcucaaacgguagucuacagugcaggaucuguauuuga

SEQ ID NO: 129743 - RNA, 1704 nt, Artificial Sequence
  derived and/or modified sequence opt3 from hemagglutinin__InfluenzaA__AEO89289
auggagaagaucgugcugcuccuugccauugucagccuggcuaaauccgaccagauaugcaucggcuaccacgcaaacaauucuaccgaacaaguugauacaauuauggagaagaacgugacuguaacgcaugcccaggacaucuuggaaaagacccacaaugggaaguuaugugaucuggacggagugaaaccccuaauucucggugauugcucagucgcgggcuggcugcuugggaacccuaugugugacaaguucaucaaugugccagaguggaguuauauaguugaaaaggugaacccggcuaaugaucugugcuaccccggaaacuuuaaugacuaugaggaguugaaacaucuccugagcagaaucaaccacuucgaaaagauuaaaaucauuccuaaguccucuuggucggaucaugaggccucaagcggcgucaguuccgcauguccauaccaggguacacccagcuuuuucaggaaugugguauggcugaucaaaaagaacaauacuuauccuaccauaaagcggucuuacaacaauacaaaccaggaagaccucuuaauucugugggggauccaccacuccaacaauguugccgagcaagagaaacuuuaucagaacccaaccacuuacauuucagugggaacaaguaccuugaaucagcgccugguccccaagaucgcuacgcgaagcaaagugaacggccagucuggccguauggacuuuuucuggacuauccuaaagccuaaugauaccauuaacuuugaauccaaugggaacuucauagcaccagaguacgccuauaaaaucgugaagaaaggagauucagcuauuaugaaaagcggugucgaauacggcaauugcaacacaaagugucaaacuccgaucggggccauaaauaguucuaugcccuuucauaacauucacccucucaccaucggagagugcccaaaauauguuaaguccaauaaacuggugcuugcgacaggccugagaaacagccccuugagggaacggcgcagaaagaggggucucuucggggcaaucgccggauuuauugagggcggcuggcaggggaugguagacggaugguacgguuaucaucacucgaaugagcagggcucuggguacgcugccgacaaagaauccacccagaaggcaaucgauggagugacgaacaaggucaacucaauuauagacaaaaugaauacucaauucgaggcugugggccgggaauuuaacaaucuggagcgccgaaucgaaaacuuaaauaagaaaauggaggaugguuuccuggacguuuggacauauaacgccgagcuccuugugcugauggaaaaugagagaaccuuggauuuccacgacaguaacgucaagaaucuauacgauaaagugaggcugcagcuccgggacaacgcgaaggaacuggggaauggcuguuuugaguucuaccauaagugcgauaacgaauguauggagagcguacguaauggaacuuaugacuacccucgcuauuccgaggaagccagacuuaaaagggaggaaauuucuggcguuaagcuggagagcaucgggacauaccagaucuugucaauuuauaguaccgcagcuuccagccucgcccuggcuauaaugguggccggauuaucucuguggaugugcucaaacgguagucuacaaugccggaucuguauuuga

SEQ ID NO: 129744 - RNA, 1704 nt, Artificial Sequence
  derived and/or modified sequence opt3 from hemagglutinin__InfluenzaA__AEO89300
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcagcuacaacaauacaaaccaagagaaccucuuaauucugugggguauccaccacuccaaugacgccgcugagcagauuaaacuuuaucagcauccaaccacuuacaucucaguugggacaaguaccuugaaccagcgacuggugcccaagaucgcaacgcguagcaaagucaauggacaaucuggcagaauggacuuuuucuggacuauucuaaagccuaacgaugccauaaauuuugaauccaacggcaauuucaucgcuccagaguacgccuauaaaauugugaaggaaggggauucagcgaucaugaaaagcgagguggaauacggaaacugcaauaccaagugucagacaccgauaggugcaauuaacaguucuaugcccuuucacaauauccauccucucacuaucggcgagugcccaaaauaugucaaguccaacaagcugguucuugccaccgggcugaggaauagccccuugcgggagcgcagaaggaaacggggacucuucggcgcuauugccgguuuuaucgaagggggauggcagggcaugguggacggcugguacggguaucaccacucgaacgagcagggaucugguuacgcagcugacaaggaauccacacaaaaagccauugauggcguaaccaauaaggugaacucaauaaucgacaaaaugaacacgcaguucgaggcggucgggcgcgaauuuaauaaccuggagcgaagaauugagaauuuaaacaagaagauggaagauggauuccuggacguguggacuuauaaugccgagcuccuuguucugauggaaaacgagaggacauuggauuuccaugacaguaaugugaaaaaccuauacgauaagguccggcugcagcuccgugacaaugcaaaagaacugggcaacgguuguuuugaguucuaccacaagugcgauaaugaguguauggaaagcgugcgcaacgggaccuaugacuacccucaauauuccgaggaagcuagacuuaaaagggaggagaucaauggcguaaagcuggaaucuaugggaacuuaccagaucuugagcauuuauucaacaguugccaguucccucgcucuggccauaaugguggcaggcuuaucuuuuuggaugugcucuaacgggucacugcagugccggaucuguauuuga

SEQ ID NO: 129745 - RNA, 1704 nt, Artificial Sequence
  derived and/or modified sequence opt3 from hemagglutinin__InfluenzaA__AEO89311
auggagaagaucgugcuccuguucgccauugucagccuuguuaaauccgaccacauaugcaucggcuaccaugcuaacaauucuaccgaacagguggauacaauuauggagaagaacguaacugugacgcacgcacaagacauccuggaaaagacccauaaugggaaguugugugauuuaaacggagucaaaccccugauucuaaaggacugcucaguggccgguuggcuccugggcaauccuaugugugaugaguuuaucaacguuccagaauggaguuauauaguggagaaggcgaauccggcuaacgaccuuugcuaccccgggaauuucaacgauuaugaggaacugaaacacuugcucagcagaaucaaucauuuugagaagauucagaucauuccuaaagacuccuggucugaucacgaagccucgcugggagucucagcagccuguccauaccagggcaacagcaguuucuuuaggaaugugguauggcugaucaagaaagacaacgcuuaucccacaauaaagaaguccuacaauaacacuaaccaggaggaucucuuaauucugugggguauccaccauccuaaugacgaggcagaacaaacccggcuuuaucagaacccaacaaccuacauuucuaucgggacuagcacauugaaucagcgccugguucccaaaaucgccacccgauccaaggugaacggacagucaggccguauugauuucuuuuggacgauacuaaaaccuaaugacgcuauccacuucgagaguaacggcaauuuuauugccccagaauacgcguauaagaucgucaaaaagggggacagcacuauaaugaaaucugagguggaauacggaaacugcaauaccagaugucaaacaccgaugggugcaauuaacuccucaaugcccuuccauaauauccacccucucacuaucggcgagugcccaaaguaugugaaaagcaccaaacugguccuugccacagggcugaggaacaguccccagcgggagcgcagaaggaagcggggauuguuuggcgcuauugccgguuucaucgaagggggauggcagggcaugguugauggcugguacggguaucaccauucuaaugagcagggauccgguuacgcagcugacaaagaaagcacccaaaaggccauugauggcgugacgaacaaaguaaauucgauaaucgacaagaugaacacucaguuugaggcgguggggcgcgaguucaacaagcucgaacgaagaauugagaaucugaacaaaaagauggaagauggauucuuagacgucuggacauauaaugccgagcugcucgugcuuauggaaaacgagaggacccuggauuuucacgacucuaauguuaaaaacuuguacgauaaggugcggcuacagcugcgugacaaugcaaaagaacucggcaacgguuguuucgaguuuuaccauaagugcaauaacgaguguauggaauccguccgcaaugggacuuaugauuacccucaauauucagaggaagcuagacugaagagggaggagaucaguggcgugaaacuugaaagcaucggaauuuaccagauacuguccaucuauucuacaguagccagcucauugguucucgcuauuaugauggccggccugaguuuauggaugugcuccaacgggagccugcagugccggaucuguauuuga

SEQ ID NO: 129746 - RNA, 1701 nt, Artificial Sequence; identical to SEQ ID NO: 123944
  derived and/or modified sequence opt3 from hemagglutinin__InfluenzaA__AEO99215

SEQ ID NO: 129747 - RNA, 1698 nt, Artificial Sequence
  derived and/or modified sequence opt3 from hemagglutinin__InfluenzaA__AEQ38187
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugccucugcaagcugcucccauaauggggaaaacucauuuuaucggaauuuacuguggcuuaccggaaagaacggcuuguaccccaaucugaguaagagcuaugccaacaacaaagagaaggaagugcuaguacucuggggcguucaccacccuccaaauaucgcugaccagaaaacgcuguaccauacugagaacgcauacgugucugucguguccucacacuauagccgcaaguucacccccgaaauagccaagcgaccuaaagugcgugaucaggaggggagaaucaauuacuauuggacacuucuggagccaggagacacuauuaucuuugaagcuaacgguaauuugauugccccgagguacgcguucgcacucagucggggcuuugggucuggaaucauaaacuccaaugcccccauggauaagugugacgcuaaaugccagaccccucaaggcgccauuaacagcucgcugccauuccagaauguccaucccguuacaaucggugaguguccuaaguaugugcgcucugcaaaauuaagaaugguaaccgggcugaggaacauuccauccauccagucacggggacucuuuggcgcuaucgccggcuucauugaagggggauggacggguaugguggauggcugguacggguaucaccaccagaaugagcaaggaaguggcuacgcggccgaccagaaaagcacucagaacgcaauaaaugguaucacaaacaaagucaauuccgugauugaaaagaugaacacccaguuuacugcuguugggaaggaguucaacaaacuugagcgccgaauggaaaaucugaacaagaaaguggaugacggcuucaucgauauauggacauacaaugccgaguugcuaguccugcucgaaaacgagagaacccuggacuuucaugacucuaaugugaagaaccuuuaugaaaaaguaaagagccaacugaagaauaacgcuaaagagauuggaaauggcugcuucgaguuuuaccacaaguguaacgaugaaugcauggagucaguuaaaaaugggacguaugacuaccccaaguauagugaagaguccaaauugaacagggagaagaucgauggagugaagcucgaaagcaugggugucuaccagauccuggccauuuauucuaccguggcaucaaguuuaguccugcuagugagccucggcgccaucuccuucuggaugugcucuaaugggucgcugcagugucggauuugcauauga

SEQ ID NO: 129748 - RNA, 1698 nt, Artificial Sequence; identical to SEQ ID NO: 129747
  derived and/or modified sequence opt3 from hemagglutinin__InfluenzaA__AEQ38188

SEQ ID NO: 129749 - RNA, 1698 nt, Artificial Sequence
  derived and/or modified sequence opt3 from hemagglutinin__InfluenzaA__AEQ38189
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggaaagaacggcuuguaccccaaucugaguaagagcuaugcaaacaacaaagagaaggaaguucuaguacucuggggcgugcaccacccuccaaauaucgccaaccagaaaacgcuguaccauacugagaaugcuuacgucucugugguguccucacacuauagccgcaaguucacccccgaaauagcaaagcgaccuaaaguccgugaccaggaggggagaaucaacuacuauuggacacuucuggagccaggagauacuauuaucuuugaagccaaugguaacuugauugcuccgagguacgccuucgcgcucagucggggcuuugggucuggaaucauaaauuccaacgcacccauggacaagugugaugccaaaugccagaccccucaaggcgcuauuaauagcucgcugccauuccagaacguucaucccgugacaaucggugaguguccuaaguauguacgcucugccaaauuaagaauggugaccgggcugaggaauauuccauccauccagucacggggacucuuuggcgcaaucgcuggcuucauugaagggggauggacggguauggucgacggcugguacggguaucaccaccagaacgagcaaggaaguggcuacgccgcggaucagaaaagcacucagaaugccauaaacgguaucacaaauaaagugaacuccguuauugaaaagaugaacacccaguuuacugcaguggggaaggaguucaauaaacuugagcgccgaauggaaaaccugaauaagaaagucgacgauggcuucaucgacauauggacauacaacgcugaguugcuagugcugcucgaaaaugagagaacccuggauuuucaugacucuaacguaaagaaucuuuaugaaaaaguuaagagccaacugaagaacaaugccaaagagauuggaaacggcugcuucgaguuuuaccacaaguguaaugacgaaugcauggagucagugaaaaacgggacguaugauuaccccaaguauagugaagaguccaaauugaauagggagaagaucgacggagucaagcucgaaagcauggguguguaccagauccuggcuauuuauucuaccgucgccucaaguuuagugcugcuaguuagccucggcgcaaucuccuucuggaugugcucuaacgggucgcugcagugucggauuugcauauga

SEQ ID NO: 129750 - RNA, 1698 nt, Artificial Sequence
  derived and/or modified sequence opt3 from hemagglutinin__InfluenzaA__AEQ38190
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaaacucauuuuaucggaauuuacuguggcuuaccggcaaaaacggauuguaccccaaucugaguaagccuuaugcaaacaacaaagagaaggaaguucuaguacucuggggcgugcaccacccacccaauaucgccguccagaaaacgcuguaccauacugagaacgcuuacgugagcguggucucuucccacuauucacgcaaguucaccccugaaauagcaaagcgaccaaaaguucgugaccaggaggggagaaucaauuacuauuggacacuucuggagccgggagauacuauuaucuuugaagccaacgguaauuugauugcucccagguacgccuucgcgcucagccggggcuuugggaguggaaucauaaacucuaaugcaccuauggacaagugugaugccaaaugccagaccccacaaggcgcuauuaacuccagccugcccuuccagaaugugcauccuguaacaaucggugaguguccaaaguaugugcgcucggccaaauuaagaauggucaccgggcugaggaacauucccucuauccagucccggggacucuuuggcgcaaucgcuggcuucauugaagggggauggacggguaugguggacggcugguacggguaucaccaccagaaugagcaaggaucaggcuacgccgcggaucagaagaguacucagaacgccauaaaugguaucacaaacaaaguuaauagcgugauugaaaagaugaacacccaguuuacugcagucgggaaggaguucaacaaacuugagcgccgaauggaaaaucugaacaagaaaguggacgauggcuucaucgacauauggacauacaaugcugaguugcuaguacugcucgaaaacgagagaacccuggauuuucaugacuccaauguuaagaaccuuuaugaaaaagugaagucucaacugaagaauaacgccaaagagauuggaaauggcugcuucgaguuuuaccacaaguguaacgacgaaugcauggagagcgucaaaaaugggacguaugauuacccgaaguauucagaagagaguaaauugaacagggagaagaucgacggagugaagcucgaauccaugggugucuaccagauccuggcuauuuauagcaccguggccucuucauuaguucugcuagugagucucggcgcaaucagcuucuggaugugcuccaaugggucucugcagugucggauuugcauauga

SEQ ID NO: 129751 - RNA, 1698 nt, Artificial Sequence; identical to SEQ ID NO: 125642
  derived and/or modified sequence opt3 from hemagglutinin__InfluenzaA__AEQ38191

SEQ ID NO: 129752 - RNA, 1698 nt, Artificial Sequence
  derived and/or modified sequence opt3 from hemagglutinin__InfluenzaA__AEQ38192
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaagugcuaguucucuggggcgugcaccacccuccauccaucucagaccagaaaacgcuguaccauacugagaacgccuacgucagcguggugaguucucacuauucccgcaaguucacccccgaaauaacaaagcgaccuaaaguccgugaucaggaggggagaaucaauuacuauuggacucuucuggagccaggagacaccauuaucuuugaagcuaacgguaauuugauugcaccgagguacgccuucgcucucagccggggcuuugggucgggaaucauaaacucuaauacacccauggauaagugugacaccaaaugccagacgccucaaggcgccauuaacuccucacugccauuccagaauguucaucccgugacuaucggugaguguccuaaguauguacgcagugcgaaauuaagaauggugacagggcugaggaacauuccaagcauccagucccggggacucuuuggcgcaaucgccggcuucauugaagggggauggaccgguauggucgauggcugguacggguaucaccaccagaaugagcaaggaucuggcuacgcugccgaccagaaaagcacucagaacgcaauaaaugguaucacaaacaaaguaaauucaguuauugaaaagaugaacacccaguuuacggcuguggggaaggaguucaauaaacuugagcgccgaauggaaaaccugaacaagaaagucgaugacggcuucaucgauauauggaccuacaaugccgaguugcuagugcugcucgaaaacgagagaacacuggacuuucaugacaguaauguaaagaaccuuuaugaaaaaguuaagucccaacugaagaauaacgcgaaagagauuggaaauggcugcuucgaguuuuaccacaaguguaacgaugaaugcauggagagcgugaaaaaugggacuuaugacuaccccaaguauucugaagagucaaaauugaacagggagaagaucgauggagucaagcucgaaaguauggguguguaccagauccuggccauuuauagcaccgucgcauccucuuuagugcugcuaguuucgcucggcgcuaucagcuucuggaugugcuccaaugggucacugcagugucggauuugcauauga

SEQ ID NO: 129753 - RNA, 1698 nt, Artificial Sequence
  derived and/or modified sequence opt3 from hemagglutinin__InfluenzaA__AEQ38193
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaaaacucucacaaugggaaacuaugccuccugaagggaaucgcgccccuucagcuggguaacuguucagucgccggcuggauuuuggggaauccugagugcgaacuccugaucaguaaagagagcugguccuacauuguggaaaagccaaacccggagaauggaaccuguuaucccggccauuuugcugauuacgaggaacugagagagcaacucucuucgguuagcucauucgaaagguuugagaucuucccuaaggagaguuccuggccaaaccacacugugacaggugucucugccagcugcucccauaauggggaaucaaguuuuuaucggaacuuacuguggcuuaccggcaaaaauggauuguaccccaaccugagcaagucuuaugcaaauaacaaagagaaggaagugcuaguacucuggggcguucaccacccuccaaacauaguggaccagaaaacgcuguaccgcacugagaaugccuacgucuccguggugucaagccauuauagucgaaaguucacccccgaaaucgcuaagcguccuaaagucagagaucaggaggggaggauuaacuacuauuggacacuucuggagccaggagacacuaucauuuuugaagcaaaugguaacuugaucgccccgcgguacgcuuucgcccucucucgcggcuuuggguccggaauaauuaauagcaacgcgcccauggauaagugugacgcaaaaugccagaccccucaaggcgccaucaauucgucucugccauuccagaacguucaccccgugacaauuggugaguguccuaaguauguaagauccgcuaaauuaaggauggugaccgggcugcggaauaucccaucaauccagagucgcggacucuuuggcgccauugcaggcuucauagaagggggauggacggguauggucgauggcugguacggguaucaucaccagaacgagcaaggaagcggcuacgcugccgaccagaaguccacucagaaugcgaucaacgguauuacaaauaaagugaacucuguuaucgaaaagaugaauacccaguuuacugccguggggaaggaguucaacaaacuugagcgaagaauggaaaaccugaauaagaaagucgaugacggcuucauagauauuuggacauacaacgcagaguugcuagugcugcucgaaaaugagaggacccuggacuuucacgacagcaacguaaagaaucuuuaugaaaaaguuaagucacaacugaagaacaaugcuaaagagaucggaaacggcugcuucgaguuuuaccauaaguguaaugaugaaugcauggagagugugaaaaacgggacguaugacuaccccaaguauuccgaagagagcaaauugaaucgggagaagaucgauggagucaagcucgaaucuauggguguguaccagauucuggccaucuauucaaccgucgcuaguagcuuagugcugcuaguuucccucggcgccauuucuuucuggaugugcucgaacgggagccugcagugucguauaugcaucuga

SEQ ID NO: 129754 - RNA, 1698 nt, Artificial Sequence
  derived and/or modified sequence opt3 from hemagglutinin__InfluenzaA__AEQ38194
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccauccaucucagaccagaaaacgcuguaccauacugagaacgccuacgucagcguggugaguucucacuauucccgcaaguucacccccgaaauagcuaagcgaccuaaaguccgugaucaggaggggagaaucaauuacuauuggacacuucuggagccaggagacacuauuaucuuugaagcaagcgguaacuugauugccccgagguacgcuuucgcccucucgcggggcuuugggucuggaaucauaaauuccaacgcgcccauggauaagugugacgcaaaaugccagaccccucaaggcgccauuaauucaagucugccauuccagaacguucaucccgugacaaucggugaguguccuaaguauguacgcagcgcuaaauuaagaauggugaccgggcugaggaauauuccauccauccagucucggggacucuuuggcgccaucgcaggcuucauugaagggggauggacggguauggucgauggcugguacggguaucaccaccgcaacgagcagggaagcggcuacgcugccgaccaaaagucaacucagaaugcgauaaacgguaucacaaauaaagugaacaguguuauugaaaagaugaauacccaguuuacugccguggggaaggaguucaacaaacuugagcgaagaauggaaaaucugaacaagagggucgaugacggcuucaucgauauauggacauacaacgcagaguugcuagugcugcucgaaaaugagcggacccuggacuuucaugacuccaacguuaaaaaucuuuaugaaaagguaaaaagccagcugaagaacaaugcuaaggagauuggaaacggcugcuucgaguuuuaccacaaauguaaugaugaaugcauggagucugugaagaacgggacguaugacuaccccaaauauucagaagagaguaaguugaaucgugagaaaaucgauggagucaagcucgaaagcauggguguguaccaaauccuggccauuuauuccaccgucgcuucuucguuagugcugcuaguuagccucggcgccaucuccuucuggaugugcucaaacgggagucugcagugucgcauuugcauauga

SEQ ID NO: 129755 - RNA, 1698 nt, Artificial Sequence
  derived and/or modified sequence opt3 from hemagglutinin__InfluenzaA__AEQ38195
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugccucugcaagcugcucccauaauggggaaaacucauuuuaucggaauuuacuguggcuuaccggaaagaacggcuuguaccccaaucugaguaagagcuaugccaacaacaaagagaaggaagugcuaguacucuggggcguucaccacccuccaaauaucgcuaaccagaaaacgcuguaccauacugagaaugcauacgugucugucguguccucacacuauagccgcaaguucacccccgaaauagccaagcgaccuaaagugcgugaccaggaggggagaaucaacuacuauuggacacuucuggagccaggagauacuauuaucuuugaagcuaaugguaacuugauugccccgagguacgcguucgcacucagucggggcuuugggucuggaaucauaaauuccaacgcccccauggacaagugugaugcuaaaugccagaccccucaaggcgccauuaauagcucgcugccauuccagaacguccaucccguuacaaucggugaguguccuaaguaugugcgcucugcaaaauuaagaaugguaaccgggcugaggaauauuccauccauccagucacggggacucuuuggcgcuaucgccggcuucauugaagggggauggacggguaugguggacggcugguacggguaucaccaccagaacgagcaaggaaguggcuacgcggccgaucagaaaagcacucagaaugcaauaaacgguaucacaaauaaagucaacuccgugauugaaaagaugaacacccaguuuacugcuauggggaaggaguucaauaaacuugagcgccgaauggaaaaccugaauaagaaaguugacgauggcuucaucgacauauggacauacaacgccgaguugcuagugcugcucgaaaaugagagaacccuggauuuucaugacucuaacgucaagaaucuuuaugaaaaaguaaagagccaacugaagaacaaugcuaaagagauuggaaacggcugcuucgaguuuuaccacaaguguaaugacgaaugcauggagucagugaaaaacgggacguaugauuaccccaaguauagugaagaguccaaauugaauagggagaagaucgacggaguuaagcucgaaagcauggguguguaccagauccuggccauuuauucuaccgucgcaucaaguuuagugcugcuagucagccucggcgccaucuccuucuggaugugcucuaacgggucgcugcagugucggauuugcauauga

SEQ ID NO: 129756 - RNA, 1698 nt, Artificial Sequence
  derived and/or modified sequence opt3 from hemagglutinin__InfluenzaA__AEQ38196
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugccucugcaagcugcucccauaauggggaaaacucauuuuaucggaauuuacuguggcuuaccggaaagaacggcuuguaccccaaucugaguaagagcuaugccaacaacaaagagaaggaagugcuaguacucuggggcguucaccacccuccaaauaucgcugaccagaaaacgcuguaccauacugagaacgcauacgugucugucguguccucacacuauagccgcaaguucacccccgaaauagccaagcgaccuaaagugcgugaucaggaggggagaaucaauuacuauuggacacuucuggagccaggagacacuauuaucuuugaagcuaacgguaauuugauugccccgagguacgcguucgcacucagucggggcuuugggucuggaaucauaaacuccaaugcccccauggauaagugugacgcuaaaugccagaccccucaaggcgccauuaacagcucgcugccauuccagaauguccaucccguuacaaucggugaguguccuaaguaugugcgcucugcaaaauuaagaaugguaaccgggcugaggaacauuccauccauccagucacggggacucuuuggcgcuaucgccggcuucauugaagggggauggacggguaugguggauggcugguacggguaucaccaccagaaugagcaaggaaguggcuacgcggccgaccagaaaagcacucagaacgcaauaaaugguaucacaaacaaagucaauuccgugauugaaaagaugaacacccaguuuacugcuguugggaaggaguucaacaaacuugagcgccgaauggaaaaucugaacaagaaaguggaugacggcuucaucgauauauggacauacaaugccgaguugcuaguccugcucgaaaacgagagaacccuggacuuucaugacucuaaugugaagaaccuuuaugaaaaaguaaagagccaacugaagaauaacgcuaaagagauuggaaauggcugcuucgaguuuuaccacaaguguaacgaugaaugcauggagucaguuaaaaaugggacguaugaauaccccaaguauagugaggaguccaaauugaacagggaaaagaucgacggagugaagcucgagagcaugggugucuaccagauccuggccauuuauucuaccguggcaucaaguuuaguccugcuagugagccucggcgccaucuccuucuggaugugcucuaaugggucgcugcagugucggauuugcauauga

SEQ ID NO: 129757 - RNA, 1698 nt, Artificial Sequence; identical to SEQ ID NO: 129747
  derived and/or modified sequence opt3 from hemagglutinin__InfluenzaA__AEQ38197

SEQ ID NO: 129758 - RNA, 1698 nt, Artificial Sequence; identical to SEQ ID NO: 129747
  derived and/or modified sequence opt3 from hemagglutinin__InfluenzaA__AEQ38198

SEQ ID NO: 129759 - RNA, 1701 nt, Artificial Sequence; identical to SEQ ID NO: 129066
  derived and/or modified sequence opt3 from hemagglutinin__InfluenzaA__AEQ62909

SEQ ID NO: 129760 - RNA, 1701 nt, Artificial Sequence
  derived and/or modified sequence opt3 from hemagglutinin__InfluenzaA__AEQ62910
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccgccucuccagacaacggaacuugcuauccgggcgauuuuaucgacuacgaagaguugagggagcagcucucgucagugagcaguuucgaacgguuugagauuuuccccaagacauccucuuggccuaaucacgauagcaacaagggugucaccgcugcauguccacaugccggggcuaaauccuuuuauaagaaucugauguggcuggugaaaaagggaaacucauaccccaaacucaguaagagcuauaucaaugacaagggcaaagaaguauuaguucuguggggcauacaccacccuccaacgucugccgaucaacagucccuuuaccagaacgcggacgcauacguguucgucgggacuucacgcuauagcaagaaauuuaagcccgagaucgccauucgaccuaaagugcguggacaggaggguagaaugaauuacuauuggaccuugguggaaccaggcgauaagaucacauucgaggcuacugggaaccuggucguuccgagguacgccuuugcaauggaacggaacgcuggaaguggcauuaucauaucugacacccccgugcaugauugcaauacaaccugucaauccccuaaaggugccauuaacacgagccuaccauuccagaauauccaccccauuacuaucggggagugcccuaaguauguaaagucgacaaaacuccgccuggcgaccggacuuagaaacgugccaucuguccaguccaggggccuguuuggcgccaucgcaggguucauugaaggagguuggacuggcaugguggacgggugguacggauaucaucaccagaaugagcaaggcucagguuacgcugccgacuugaagaguacacagaacgcuauagaugagaucaccaauaaaguuaacagcgugauugaaaagaugaauacgcaguuuaccgccgucgggaaagaguucaaccagcucgaaaagcggaucgagaaucugaacaagaaaguggacgauggcuucuuagacauauggacauacaaugcagaacugcucguacuucuggagaacgagcgcacuuuggauuaucacgacuccaauguuaagaaccuauacgaaaaagugcgaucucaacugaagaacaaugccaaagagauuggaaacggcuguuuugaguucuaucauaagugcgauaauaccuguauggaaagcgucaagaacgggacauacgacuaucccaaauacucagaagaggcuaagcucaauagagaggaaaucgauggagugaaacuggagaguacuaggaucuaucagauucuugcgaucuacuccaccgucgcaagcucucugguguugguugugucacucggugccauuaguuuuuggaugugcagcaacggcucccugcagugccggauauguaucuga

SEQ ID NO: 129761 - RNA, 1701 nt, Artificial Sequence; identical to SEQ ID NO: 128883
  derived and/or modified sequence opt3 from hemagglutinin__InfluenzaA__AEQ62911

SEQ ID NO: 129762 - RNA, 1701 nt, Artificial Sequence; identical to SEQ ID NO: 129066
  derived and/or modified sequence opt3 from hemagglutinin__InfluenzaA__AEQ62912

SEQ ID NO: 129763 - RNA, 1701 nt, Artificial Sequence
  derived and/or modified sequence opt3 from hemagglutinin__InfluenzaA__AEQ62915
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagacuaacgcaaaggagaucggcaauggauguuuugaguucuaucacaaaugcgauaacaccuguauggaaagcgugaagaauggcacauacgacuauccuaaauacucagaagaggccaagcugaacagagaagagauugauggggucaaacuugagaguaccaggaucuaucaaauucuggcuauauacuccacuguggcgagcucuuugguccucgugguuucacugggagcaaucaguuuuuggaugugcagcaaugguuccuuacagugccggauuuguaucuga

SEQ ID NO: 129764 - RNA, 1701 nt, Artificial Sequence; identical to SEQ ID NO: 125427
  derived and/or modified sequence opt3 from hemagglutinin__InfluenzaA__AER08646

SEQ ID NO: 129765 - RNA, 1701 nt, Artificial Sequence; identical to SEQ ID NO: 127435
  derived and/or modified sequence opt3 from hemagglutinin__InfluenzaA__AER08648

SEQ ID NO: 129766 - RNA, 1701 nt, Artificial Sequence
  derived and/or modified sequence opt3 from hemagglutinin__InfluenzaA__AER08652
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuuuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccugcuaauuaauucuacggguaaccucauagcgccgaggggcuacuucaagauccgguccggaaagagcucgauuaugcgcucugacgcacccaucgggaaauguaauuccgagugcauaacuccuaacggcucaauuccaagugacaagcccuuucagaaugugaaccgaaucacauauggugccuguccuagauacgucaaacaaaauacccugaaacuugcuacugggaugaggaacgugccagaaaagcagacacggggaaucuucggcgccauugcaggcuuuaucgagaaugggugggaaggaaugguggaugguugguauggcuuccgucaccagaacagcgaggggcgcggacaagcugccgaccugaaguccacccaggcggccauugaucagauaaauggcaaauugaacagacucaucgguaagacgaaugagaaguuccaccagauugaaaaagaguuuucugaagucgaggggaggauccaagaccuggaaaaguacguugaggauaccaaaaucgacuuauggagcuauaacgcagagcugcucguggcucuugaaaaccagcauacaauugaucugacugacucagagaugaauaaguuguucgaaaagaccaagaagcagcuacgggagaacgccgaagauaugggcaauggaugcuuuaaaauauaccacaagugugacaacgcuugcaucggcaguauucgaaaugggacauaugaucaugacguauaccgcgacgaggcccugaacaauagauuccagaucaaaggaguggagcucaaguccgguuacaaagauuggauucuguggaucagcuuugcaauaucuugcuuccuucugugugucgccuugcucggcuuuaucaugugggcuugccaaaaggggaacauuagguguaauaucugcauuuga

SEQ ID NO: 129767 - RNA, 1701 nt, Artificial Sequence; identical to SEQ ID NO: 129766
  derived and/or modified sequence opt3 from hemagglutinin__InfluenzaA__AER08654

SEQ ID NO: 129768 - RNA, 1701 nt, Artificial Sequence
  derived and/or modified sequence opt3 from hemagglutinin__InfluenzaA__AER08656
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccuggcacagauaaagaccagaucuuuuuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagaugcaguccggaaagagcucgaucaugcggucugacgcgcccauugggaaauguaauuccgagugcaucacuccuaacggcucaauaccaaaugacaagcccuuucaaaacgucaaucgcauuacauauggugcauguccucgauacgugaaacagaacacccugaaacuugccacugggaugagaaaugugccagaaaaacagacaaggggaaucuucggcgcuaucgccggcuuuauugagaacgggugggaaggaauggucgaugguugguauggcuuccggcaccaaaauagugaggggcguggacaggcagcugaccuuaagagcacccaggccgcgaucgaucagauuaacggcaaauugaaucgccucauagguaagacgaacgagaaguuccaccaaaucgaaaaagaguuuuccgaaguugaggggaggauucaggaccuggaaaaguacguggaggauaccaaaaucgacuuauggucuuauaacgccgagcugcucguagcacuugaaaaucagcauacaaucgaucugacugacagcgagaugaacaaguuguucgaaaagaccaagaagcagcuaagagagaaugcugaagauaugggcaacggaugcuuuaaaauuuaccacaagugugacaaugccugcauaggcucaauccggaacgggacauaugaucaugacguguaccgagacgaggcucugaauaaccgcuuccaaauuaaaggagucgagcucaagagugguuacaaagauuggauccuguggauuuccuuugccaucagcugcuuccuucuguguguggcauugcucggcuuuauaaugugggccugccagaaggggaauaucagauguaacauuugcaucuga

SEQ ID NO: 129769 - RNA, 1701 nt, Artificial Sequence
  derived and/or modified sequence opt3 from hemagglutinin__InfluenzaA__AER08660
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaacuuuaaguauccagcacugaacgugaccaugcccaauaacgagcaguucgauaagcuguacauuuggggaguccaccauccuggcacagacaaagaucagaucuuuuuguaugcccaagcuagcggccguauuacugugucuaccaagagaucccagcaggccguaaucccaaauauagggucaaggccccggguucgcaacauuccuagcagaaucaguauuuacuggacaaucgugaaaccaggagacauccugcuaauuaauucuaccgguaaccucauagcgccgaggggcuacuucaagauccgguccgggaaaagcucgauuaugcgcucugaugcacccaucggaaaguguaauuccgccugcauaacgccuaacggcucaauuccaaaugacaagcccuuucagaacgucaaucgaaucacuuauggugcuuguccuagauacgugaaacaaaacacacugaaacuugccaccgggaugaggaaugugccagaaaaacagacucggggaaucuucggcgcaauugcuggcuuuaucgagaacgggugggaaggaauggucgacgguugguauggcuuccgucaccagaauagugaggggcgcggacaagccgcggaucuuaagagcacacaggccgcaauugaccagauaaacggcaaauugaacagacucaucgguaagaccaaugagaaauuccaccagauugaaaaggaguuuuccgaaguugaggggaggauccaagaucuggaaaaguacguggaggacacgaaaaucgauuuauggucuuauaacgcugagcugcucguagcccuugaaaaucagcauaccauugaccugacagauagcgagaugaacaaguuguucgaaaagacuaagaaacagcuacgggagaaugcugaagacaugggcaacggaugcuuuaagauauaccacaagugugauaaugccugcaucggcucaauucgaaacgggaccuaugaccaugauguguaccgcgacgaggcacugaauaacagauuccagaucaaaggagucgagcucaagagugguuacaaagacuggauucuguggaucuccuuugccauaagcugcuuccuucuguguguggcuuugcucggcuuuaucaugugggcgugccaaaaggggaauauuagguguaacaucugcauuuga

SEQ ID NO: 129770 - RNA, 1701 nt, Artificial Sequence
  derived and/or modified sequence opt3 from hemagglutinin__InfluenzaA__AER08664
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacuccgagucuuucaauuggacagguguuacccagaacgggacgagcuccgcuugcauccggcgcucaaauaacagcuuuuucagucgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaggcuucuggccguauuacuguguccaccaagagaucacaacaggccguaaucccaaauauagggagcaggccccggguucgcaacauuccuaguagaaucucuauuuacuggacaaucgugaaaccaggagauauccugcuaauuaauuccaccgguaaccucauagcgccgaggggcuacuucaagauccggagcgggaaaucgucuauuaugcgcuccgacgcacccaucggaaaguguaauucagaaugcauaacgccuaacggcaguauuccaaaugacaagcccuuucagaacgucaaucgaaucacuuauggugccuguccuagauacgugaaacaaagcacacugaaacuugcuaccgggaugaggaacgugccagagaagcagacucggggaaucuucggcgccauugcaggcuuuaucgaaaaugggugggagggaauggucgaugguugguauggcuuccgucaccagaacuccgaggggcgcggacaagcugccgaccugaagucuacacaggcggccauugaucagauaaauggcaaauugaacagacucaucgguaagaccaaugaaaaauuccaccagauugagaaggaauuuagcgagguugaagggaggauccaagaccuggagaaguacguggaggauacgaaaaucgacuuauggucauauaacgcagaacugcucguagcucuugagaaccagcauaccauugaucugacagacagugaaaugaauaaguuguucgagaaaacuaagaaacagcuacgggaaaacgccgaggauaugggcaauggaugcuuuaagauauaccacaagugugacaacgcuugcaucggcuccauucgaaaugggaccuaugaucaugacguguaccgcgacgaggcccugaacaauagauuccagaucaaaggagucgaacucaagagcgguuacaaagauuggauucuguggaucucuuuugcaauaucaugcuuccuucuguguguggccuugcucggcuuuaucaugugggcuugccaaaaggggaacauuagguguaauaucugcauuuga

SEQ ID NO: 129771 - RNA, 1701 nt, Artificial Sequence; identical to SEQ ID NO: 128998
  derived and/or modified sequence opt3 from hemagglutinin__InfluenzaA__AER08668

SEQ ID NO: 129772 - RNA, 1701 nt, Artificial Sequence
  derived and/or modified sequence opt3 from hemagglutinin__InfluenzaA__AER08670
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugaagucugaugcacccauuggaaaguguaauuccgccugcaucacgccuaacggcucaauaccaaaugacaaacccuuucagaacgugaaucgcauuacuuacggugcuuguccucgauaugugaagcaaaacacacugaaacuugccaccgggaugagaaaugucccagaaaagcagacuaggggaaucuucggcgcaaucgcuggcuuuauugagaacgggugggaaggaaugguugacgguugguacggcuuccggcaccagaauagugaggggcguggacaagccgcggaucugaaaagcacacaggccgcaaucgaccagauuaacggcaaguugaaccgccucauagguaaaaccaaugagaaguuccaucagaucgaaaaggaguuuuccgaaguggaggggaggauucaagaucuggaaaaauauguagaggacacgaagaucgauuuauggucuuacaacgcugagcugcucguggcccuugaaaaucagcacaccaucgaccugacagauagcgagaugaacaaauuguucgaaaagacuaaaaagcagcuaagagagaaugcugaagacaugggcaacggaugcuuuaagauuuaucauaaaugugauaaugccugcauaggcucaauccggaacgggaccuacgaccacgaugucuaucgagacgaggcacugaauaaccgcuuccagauuaagggaguggagcucaaaagugguuacaaggacuggauccuguggauuuccuuugccaucagcugcuuccuucuguguguugcuuugcucggcuuuauaaugugggcgugccaaaaagggaauaucagauguaacauuugcaucuga

SEQ ID NO: 129773 - RNA, 1701 nt, Artificial Sequence
  derived and/or modified sequence opt3 from hemagglutinin__InfluenzaA__AER08672
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagaugggggaaauuguacccucauagacgcucugcuuggcgauccgcagugcgacgguuuucaaaacaaaaagugggaucuguucguggagagauccaaagccuauucuaauuguuaccccuaugacgucccugauuacgcaucguugaggucacucguggccagcagugggacucuggaauuuaacuccgagucuuucaauuggacaggaguuacccagaacggcacgagcuccgcuugcauccggcgcucaaauaacagcuuuuucagucgacugaauuggcucacucauuuaaacuuuaaguauccagcacugaaugugaccaugcccaacaacgaacaguucgacaaacuuuacauuuggggcguccaccauccugggacagauaaggaccagaucuuuuuguaugcccaggcuucuggacguauuacuguguccaccaagagaucacaacaggccguaaucccaaauauagguagcaggccccggguucgcaacauuccuaguagaaucucuauuuacuggacaaucgugaaaccaggcgauauccugcuaauuaauuccaccgggaaccucauagcgccgaggggauacuucaagauccggagcggcaaaucgucuauuaugcgcuccgacgcacccaucgguaaguguaauucagagugcauaacgccuaacgggaguauuccaaaugacaagcccuuucagaacgucaaucgaaucacuuauggagccuguccuagauacgugaaacaaagcacacugaaacuugcuaccggcaugaggaacgugccagagaagcagacucggggcaucuucggggccauugcaggauuuaucgaaaaugguugggagggcauggucgaugggugguauggauuccgucaccagaacuccgaaggccgcggucaagcugccgaccugaagucuacacaggcggccauugaucagauaaaugggaaauugaacagacucaucggcaagaccaaugagaaauuccaccagauugagaaggaauuuagcgagguugaaggaaggauccaagaccuggagaaguacguggaagauacgaaaaucgacuuauggucauauaacgcagagcugcucguagcucuugagaaccagcauaccauugaucugacagacagugaaaugaauaaguuguucgagaaaacuaagaaacagcuacgggaaaacgccgaggauaugggcaaugggugcuuuaagauauaccacaagugugacaacgcuugcaucggauccauucgaaaugguaccuaugaucaugacguguaccgcgacgaagcccugaacaauagauuccagaucaaaggcgucgagcucaagagcggguacaaagauuggauucuguggaucucuuuugcaauaucaugcuuccuucuguguguggccuugcucggauuuaucaugugggcuugccaaaagggcaacauuagguguaauaucugcauuuga

SEQ ID NO: 129774 - RNA, 1701 nt, Artificial Sequence
  derived and/or modified sequence opt3 from hemagglutinin__InfluenzaA__AER08674
augaagaccaucauugcccugagcuacauacucugccuuguguucgcucagaaacugcccggcaacgacaauuccacagcaacuuuguguuuagggcaccaugccgucccuaacggaacgaugguuaagaccaucacaaaugaucaaauugaggugacuaacgcgaccgaacugguacagucuucaaguacaggugagaucugcaauagcccacaccagauucuagacggcgaaaacuguacccucaucgaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauacggcgcuccaauaacucauuuuucagucgacugaauuggcucacucacuuaaacuuuaaguacccagcacugaacgugaccaugcccaauaacgagcaguucgauaagcuguauaucuggggaguccaucacccuggcacagacaaagaucagaucuuuuuguacgcccaagcuagcggccguauuacugugucuaccaagagaucccagcaggccguaauuccaaauaucgggucaaggccccggguucgcaacauaccuagcagagugaguauuuauuggacaaucgucaaaccaggagacauucugcuaaucaauucuaccgguaaccucaucgcgccgaggggcuacuucaagauucgguccgggaaaagcucgauaaugcgcucugaugcacccaucggaaaguguaauuccgccugcauuacgccuaacggcucaaucccaaaugacaagcccuuucagaacgugaaucgaauaacuuacggugcuuguccuagauaugugaaacaaaacacacugaaacuugccaccgggaugaggaaugucccagaaaaacagacucggggaauuuucggcgcaaucgcuggcuuuaucgagaacgggugggaaggaaugguugacgguugguacggcuuccgucaccagaauagugaggggcgcggacaagccgcggaucuuaagagcacacaggccgcaauugaccagaucaacggcaaauugaacagacucauugguaagaccaaugagaaauuccaucagauagaaaaggaguuuuccgaaguggaggggaggauccaagaucuggaaaaguauguagaggacacgaaaauugauuuauggucuuacaacgcugagcugcucguggcccuugaaaaucagcacaccaucgaccugacagauagcgagaugaacaaguuguucgaaaagacuaagaaacagcuacgggagaaugcugaagacaugggcaacggaugcuuuaagaucuaucauaagugugauaaugccugcauuggcucaauacgaaacgggaccuacgaccacgaugucuaucgcgacgaggcacugaauaacagauuccagaucaaaggaguggagcucaagagugguuacaaagacuggauucuguggaucuccuuugccauuagcugcuuccuucuguguguugcuuugcucggcuuuaucaugugggcgugccaaaaggggaauauaagguguaacaucugcauuuga

SEQ ID NO: 129775 - RNA, 1701 nt, Artificial Sequence; identical to SEQ ID NO: 128998
  derived and/or modified sequence opt3 from hemagglutinin__InfluenzaA__AER08676

SEQ ID NO: 129776 - RNA, 1701 nt, Artificial Sequence; identical to SEQ ID NO: 128998
  derived and/or modified sequence opt3 from hemagglutinin__InfluenzaA__AER08678

SEQ ID NO: 129777 - RNA, 1701 nt, Artificial Sequence
  derived and/or modified sequence opt3 from hemagglutinin__InfluenzaA__AER08680
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccagauccuagauggcgaaaauuguacacucauagacgcccugcuuggggauccgcagugcgacggauuucaaaacaaaaagugggaucuguucguggagagauccagggcacauucuaauuguuaucccuacgacgucccugauuaugccucguugcggucacucguggcuagcaguggcacccuggaauuuaacaaugaguccuucaacuggacugguguuacacagaaugggaccucuagcgcaugcauccgccgauccaacaauucauuuuucagucgucugaacuggcucacgcacuuaaauuuuaaauacccagcccugaacgugacuaugcccaacaaugagcaguucgacaaacuuuauauuuggggaguccaucacccuggcaccgauaaggaccagaucuuuuuguacgcucaagccagcggcagaauuacagugucuacuaaaaggucccagcaggcgguaaucccaaacauagggucacggccccgcguuagaaauauuccuagcaggaucaguauuuauuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguacggugcuuguccuagguaugugaagcaaaguacucugaaacuugccacagggaugcggaaugugccagagaagcagacccguggaaucuucggcgcaauugcuggcuuuaucgaaaacgggugggagggaaugauggaugguugguacggcuuccgccaccagaauagcgaggggagaggacaagccgcggaccugaaauccacucaggccgcaauugaucagauaaacggcaaguugaauaggcucaucgguaaaacaaacgaaaaguuccaucagauugagaaagaauuuucugaggucgaagggcggauccaagaccuggagaaguauguugaggauaccaagaucgacuuauggagcuacaacgcugaacugcucguggcccuugagaaucagcacacgauugaucugaccgacucagaaaugaacaaauuguucgagaagacaaagaagcagcuacgagaaaaugcugaggauaugggcaacggaugcuuuaaaauauaucauaagugugacaaugccugcaucggcaguauucgcaacgggacuuacgaucacgacguauauagagacgaggcacugaauaacagguuccagaucaagggaguggaacucaaauccgguuacaaggauuggauucuguggaucagcuuugccauaucuugcuuccuucugugugucgcuuugcucggcuuuaucaugugggcgugccaaaaagggaauauucgguguaacaucugcauuuga

SEQ ID NO: 129778 - RNA, 1701 nt, Artificial Sequence
  derived and/or modified sequence opt3 from hemagglutinin__InfluenzaA__AER08682
augaagaccgugaucgcccugagcuacauucucugccuugucuucgcucagaaacugcccggcaacgacaauuccacagcaacuuuguguuuagggcaccaugccguuccuaacggaacgauagugaagaccaucacaaaugaucaaauugagguaacuaacgcgaccgaacuggugcagucuucaaguacaggugagaucugcaauagcccacaccagauucuagacggcgaaaacuguacccucaucgaugcucugcuuggggacccgcagugcgauggauuucaaaauaaaaagugggaccuguucgucgagagauccaaagcccauucuaacuguuaucccuacgaugugccugacuaugcaucguugaggucacucguugccagcaguggcacucuggaauuuaauaacgaguccuucaauuggacaggugugacccagaacgggacgucuagcgcuugcauacggcgcuccaauaacucauuuuucagucgacugaauuggcucacucacuuaaacuuuaaguacccagcacugaacgucaccaugcccaauaacgagcaguucgauaagcuguauaucuggggagugcaucacccuggcacagacaaagaucagaucuuuuuguacgcccaagcuagcggccguauuacuguaucuaccaagagaucccagcaggccguuauuccaaauaucgggucaaggccccgggugcgcaacauaccuagcagagucaguauuuauuggacaaucgugaaaccaggagacauucugcuaaucaauucuaccgguaaccucaucgcgccgaggggcuacuucaagauucgguccgggaaaagcucgauaaugcgcucugaugcacccaucggaaaguguaauuccgccugcauuacgccuaacggcucaaucccaaaugacaagcccuuucagaacgugaaucgaauaacuuacggugcuuguccuagauaugucaaacaaaacacacugaaacuugccaccgggaugaggaauguuccagaaaaacagacucggggaauuuucggcgcaaucgcuggcuuuaucgagaacgggugggaaggaaugguggacgguugguacggcuuccgucaccagaauagugaggggcgcggacaagccgcggaucuuaagagcacacaggccgcaauugaccagaucaacggcaaauugaacagacucauugguaagaccaaugagaaauuccaucagauagaaaaggaguuuuccgaaguagaggggaggauccaagaucuggaaaaguauguggaggacacgaaaauugauuuauggucuuacaacgcugagcugcucgucgcccuugaaaaucagcacaccaucgaccugacagauagcgagaugaacaaguuguucgaaaagacuaagaaacagcuacgggagaaugcugaagacaugggcaacggaugcuuuaagaucuaucauaagugugauaaugccugcauuggcucaauacgaaacgggaccuacgaccacgauguguaucgcgacgaggcacugaauaacagauuccagaucaaaggaguugagcucaagagugguuacaaagacuggauucuguggaucuccuuugccauuagcugcuuccuucuguguguggcuuugcucggcuuuaucaugugggcgugccaaaaggggaauauaagguguaacaucugcauuuga

SEQ ID NO: 129779 - RNA, 1701 nt, Artificial Sequence
  derived and/or modified sequence opt3 from hemagglutinin__InfluenzaA__AER08684
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccacgugcaucacuccuaacggcucaauaccaaaugacaagcccuuucagaacgugaaucgaauuacauacggugccuguccuagauaugugaaacaaaacacccugaaacuugcuacugggaugaggaaugucccagaaaaacagacacggggaaucuucggcgccaucgcaggcuuuauugagaacgggugggaaggaaugguugacgguugguacggcuuccgucaccagaauagugaggggcgcggacaagcugccgaucuuaagagcacccaggcggccaucgaccagauuaacggcaaauugaacagacucauagguaagacgaaugagaaauuccaucagaucgaaaaggaguuuuccgaaguggaggggaggauucaagaucuggaaaaguauguagaggacaccaaaaucgauuuauggucuuacaacgcagagcugcucguggcucuugaaaaucagcacacaaucgaccugacugauagcgagaugaacaaguuguucgaaaagaccaagaaacagcuacgggagaaugccgaagacaugggcaacggaugcuuuaagauuuaucauaagugugauaaugcuugcauaggcucaauccgaaacgggacauacgaccacgaugucuaucgcgacgaggcccugaauaacagauuccagauuaaaggaguggagcucaagagugguuacaaagacuggauccuguggauuuccuuugcaaucagcugcuuccuucuguguguugccuugcucggcuuuauaaugugggcuugccaaaaggggaauaucagguguaacauuugcaucuga

SEQ ID NO: 129780 - RNA, 1701 nt, Artificial Sequence
  derived and/or modified sequence opt3 from hemagglutinin__InfluenzaA__AER08686
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccacgugcaucacuccuaacggcucaauaccaaaugacaagcccuuucagaacgugaaucgaauuacauacggugccuguccuagauaugugaaacaaaacacccugaaacuugcuacugggaugaggaaugucccagaaaaacagacacggggaaucuucggcgccaucgcaggcuuuauugagaacgggugggaaggaaugguugacgguugguacggcuuccgucaccagaauagugaggggcgcggacaagcugccgaucuuaagagcacccaggcggccaucgaccagauuaacggcaaauugaacagacucauagguaagacgaaugagaaauuccaucagaucgaaaaggaguuuuccgaaguggaggggaggauucaagaucuggaaaaguauaucgaggacaccaaaaucgauuuauggucuuacaacgcagagcugcucguagcucuugaaaaucagcacacaauugaccugacugauagcgagaugaacaaguuguucgaaaagaccaagaaacagcuacgggagaaugccgaagacaugggcaacggaugcuuuaagauauaucauaagugugauaaugcuugcaucggcucaauucgaaacgggacauacgaccacgauguguaucgcgacgaggcccugaauaacagauuccagaucaaaggagucgagcucaagagugguuacaaagacuggauucuguggaucuccuuugcaauaagcugcuuccuucuguguguggccuugcucggcuuuaucaugugggcuugccaaaaggggaauauuagguguaacaucugcauuuga

SEQ ID NO: 129781 - RNA, 1701 nt, Artificial Sequence; identical to SEQ ID NO: 128998
  derived and/or modified sequence opt3 from hemagglutinin__InfluenzaA__AER08688

SEQ ID NO: 129782 - RNA, 1701 nt, Artificial Sequence
  derived and/or modified sequence opt3 from hemagglutinin__InfluenzaA__AER08690
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcaauagcccacaccagauccuagacggugagaacuguacccucauagaugcucugcuuggcgacccgcagugcgauggguuucaaaauaaaaagugggaccuguucguggaaagauccaaagcccauucuaacuguuaucccuacgaugucccugacuaugcaucguugaggucacucguggccagcaguggaacucuggaguuuaauaacgaguccuucaauuggacaggcguuacccagaacgguacgucuagcgcuugcauccggcgcuccaauaacucauuuuucagucgacugaauuggcucacucacuuaaacuuuaaguacccagcacugaacgugaccaugcccaauaacgaacaguucgauaagcuguauauuuggggaguccaucacccugggacagacaaagaucagaucuuuuuguacgcccaagcuagcggccguauuacugugucuaccaagagaucccagcaggccguaaucccaaauauaggcucaaggccccggguucgcaacauuccuagcagagugaguaucuauuggacaauugucaaaccaggggacauccugcuaaucaauucuaccggaaaccucauugcgccgagggguuacuucaagauacgguccggcaaaagcucgaucaugcgcucugaugcacccauugggaaguguaauuccacgugcaucacuccuaacggaucaauaccaaaugacaagcccuuucagaacgugaaucgaauuacauacggcgccuguccuagauaugugaaacaaaacacccugaaacuugcuacugguaugaggaaugucccagagaagcagacacgggggaucuucggagccaucgcaggcuuuauugaaaacggcugggaggggaugguugacggaugguacgguuuccgucaccagaauagugagggccgcgggcaagcugccgaucuuaagagcacccaggcggccaucgaccagauuaacggaaaauugaacagacucauaggcaagacgaaugaaaaauuccaucagaucgagaaggaauuuuccgagguggaagguaggauucaagaucuggagaaguauguagaggacaccaaaaucgauuuauggucuuacaacgcagaacugcucguggcucuugagaaucagcacacaaucgaccugacugauagcgaaaugaacaaguuguucgagaaaaccaagaaacagcuacgggaaaaugccgaggacauggggaacggcugcuuuaagauuuaucauaagugugauaaugcuugcauaggaucaauccgaaacggcacauacgaccacgaugucuaucgcgacgaggcccugaauaacagauuccagauuaaagggguggaacucaagaguggauacaaagacuggauccuguggauuuccuuugcaaucagcugcuuccuucuguguguuguguugcucgguuuuauaaugugggccugccaaaagggcaauaucagguguaacauuugcaucuga

SEQ ID NO: 129783 - RNA, 1701 nt, Artificial Sequence; identical to SEQ ID NO: 128998
  derived and/or modified sequence opt3 from hemagglutinin__InfluenzaA__AER08692

SEQ ID NO: 129784 - RNA, 1701 nt, Artificial Sequence
  derived and/or modified sequence opt3 from hemagglutinin__InfluenzaA__AER08698
augaagaccacaaucgcccugagccacauucucugccuuguguucgcucagaaacugcccggcaacgacaauuccacugcaacguuguguuuagggcaucacgccgucccuaacggaaccauaguuaagacaaucacuaaugaucaaauugaggugaccaacgcgacagaacugguacagucuucaagugcuggugagaucugcgacagcccacaucagauucuagauggcgaaaauuguacccucaucgacgcccugcuuggggauccgcagugcgacggauuucaaaacaaaaagugggaucuguucguggagagauccagggcauacucuaauuguuaucccuacgacgucccugauuaugccucguugcggucacucguggcuagcaguggcacucuggaauuuaacaaugaguccuucaacuggacagguguuacccagaaugggacgucuagcgcaugcauacgccgauccaacaauucauuuuucagucgucugaacuggcucacucacuuaaauuuuaaauacccagcccugaacgugaccaugcccaacaaugagcaguucgacaaguuguauaucuggggaguccaucacccuggcacagauaaggaccagauuuuucuuuacgcucaagccagcggcagaaucacugugucuaccaaaaggucccagcaggcgguaauuccaaacaucgggucacggccccgcguuagaaauauaccuagcaggauuaguaucuauuggacaauugugaagccaggagauauccugcuaaucaacucuaccgguaaucucauugcaccgcggggcuacuucaaaauacgcuccggaaagagcucgaucaugcgaucugacgcccccauugggaaauguaacuccgaaugcaucacgccuaauggcucaauaccaaacgacaagcccuuucagaaugucaacagaauuacuuacggugcuuguccuagguaugugaagcaaaguacacugaaacuugccaccgggaugcggaaugugccagagaagcagacucguggaaucuucggcgcaaucgcuggcuuuauugaaaacgggugggagggaauggucgaugguugguacggcuuccgccaccagaauagcgaggggagaggacaagccgcggaccugaaauccacacaggccgcaaucgaucagauuaacggcaaguugaauaggcucauagguaaaaccaacgaaaaguuccaucagaucgagaaagaauuuucugagguugaagggcggauucaagaccuggagaaguauguggaggauacgaagaucgacuuauggagcuacaacgcugaacugcucguagcccuugagaaucagcacaccaucgaucugacagacucagaaaugaacaaauuguucgagaagacuaaaaagcagcuacgagaaaaugcugaggauaugggcaacggaugcuuuaaaauuuaucauaagugugacaaugccugcauaggcaguauccgcaacgggaccuacgaucacgacguguauagagacgaggcacugaauaacagguuccagauuaagggagucgaacucaaauccgguuacaaggauuggauccuguggauuagcuuugccaucucuugcuuccuucuguguguggcuuugcucggcuuuauaaugugggcgugccaaaaagggaauauccgguguaacauuugcaucuga

SEQ ID NO: 129785 - RNA, 1701 nt, Artificial Sequence; identical to SEQ ID NO: 128998
  derived and/or modified sequence opt3 from hemagglutinin__InfluenzaA__AER08700

SEQ ID NO: 129786 - RNA, 1701 nt, Artificial Sequence
  derived and/or modified sequence opt3 from hemagglutinin__InfluenzaA__AER92712
augaaggccauccuggugguccuccuuuacaccuucgcuacagcaaacgccgacacucugugcauuggcuaucacgcgaauaacagcacggauaccguugacacaguguuggagaagaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuaauucggauaacggaacuugcuauccaggcgacuuuaucgauuacgaggagcucagggagcagcugucaagcgugaguuccuucgaacgguuugagauuuucccgaagacaucuagcuggcccaaucacgacuccaacaagggugucaccgccgcuuguccucaugcaggggccaaaucauuuuauaagaaucugaucuggcucgugaaaaagggaaacaguuacccaaaauuaaauaagagcuauauaaacgauaagggcaaagaaguacugguucuuuggggcauccaccaccccucuacguccacugaccaacagucauuguaccagaaugcugaugccuacguguucgucgggaccagccgcuauaguaagaaauuuaagccugagauugcgauccgaccaaaagugcguaaccaggagggaagaaugaacuacuauuggacacugguggaacccggugacaagauuacuuucgaggcaaccggcaaucuagucguuccuagguacgccuuuacaaucgaacggaacgcugggucuggaauaauuaucuccgauaccccaauucaugacugcaauacgacuugucaaacaccgaaaggcgccaucaacaccagccuccccuuccagaauauccacccuauuacuauagguaagugcccaaaguaugugaaaucgacaaagcugcgccuugcaaccgggcugagaaacguacccucuauccaguccaggggauuguuuggcgcuauugccggcuucaucgaagggggauggacggguaugguggacggcugguacggguaucaucaccagaaugaacaaggaucaggcuacgcggccgaucucaaaaguacccagaacgcaauagacgagauuacaaauaaggucaacagcgugaucgagaaaaugaauacucaguuuaccgcuguugguaaggaguucaaccaccuggaaaagcggaucgaaaauuuaaacaaaaagguggaugacggguuccuggauauuuggacauacaaugccgagcuccuuguccuguuggaaaacgagcgcacucuagacuaucaugauuccaacgugaaaaaucuguacgagaagguacgaucucagcucaaaaacaaugcuaaggaaaucggcaacggauguuuugaguucuaucacaagugcgacaauaccuguauggaaagcguuaaaaacggcacauacgauuauccuaaguacucagaggaagccaaacugaauagagaggagauugacggggugaaacuugaaaguaccaggauauaucaaauccuggcaauuuacuccacugucgccagcucuuuggugcucgucgugucacugggagcuaucaguuuuuggaugugcagcaacgguuccuuacagugccggaucuguauuuga

SEQ ID NO: 129787 - RNA, 1701 nt, Artificial Sequence; identical to SEQ ID NO: 127549
  derived and/or modified sequence opt3 from hemagglutinin__InfluenzaA__AET10090

SEQ ID NO: 129788 - RNA, 1701 nt, Artificial Sequence; identical to SEQ ID NO: 127549
  derived and/or modified sequence opt3 from hemagglutinin__InfluenzaA__AET10091

SEQ ID NO: 129789 - RNA, 1701 nt, Artificial Sequence; identical to SEQ ID NO: 127549
  derived and/or modified sequence opt3 from hemagglutinin__InfluenzaA__AET10092

SEQ ID NO: 129790 - RNA, 1701 nt, Artificial Sequence
  derived and/or modified sequence opt3 from hemagglutinin__InfluenzaA__AET10094
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacaggugagauuugugacagcccacaccagauccuagauggcgaaaauugcacccucauagacgcucugcuuggggauccgcagugugacggauuucaaaacaaaaagugggaucuguucguggagagauccaaagccuacucuucgugcuaucccuacgacgucccugauuaugcaucauugaggagccucguggccaguuccggcacucuggaauuuaauaacgagucuuucaauuggacagguguuacccagaacgggacgagcuccgcuuguauccggcgcucaaauaacagcuuuuucagucgacugaauuggcucacucauuuaaacuuuaaguacccagcacugaaugugaccaugcccaacaacgagcaguucgacaaacuuuauauuuggggaguccaccauccuggcacagauaaggaccagaucuuuuuguacgcccaggcuucuggccguauuacuguguccaccaagagaucacaacaggccguaaucccaaauauagggagcaggccccggguucgcaacauuccuaguagaaucucuauuuauuggacaaucgugaaaccaggagauauccugcuaauuaauuccaccgguaaccucauagcgccgaggggcuacuucaagauccggagcgggaaaucgucuauuaugcgcuccgacgcacccaucggaaagugcaauucagaauguauaacgccuaacggcaguauuccaaaugacaagcccuuucagaacgucaaucgaaucacuuacggugccugcccuagauaugugaaacaaagcacacugaaacuugcuaccgggaugaggaacgugccagagaagcagacucggggaaucuucggcgccauugcaggcuuuaucgaaaaugggugggagggaauggucgaugguugguacggcuuccgucaccagaacuccgaggggcgcggacaagcugccgaccugaagucuacacaggcggccauugaucagauaaauggcaaauugaacagacucaucgguaagaccaaugaaaaauuccaccagauugagaaggaauuuagcgagguugaagggaggauccaagaccuggagaaguauguggaggauacgaaaaucgacuuauggucauacaacgcagaacugcucguagcucuugagaaccagcauaccauugaucugacagacagugaaaugaauaaguuguucgagaaaacuaagaaacagcuacgggaaaacgccgaggauaugggcaauggauguuuuaccauauaucacaagugcgacaacgcuugcaucggcuccauucgaaaugggacauacgaucauaacguguaucgcgacgaggcccugaauaacagauuccagaucaagggagucgaacucaaaagcgguuacaaggacuggauucuguggaucucuuuugcaauaucauguuuccuucugugcguggccuugcucggcuuuaucaugugggcuugucaaaaagggaauauuaggugcaacaucuguauuuga

SEQ ID NO: 129791 - RNA, 1701 nt, Artificial Sequence
  derived and/or modified sequence opt3 from hemagglutinin__InfluenzaA__AET10095
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaagcuguacauuuggggaguccaccauccuggcacagauaaagaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacacgcccaucggaaaguguaacuccgaaugcauaacuccuaauggcucaauuccaaacgacaagcccuuucagaaugucaaccgaaucacauauggugcauguccuagauacgugaaacaaaauacccugaaacuugccacugggaugaggaacgugccagagaagcagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucgagucaauucgaaauggcacauaugaucaugacguguaccgcgacgaagcucugaacaauagauuccagaucaaaggggucgagcucaagaguggauacaaagauuggauucuguggaucuccuuugccauaagcugcuuccuucuguguguggcauugcucgguuuuaucaugugggccugccaaaagggcaacauuagguguaauaucugcauuuga

SEQ ID NO: 129792 - RNA, 1701 nt, Artificial Sequence
  derived and/or modified sequence opt3 from hemagglutinin__InfluenzaA__AET10096
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacaaaauucuucaacaggugagauuugcgacaguccacaccagaucauagauggcgaaaacuguacccugaucgacgcucuacucggggauccgcagugcgacggauuccagaauaaaaaguggaaccuguuuguggagagaagcaaagccuauuccaauuguuaccccuaugaugucccugacuacgcaucucuuaggucgcugguggccucaagcggcacuuuggaguucaacaaugaaaguuuuaacuggacagguguuacccagaaugggacguccucugcuugcauucggcgcagcaacaauuccuucuuuucacgacucaacuggcugacucaucugaacuucaaguauccagcacucaaugugaccaugcccaacaaugagcaguuugauaaguuauacaucuggggaguccaccauccuggcacagacaaagaucagauuuuccuguaugcccaagcuaguggccguaucacugugagcaccaagagaucucagcaggccguaauaccaaacauuggguccaggccccggguucgcaauaucccuucaagaauuagcaucuacuggacaaucgugaaaccaggagacauucuuuugauaaacaguaccgguaaucugaucgcgccgaggggcuacuuuaagauucggucugggaaauccagcaucaugcgcucggaugcacccauaggaaaguguaacucugaaugcauuacgccuaauggcuccaucccaaacgacaagcccuuccagaaugucaaccgaaucacuuauggugccuguccuagauacgugaaacaaaauacacuaaagcucgcuaccgggaugaggaacgugccagagaaacagacucggggaauuuuuggcgccaucgcaggcuucauugaaaaugggugggagggaauggucgacgguugguauggcuuccgucaccagaacucagaggggcgcggacaagcugccgaucugaagaguacacaggcggccauagaccagaucaacggcaaacuuaauagacugauugguaagaccaacgaaaaauuucaccagaucgagaaggaguucagcgaaguugaagggaggauccaagauuuggagaaguacguggaggacacgaaaauugaucucugguccuauaaugcagaacuguuaguagcucuggagaaccagcauaccauagaccucacagauucugaaaugaauaaacuuuuugagaagacuaagaaacagcugcgggaaaacgccgaggacaugggcaauggaugcuucaagaucuaccacaagugugauaacgcuugcauuggcagcauccgaaaugggaccuaugaccaugauguguaccgcgacgaggccuugaacaauagauuucagauuaaaggagucgaacuaaagucagguuacaaagacuggauccuguggauaaguuucgcaaucuccugcuuucuccuguguguggcccuucugggcuucauuaugugggcuugccaaaaggggaacaucagguguaauauuugcaucuga

SEQ ID NO: 129793 - RNA, 1701 nt, Artificial Sequence
  derived and/or modified sequence opt3 from hemagglutinin__InfluenzaA__AET10098
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacaaaauucuucaacaggugagauuugcgacaguccacaccagaucauagauggcgaaaacuguacccugaucgacgcucuacucggggauccgcagugcgacggauuccagaauaaaaagugggaucuguuuguggagagaagcaaagccuauuccaacuguuaccccuaugacgucccugauuacgcaucucuuaggucgcugguggccucaagcggcacuuuggaguucaauaacgaaaguuuuaauuggacagguguuacccagaacgggacguccucugcuugcauucggcgcagcaauaacuccuucuuuucacgacucaauuggcugacucaucugaacuucaaguauccagcacucaacgugaccaugcccaauaacgagcaguuugacaaguuauacaucuggggaguccaccauccuggcacagauaaagaccagauuuuccuguaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauucuuuugauaaauaguaccgguaaccugaucgcgccgaggggcuacuuuaagauucggucugggaaauccagcaucaugcgcucggacgcacccauaggaaaguguaauucugaaugcauuacgccuaacggcuccaucccaaaugacaagcccuuccagaacgucaaucgaaucacuuauggugccuguccuagauacgugaaacaaaacacacuaaagcucgcuaccgggaugaggaaugugccagagaaacagacucggggaauuuuuggcgccaucgcaggcuucauugaaaacgggugggagggaauggucgaugguugguauggcuuccgucaccaaaauucagaggggcgcggacaggcugccgaccugaagaguacacaggcggccauagaucagaucaacggcaaacuuaacagacugauugguaagaccaaugaaaaauuucaccagaucgagaaggaguucagcgaaguugaagggaggauccaagacuuggagaaguacguggaggauacgaaaauugaccucugguccuauaacgcagaacuguuaguagcucuggagaaucagcauaccauagaucucacagacucugaaaugaacaaacuuuuugagaagacuaagaaacagcugcgggaaaaugccgaggauaugggcaacggaugcuucaagaucuaccacaagugugacaaugcuugcauuggcagcauccgaaacgggaccuaugaucaugacguguaccgcgacgaggccuugaauaacagauuucagauuaaaggagucgaacuaaagucagguuacaaagauuggauccuguggauaaguuucgcaaucuccugcuuucuccuguguguggcccuucugggcuucauuaugugggcuugccaaaaggggaauaucagguguaacauuugcaucuga

SEQ ID NO: 129794 - RNA, 1701 nt, Artificial Sequence; identical to SEQ ID NO: 128871
  derived and/or modified sequence opt3 from hemagglutinin__InfluenzaA__AET10099

SEQ ID NO: 129795 - RNA, 1701 nt, Artificial Sequence; identical to SEQ ID NO: 128998
  derived and/or modified sequence opt3 from hemagglutinin__InfluenzaA__AET10100

SEQ ID NO: 129796 - RNA, 1701 nt, Artificial Sequence
  derived and/or modified sequence opt3 from hemagglutinin__InfluenzaA__AET10101
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacaggugagauuugugacagcccacaccagauccuagauggcgaaaauugcacccucauagacgcucugcuuggggauccgcagugugacggauuucaaaacaaaaagugggaucuguucguggagagauccaaagccuacucuaauugcuaucccuacgacgucccugauuaugcaucguugaggucacucguggccagcaguggcacucuggaauuuaacaaugaguccuucaacuggacagguguuacccagaaugggacgucuagcgcuuguauccggcgcuccaacaauucauuuuucagucgacugaacuggcucacucauuuaaauuuuaaguacccagcacugaacgugaccaugcccaacaaugagcaguucgacaaacuuuauauuuggggaguccaccauccuggcgccgauaaggaccagaucuuuuuguacgcucaagccagcggccguauuacagugucuacuaagagaucccagcaggcgguaaucccaaacauagggucaaggccccggguucgcaauauuccuagcagaaucaguauuuauuggaccaucgugaaaccaggagauauccugcuaauuaacucuacagguaaucucauagcaccgaggggcuacuucaagauccgguccgggaaaagcucgauuaugcgcucugacgcccccaucggaaagugcaacuccgaauguauaaccccuaauggcucaauuccaaacgacaagcccuuucagaaugucaaccgaaucacguacggugcuugcccuagauaugugaaacaaaguacucugaaacuugccacagggaugaggaaugugccagagaagcagacccggggaaucuucggcgcaauugcuggcuuuaucgaaaacgggugggagggaauggucgaugguugguacggcuuccgucaccagaauagcgaggggcgcggacaagccgcggaccugaaguccacucaggccgcaauugaucagauaaacggcaaauugaauagacucaucgguaagacaaacgaaaaauuccaccagauugagaaggaauuuucugagguugaagggaggauccaagaccuggagaaguauguggaggauaccaaaaucgacuuauggagcuacaacgcugaacugcucguagcccuugagaaucagcauacgauugaucugaccgacucagaaaugaacaaguuguucgagaaaacaaagaaacagcuacgggaaaaugcugaggauaugggcaacggauguuuuacuauauaucacaagugcgacaaugccugcaucggcaguauucgaaacgggaccuacgaucauaauguguaucgcgacgaggcacugaacaauagauuccagaucaagggagucgaacucaaauccgguuacaaggacuggauucuguggaucagcuuugccauaucuuguuuccuucugugcguggcuuugcucggcuuuaucaugugggcgugucaaaaagggaacauuaggugcaauaucuguauuuga

SEQ ID NO: 129797 - RNA, 1701 nt, Artificial Sequence
  derived and/or modified sequence opt3 from hemagglutinin__InfluenzaA__AET10102
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcaaaaauuguacucucauagacgcgcugcuuggggauccgcagugcgacggauuucaaaacaagaaaugggaucuguucguggaaagauccaaggcuuauucuaauuguuaccccuuugacgucccugauuaugccucguugaggucacucguggcaagcaguggcacacuggaguucaacaaugaauccuuuaacuggaccgguguuacgcagaaugggacuucuagcgccugcaugcggcgcuccaagucaaguuucuuuagccgacugaacuggcucacccauuuaaauuucaaauacccagcucugaacgugacaaugcccaaugacgagcaguuugauaaacuuuauaucuggggaguccaccauccuggcacugacaaggaucagauuuucuuguacgcacaagccucuggccguaucaccguguccacaaagagaucacagcagaccguaauuccaaacaucgggagcaggccccggauacgcaacauuccuaguagaaucucuauuuauuggacgaucguuaaaccaggagacauccugcuaauuaauuccacugguaaccucauagcuccgaggggcuacuuuaagauccggagcgggaagucgucuauuaugcgcuccgacgcccccaucggaaaauguaauucagagugcauaacaccuaacggcaguauuccaaaugauaagcccuuccagaacgugaaucgaaucaccuacggugcguguccuagauaugucaaacaaaacacucugaaacuugcaacagggaugaggaaugugccagaaaagcagacccggggaaucuuuggcgccauugcuggcuucaucgagaacgggugggaaggaaugguggacgguugguacggcuuccgucaccagaauagcgaggggcgcggacaagccgcagaucugaaguccacgcaggcugccauugaccagauaaacggcaaauugaauagacucaucgguaggaccaacgagaaguuucaccagauugaaaaggaguucucugaagucgaggggcggauccaagaucuggaaaaauauguugaggacacaaagaucgauuuauggagcuacaaugcggagcugcucguggcccuugaaaaccagcauacuauugaccugaccgauucagagaugaacaaauuguuugaaaagacacgaaaacagcuacgcgagaaugcagaagacaugggcaacggaugcuucaagauauaucacaagugugauaaugcuugcaucggcaguauuagaaacgggacuuacgaccaugacguauauagggaugaggcccugaauaaccgguuucagaucaaaggaguggagcucaaguccgguuacaaagacuggauucuguggaucagcuucgcuauaucuugcuuucuucugugugucgccucauugggcuucaucaugugggcaugccaaaaggggaauauucgcuguaacaucugcauuuga

SEQ ID NO: 129798 - RNA, 1701 nt, Artificial Sequence
  derived and/or modified sequence opt3 from hemagglutinin__InfluenzaA__AET10103
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauauaggguccaggccccggguucgcaacauuccuucaagaaucagcauuuacuggacaaucgugaaaccaggagauauccugcuaauuaauaguaccgguaaccucauagcgccgaggggcuacuucaagauccggucugggaaauccagcauuaugcgcucggacgcacccaucggaaaguguaauucugaaugcauaacgccuaacggcuccauuccaaaugacaagcccuuucagaacgucaaucgaaucacuuauggugccuguccuagauacgugaaacaaaacacacugaaacuugcuaccgggaugaggaaugugccagagaagcagacucggggaaucuucggcgccauugcaggcuuuaucgaaaacgggugggagggaauggucgaugguugguauggcuuccgucaccaaaauucagaggggcgcggacaggcugccgaccugaagaguacacaggcggccauugaucagauaaacggcaaauugaacagacucaucgguaagaccaaugaaaaauuccaccagauugagaaggaauuuagcgagguugaagggaggauccaagaccuggagaaguacguggaggauacgaaaaucgacuuaugguccuauaacgcagaacugcucguagcucuugagaaucagcauaccauugaucugacagacucugaaaugaacaaguuguucgagaaaacuaagaaacagcuacgggaaaaugccgaggauaugggcaacggaugcuuuaagauauaccacaagugugacaaugcuugcaucggcagcauucgaaacgggaccuaugaucaugacguguaccgcgacgaggcccugaauaacagauuccagaucaaaggagucgaacucaagucagguuacaaagauuggauucuguggaucaguuuugcaauauccugcuuccuucuguguguggccuugcucggcuuuaucaugugggcuugccaaaaggggaauauuagguguaacaucugcauuuga

SEQ ID NO: 129799 - RNA, 1701 nt, Artificial Sequence
  derived and/or modified sequence opt3 from hemagglutinin__InfluenzaA__AET10104
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacaaaauucuucaacaggugagauuugcgacaguccacaccagaucauagauggcgaaaacuguacccugaucgacgcucuacucggggauccgcagugcgacggauuccagaauaaaaagugggaucuguuuguggagagaagcaaagccuauuccaacuguuaccccuaugacgucccugauuacgcaucucuuaggucgcugguggccucaagcggcacuuuggaguucaauaacgaaaguuuuaauuggacagguguuacccagaacgggacguccucugcuugcauucggcgcagcaauaacuccuucuuuucacgacucaauuggcugacucaucugaacuucaaguauccagcacucaacgugaccaugcccaauaacgagcaguuugacaaguuauacaucuggggaguccaccauccuggcacagauaaagaccagauuuuccuguaugcccaagcuaguggccguaucacugugagcaccaagagaucucagcaggccguaauaccaaauauuggguccaggccccggguucgcaacaucccuucaagaauuagcaucuacuggacaaucgugaaaccaggagauauucuuuugauaaauaguaccgguaaccugaucgcgccgaggggcuacuuuaagauucggucugggaaauccagcaucaugcgcucggacgcacccauaggaaaguguaauucugaaugcauuacgccuaacggcuccaucccaaaugacaagcccuuccagaacgucaaucgaaucacuuauggugccuguccuagauacgugaaacaaaacacacuaaagcucgcuaccgggaugaggaaugugccagagaaacagacucggggaauuuuuggcgccaucgcaggcuucauugaaaacgggugggagggaauggucgaugguugguauggcuuccgucaccaaaauucagaggggcgcggacaggcugccgaccugaagaguacacaggcggccauagaucagaucaacggcaaacuuaacagacugauugguaagaccaaugaaaaauuucaccagaucgagaaggaguucagcgaaguugaagggaggauccaagacuugggcaaguacguggaggauacgaaaauugaccucugguccuauaacgcagagcuguuaguagcucuggaaaaucagcauaccauagaucucacagacucugagaugaacaaacuuuuugaaaagacuaagaaacagcugcgggagaaugccgaagauaugggaaacggcugcuucaagaucuaccacaagugugacaaugcuugcauugggagcauccgaaacggaaccuaugaucaugacguguaccgcgacgaggccuugaauaacagauuucagauuaaaggugucgagcuaaagucaggcuacaaagauuggauccuguggauaaguuucgcaaucuccugcuuucuccuguguguggcccuucugggguucauuaugugggcuugccaaaagggaaauaucagguguaacauuugcaucuga

SEQ ID NO: 129800 - RNA, 1701 nt, Artificial Sequence
  derived and/or modified sequence opt3 from hemagglutinin__InfluenzaA__AET10105
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuuaaauacccagcacugaacgugaccaugcccaauaacgaacaguucgauaaacuuuauauuuggggaguccaucacccuggcacagacaaggaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaagccaggagacauccugcuaaucaauaguaccgguaaccucauugcaccgaggggcuacuucaaaauacggucugggaaguccagcaucaugcgcucggaugcccccauuggaaaauguaauucugcuugcaucacgccuaacggcuccauaccaaaugacaagcccuuucagaacgugaaucgaauuacuuacggugccuguccuagauaugugaagcaaaacacacugaaacuugcaaccgggaugaggaaugucccagagaagcagacucggggaaucuucggcgcuaucgccggcuuuauugaaaacgggugggagggaaugguugacgguugguacggcuuccgucaccaaaauucagaggggcgcggacaggcggccgaucugaaaaguacacaggcagcuaucgaccagauuaacggcaaguugaacagacucauagguaaaaccaaugaaaaguuccaucagaucgagaaagaauuuagcgagguggaagggaggauucaagaucuggagaaguauguagaggacacgaagaucgauuuaugguccuacaacgccgaacugcucguggcucuugagaaucagcacaccaucgaccugacagauucugaaaugaacaaauuguucgagaagacuaaaaagcagcuacgggaaaaugccgaggacaugggcaacggaugcuuuaaaauuuaucauaagugugauaaugcaugcauaggcagcauccgaaacgggaccuacgaccacgaugucuaucgcgacgaggcccugaauaacagauuccagauuaagggaguggaacucaaaucagguuacaaggacuggauccuguggauuaguuuugcuaucuccugcuuccuucuguguguugcguugcucggcuuuauaaugugggcaugccaaaaagggaauaucagguguaacauuugcaucuga

SEQ ID NO: 129801 - RNA, 1701 nt, Artificial Sequence
  derived and/or modified sequence opt3 from hemagglutinin__InfluenzaA__AET10106
augaagaccaucauugcccugagcuacauacucugccuuguguucgcucagaaacugcccggcaacuauaauuccacagcaacuuuguguuuagggcaccaugccgucccuaacggaacgaucguuaagaccauuacaaaugaccaaaucgaggugacuaacgcgaccgaacugguacagucuucaaguacaggugagauuugcaauagcccacaccagauccuagauggcgaaaacuguacccucauagacgcucugcuuggggauccgcagugcgacggauuucaaaauaaaaagugggaucuguucguggagagauccaaagcccauucuaacuguuaccccuaugacgucccugauuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguauccagcacugaacgugaccaugcccaauaacgagcaguucgacaagcuguacauuuggggaguccaucacccuggcacagauaaagaccagaucuuuuuguaugcccaagcuagcggccguauuacugugucuaccaagagaucccagcaggccguaaucccaaauauagggucaaggccccggguucgcaacauuccuagcagagugaguaucuacuggacaauugucaaaccaggagauauccugcuaaucaauucuaccgguaaccucauugcgccgaggggcuacuucaagauacgguccgggaaaagcucgaucaugcgcucugacgcacccauuggaaaguguaauuccgccugcaucacgccuaacggcucaauaccaaaugauaagcccuuucagaacgugaaucgaauuacuuauggugcuuguccuagauacgugaaacaaaacacacugaaacuugccaccgggaugaggaaugucccagaaaaacagacucggggaaucuucggcgcaaucgcuggcuuuauugagaacgggugggaaggaaugguugacgguugguauggcuuccgucaccagaauagugaggggcgcggacaagccgcggaccuuaagagcacacaggccgcaaucgaucagauuaacggcaaauugaacagacucauagguaagaccaaugagaaauuccaucagaucgaaaaggaguuuuccgaaguggaggggaggauucaagaccuggaaaaguacguagaggauacgaaaaucgacuuauggucuuauaacgcugagcugcucguggcccuugaaaaucagcacaccaucgaucugacagacagcgagaugaacaaguuguucgaaaagacuaagaaacagcuacgggagaaugcugaagauaugggcaacggaugcuuuaagauuuaccauaagugugacaaugccugcauaggcucaauccgaaacgggaccuaugaucacgacgucuaccgcgaugaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucagguguaacauuugcaucuga

SEQ ID NO: 129802 - RNA, 1701 nt, Artificial Sequence
  derived and/or modified sequence opt3 from hemagglutinin__InfluenzaA__AET10107
augaagaccaucauugcccugagcuacauacucugccuuguguucgcucaggagauccccggcaacgacaauuccacagcaacucuguguuuggggcaccaugccgucccuaacggaacgauuguuaaaaccaucacaaaugaucaaauugaagugacuaacgcgaccgaguuaguacagucuucaaguacaggugaaaucugcaauagcccacaccagauacuggacggcgagaacuguacccuaaucgaugcucuccugggggacccgcagugcgauggauuucaaaauaagaaaugggaccuuuucguggaaagauccaaggcccauucuaacuguuaucccuacgaugucccugacuaugcaucgcugaggucauugguggccagcaguggcacucucgaguuuaauaacgaguccuucaauuggacagguguuacccagaacgggacgucuagcgcuugcauucggcgcuccaauaacucauuuuucagucgacugaauuggcugacucaccucaacuuuaaauacccagcauuaaacgugaccaugcccaauaacgaacaguucgauaagcuguauaucuggggaguccaucacccuggcacagacaaggaucagauuuuucuuuacgcccaagcuagcggccguaucacugugucuaccaaaagaucccagcaggccguaauaccaaauauugggucaaggccccggguucgcaacaucccuagcagagugaguauuuauuggacaaucgucaagccaggagacaucuugcugauuaauucuaccgguaaccuaauagcgccgaggggcuacuucaaaauccgguccggaaagagcucgauuaugcgcucugaugcacccaucgggaaauguaauuccgccugcauaacgccuaacggcucaauuccaaaugacaagcccuuucagaacgugaaucgaaucacuuacggugcuuguccuagauaugugaagcaaaacacacucaaacuggccaccgggaugaggaaugucccagagaagcagacucggggaaucuucggcgcaauugcuggcuuuaucgaaaacgggugggagggaaugguugacgguugguacggcuuccgucaccagaauagugaggggcgcggacaagccgcggaucuuaaaagcacacaggccgcaauugaccagauaaacggcaagcugaacagauugaucgguaaaaccaaugaaaaguuccaucagauugagaaagaauuuuccgagguggaagggaggauccaagaucucgagaaguauguagaggacacgaagaucgaucuguggucuuacaacgcugaauuacugguggcccucgagaaucagcacaccauugaccuuacagauagcgaaaugaacaaacuguucgagaagacuaaaaagcaguugcgggaaaaugcugaggacaugggcaacggaugcuuuaaaauauaucauaagugugauaaugccugcaucggcucaauucgaaacgggaccuacgaccacgaugucuaucgcgacgaggcacuaaauaacagauuccagaucaagggaguggaacugaaaagugguuacaaggacuggauucucuggaucuccuuugccauaagcugcuuccugcuuuguguugcucuguugggcuuuaucaugugggcgugccaaaaagggaauauuaaguguaacaucugcauuuga

SEQ ID NO: 129803 - RNA, 1701 nt, Artificial Sequence; identical to SEQ ID NO: 125427
  derived and/or modified sequence opt3 from hemagglutinin__InfluenzaA__AET10108

SEQ ID NO: 129804 - RNA, 1701 nt, Artificial Sequence; identical to SEQ ID NO: 128998
  derived and/or modified sequence opt3 from hemagglutinin__InfluenzaA__AET10109

SEQ ID NO: 129805 - RNA, 1701 nt, Artificial Sequence
  derived and/or modified sequence opt3 from hemagglutinin__InfluenzaA__AET10110
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaacuuuaaguauccagcacugaacgugaccaugcccaauaacgagcaguucgauaagcuguacauuuggggaguccaccauccuggcacagacaaagaucagaucuuuuuguaugcccaagcuagcggccguauuacugugucuaccaagagaucccagcaggccguaaucccaaauauagggucaaggccccggguucgcaacauuccuagcagagugaguaucuacuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuauggugcuuguccuagauacgugaaacaaaacacacugaaacuugccaccgggaugaggaaugucccagaaaaacagacucggggaaucuucggcgcaaucgcuggcuuuauugagaacgggugggaaggaaugguugacgguugguauggcuuccgucaccagaauagugaggggcgcggacaagccgcggaucuuaagagcacacaggccgcaaucgaccagauuaacggcaaauugaacagacucauagguaagaccaaugagaaauuccaccagaucgaaaaggaguuuuccgaaguggaggggaggauucaagaucuggaaaaguacguagaggacacgaaaaucgauuuauggucuuauaacgcugagcugcucguggcccuugaaaaucagcauaccaucgaccugacagauagcgagaugaacaaguuguucgaaaagacuaagaaacagcuacgggagaaugcugaagacaugggcaacggaugcuuuaagauuuaccacaagugugauaaugccugcauaggcucaauccgaaacgggaccuaugaccaugaugucuaccgcgacgaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucaaauguaacauuugcaucuga

SEQ ID NO: 129806 - RNA, 1701 nt, Artificial Sequence
  derived and/or modified sequence opt3 from hemagglutinin__InfluenzaA__AET10111
augaagaccaucauugcccugagcuacauacucugccuuguguucgcucaggagauccccggcaacgacaauuccacagcaacucuguguuuggggcaccaugccgucccuaacggaacgauuguuaaaaccaucacaaaugaucaaauugaagugacuaacgcgaccgaguuaguacagucuucaaguacaggugaaaucugcaauagcccacaccagauacuggacggcgagaacuguacccuaaucgaugcucuccugggggacccgcagugcgauggauuucaaaauaagaaaugggaccuuuucguggaaagauccaaggcccauucuaacuguuaucccuacgaugucccugacuaugcaucgcugaggucauugguggccagcaguggcacucucgaguuuaauaacgaguccuucaauuggacagguguuacccagaacgggacgucuagcgcuugcauucggcgcuccaauaacucauuuuucagucgacugaauuggcugacucaccucaacuuuaaauacccagcauuaaacgugaccaugcccaauaacgaacaguucgauaagcuguauaucuggggaguccaucacccuggcacagacaaggaucagauuuuucuuuacgcccaagcuagcggccguaucacugugucuaccaaaagaucccagcaggccguaauaccaaauauugggucaaggccccggguucgcaacaucccuagcagagugaguauuuauuggacaaucgucaagccaggagacaucuugcugucuaauuccaccgguaaccuaauuggcccgaggggguacuucaaaauacggagcggaaagucgucuaucaugcgcuccgaugcgcccauuggcaaauguaauucagcaugcaucacgccuaacgguaguauaccaaaugacaagcccuuucagaacgugaaucgaauuacuuacggggccuguccuagauaugugaagcaaaacacacucaaacuggcuaccggaaugaggaaugucccagagaagcagacucggggcaucuucggcgccaucgcaggguuuauugaaaacggaugggaggguaugguugacggcugguacggguuccgucaccagaauagcgagggacgcggccaagcugccgaucuuaaauccacacaggcggccaucgaccagauuaacgguaagcugaacagauugauagggaaaaccaaugaaaaguuccaucagaucgagaaagaauuuucugagguggaaggcaggauucaagaucucgagaaguauguagaggacacgaagaucgaucuguggagcuacaacgcagaauuacugguggcucucgagaaucagcacaccaucgaccuuacagauucagaaaugaacaaacuguucgagaagacuaaaaagcaguugcgggaaaaugccgaggacaugggaaacggcugcuuuaaaauuuaucauaagugugauaaugcuugcauagggaguauccgaaacggaaccuacgaccacgaugucuaucgcgacgaggcccuaaauaacagauuccagauuaaggguguggaacugaaauccggcuacaaggacuggauccucuggauuagcuuugcaaucucuugcuuccugcuuuguguugcccuguugggguuuauaaugugggcuugccaaaaaggaaauaucagguguaacauuugcaucuga

SEQ ID NO: 129807 - RNA, 1701 nt, Artificial Sequence
  derived and/or modified sequence opt3 from hemagglutinin__InfluenzaA__AET10113
augaagaccaucauugcccugagcuacauacucugccuuguguucgcucaggagcugcccggcaacgacaauuccacagcaacuuuguguuuagggcaccaugccguccaaaacggaacgaucguuaaaaccauuacaaaugaucagaucgaagugacuaacgcgaccgagcugguacagucuucaaguacaggugaaauuugcaauagcccucaccagauccuagacggcgagaacuguacccucauagaugcucugcuuggggacccacaaugcgauggauuucagaauaagaaaugggaccuguucguggaaagauccaaggcccauucuaacuguuauccguacgauguccccgacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuuaaauacccugcacugaacgugaccaugccaaauaacgaacaguucgauaaacuuuauauuuggggaguccaucaccccggcacagacaaggaucaaaucuuuuuguacgcccaggcuagcggccguauuacugugucuaccaagagaucccagcaggccguaaucccuaauauagggucaaggccacggguucgcaacauucccagcagagugaguaucuauuggacaauugucaagccuggagacauccugcuaaucaauucuaccgguaaccucauugcgccaaggggcuacuucaaaauacgguccggaaagagcucgaucaugcgcucugaugcaccgauugggaaauguaauuccgccugcaucacgcccaacggcucaauaccuaaugacaagccauuucaaaacgugaaucgaauuacuuacggugcuugucccagauaugugaagcagaacacacugaaacuugccaccgggaugaggaaugucccugagaagcagacucggggaaucuucggcgcaaucgcuggcuuuauugaaaacgggugggagggaaugguugacgguugguacggcuuccgucaccaaaauagugaggggcgcggacaggccgcggaucugaaaagcacacaggccgcaaucgaccagauuaacggcaaguugaacagacucauagguaaaaccaaugaaaaguuccaucaaaucgagaaagaauuuuccgagguggaagggaggauucaggaucuggagaaguauguagaggacacgaagaucgauuuauggucuuacaacgcugaacugcucguggcccuugagaaucagcacaccaucgaccugacagauagcgaaaugaacaaauuguucgagaagacuaaaaagcagcuacgggaaaaugcugaggacaugggcaacggaugcuuuaaaauuuaucauaagugugauaaugccugcauaggcucaauccgaaacgggaccuacgaccacgaugucuaucgcgacgaggcacugaauaacagauuccaaauuaagggaguggaacucaaaagugguuacaaggacuggauccuguggauuuccuuugccaucagcugcuuccuucuguguguugcuuugcucggcuuuauaaugugggcgugccagaaagggaauaucagguguaacauuugcaucuga

SEQ ID NO: 129808 - RNA, 1701 nt, Artificial Sequence
  derived and/or modified sequence opt3 from hemagglutinin__InfluenzaA__AET10114
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugcgcucugacgcacccauugggaaauguaacuccgccugcaucacgccuaauggcucaauaaguaacgacaagccauuucagaaugugaaccgaauuacuuacggugcuugucccagauaugugaagcaaaauacacugaaacuugccaccgggaugaggaacgucccugagaagcagacucggggaaucuucggcgcaaucgcuggcuuuauugaaaaugggugggagggaaugguugaugguugguacggcuuccgucaccagaacagcgaggggcgcggacaagccgcggaccugaaauccacacaggccgcaaucgaucagauuaauggcaaguugaacagacucauagguaaaaccaacgaaaaguuccaucagaucgagaaagaauuuucugagguggaagggaggauucaagaccuggagaaguauguagaggauacgaagaucgacuuauggagcuacaaugcugaacugcucguggcccuugagaaccagcacaccaucgaucugacagacucagaaaugaauaaauuguucgagaagacuaaaaagcagcuacgggaaaacgcugaggauaugggcaauggaugcuuuaaaauuuaucauaagugugacaacgccugcauaggcaguauccgaaaugggaccuacgaucacgacgucuaucgcgacgaggcacugaacaauagauuccagauuaagggaguggaacucaaauccgguuacaaggauuggauccuguggauuagcuuugccaucucuugcuuccuucuguguguugcuuugcucggcuuuauaaugugggcgugccaaaaagggaacaucauguguaauauuugcaucuga

SEQ ID NO: 129809 - RNA, 1698 nt, Artificial Sequence
  derived and/or modified sequence opt3 from hemagglutinin__InfluenzaA__AET50439
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgggaaucagaaagcccuguaccauacggagaacgcuuacgucuccguggugucaagccacuauagucgcaaguucacucccgaaauagcaaagcgaccuaaaguccgugaccaggagggaagaaucaauuacuauuggacccuucuggagccaggugauacaauuaucuuugaagccaacggcaauuugauugcuccgagguacgccuucgcgcucucucggggguuuggauccggcaucauaaacagcaaugcacccauggacaagugugaugccaaaugccagacuccucaaggugcuauuaacucgucucugccauuccagaauguucaucccgugaccaucggggaguguccuaaguauguacgcuccgccaaauuaagaauggugacaggacugaggaacauuccaucaauccagagucggggccucuuuggcgcaaucgcuggguucauugaaggagguuggaccggcauggucgacgggugguacggauaucaccaccagaaugagcaaggcagcgguuacgccgcggaucagaaguccacgcagaacgccauaaaugggaucacuaacaaaguaaauucuguuauugaaaagaugaacacacaguuuaccgcagugggcaaggaguucaacaaacuugagcgccgaauggaaaaucugaacaagaaagucgacgauggauucaucgacauauggacuuacaaugcugaguugcuagugcugcucgaaaacgagagaacacuggauuuucaugacagcaauguaaagaaccuuuaugaaaaaguuaagucacaacugaagaauaacgccaaagagauuggcaaugggugcuucgaguuuuaccacaaguguaacgacgaaugcauggagagugugaaaaauggaaccuaugauuaccccaaguauuccgaagagagcaaauugaacagggagaagaucgacggugucaagcucgaaucuaugggcguguaccagauccuggcuauuuauucaacggucgccaguagcuuagugcugcuaguuucccucggggcaaucucuuucuggaugugcucgaauggaagccugcagugucggauuugcauauga

SEQ ID NO: 129810 - RNA, 1698 nt, Artificial Sequence
  derived and/or modified sequence opt3 from hemagglutinin__InfluenzaA__AET50440
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaacucacacagucaccggugugucugccagcugcucccauaacggggaaucaaguuuuuaucggaauuuacuguggcuuacgggcaaaaacggauuguaccccaaucugagcaagucuuaugcaaacaauaaagagaaggaaguucuaguacucuggggcgugcaccacccuccaaacaucgggaaccagaaagcccuguaccauacugagaaugcuuacgucuccguggugucaagccacuauagucgcaaguucacccccgaaauagcaaagcgaccuaaaguccgugaccaggagggaagaaucaacuacuauuggacacuucuggagccaggugauacuauuaucuuugaagccaauggcaacuugauugcuccgagguacgccuucgcgcucucucggggguuuggauccggcaucauaaauagcaacgcacccauggacaagugugaugccaaaugccagaccccucaaggugcuauuaauucgucucugccauuccagaacguucaucccgugacaaucggggaguguccuaaguauguacgcuccgccaaauuaagaauggugaccggacugaggaauauuccaucaauccagagucggggccucuuuggcgcaaucgcuggguucauugaaggagguuggacgggcauggucgacgggugguacggauaucaccaccagaacgagcaaggcagcgguuacgccgcggaucagaaguccacucagaaugccauaaacgggaucacaaauaaagugaacucuguuauugaaaagaugaauacccaguuuacugcagugggcaaggaguucaacaaacuugagcgccgaauggaaaaccugaauaagaaagucgacgauggauucaucgacauauggacauacaacgcugaguugcuagugcugcucgaaaaugagagaacccuggauuuucaugacagcaacguaaagaaucuuuaugaaaaaguuaagucacaacugaagaacaaugccaaagagauuggcaacgggugcuucgaguuuuaccacaaguguaaugacgaaugcauggagagugugaaaaacggaacguaugauuaccccaaguauuccgaagagagcaaauugaauagggagaagaucgacggugucaagcucgaaucuaugggcguguaccagauccuggcuauuuauucaaccgucgccaguagcuuagugcugcuaguuucccucggggcaaucucuuucuggaugugcucgaacggaagccugcagugucggauuugcauauga

SEQ ID NO: 129811 - RNA, 1698 nt, Artificial Sequence
  derived and/or modified sequence opt3 from hemagglutinin__InfluenzaA__AET50441
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaacucacacagucaccggugugucugccagcugcucccauaacggggaaucaaguuuuuaucggaauuuacuguggcuuacgggcaaaaacggauuguaccccaaucugagcaagucuuaugcaaacaauaaagagaaggaaguucuaguacucuggggcgugcaccacccuccaaacaucgggaaccagaaagcccuguaccauacugagaaugcuuacgucuccguggugucaagccacuauagucgcaaguucacccccgaaauagcaaagcgaccuaaaguccguggacaggaggguagaaucaacuacuauuggacacuucuggagccaggcgacacuauuaucuuugaagccaaugggaacuugauugcuccgagguacgccuucgcgcucucucggggauuuggcuccgguaucauaaauagcaacgcacccauggauaagugugacgccaaaugccagaccccucaaggggcuauuaauucgucucugccauuccagaacguucaucccgugacaaucggagaguguccuaaguauguacgcuccgccaaauuaagaauggugaccggccugaggaauauuccaucaauccagagucggggccucuuuggggcaaucgcuggauucauugaagguggcuggacggggauggucgauggaugguacggcuaucaccaccagaacgagcaagguagcggguacgccgcggaccagaaguccacucagaaugccauaaacggcaucacaaauaaagugaacucuguuauugaaaagaugaauacccaguuuacugcagugggaaaggaguucaacaaacuugagcgccgaauggaaaaccugaauaagaaagucgaugacggcuucaucgauauauggacauacaacgcugaguugcuagugcugcucgaaaaugagagaacccuggacuuucaugauagcaacguaaagaaucuuuaugaaaaaguuaagucacaacugaagaacaaugccaaagagauugggaacggaugcuucgaguuuuaccacaaguguaaugacgaaugcauggagagugugaaaaacgguacguaugacuaccccaaguauuccgaagagagcaaauugaauagggagaagaucgauggcgucaagcucgaaucuauggggguguaccagauccuggcuauuuauucaaccgucgccaguagcuuagugcugcuaguuucccucggagcaaucucuuucuggaugugcucgaacggcagccugcagugucggauuugcauauga

SEQ ID NO: 129812 - RNA, 1698 nt, Artificial Sequence
  derived and/or modified sequence opt3 from hemagglutinin__InfluenzaA__AET50442
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaauuuguuaucccggccauuuugcugauuacgaggaacugagagagcaacucucuucggugagcucauucgaaagguuugagaucuucccuaaggagaguuccuggccaacccacacugucacaggugugucugccagcugcucccauaacggggaaucaaguuuuuaucggaauuuacuguggcuuaccggcaaaaacggauuguaccccaaucugagcaagucuuaugcaaacaauaaagagaaggaaguucuaguacucuggggcgugcaccacccuccaaacauagggaaccagaaagcccuguaccauacggagaaugcuuacgucuccguggugucaagccacuauagucgcaaguucacucccgaaaucgcaaagcgaccuaaaguccguggacaggaggguagaauuaacuacuauuggacccuucuggagccaggcgacacaaucauuuuugaagccaaugggaacuugaucgcuccgagguacgccuucgcgcucucucggggauuuggcuccgguauaauuaauagcaacgcacccauggauaagugugacgccaaaugccagacuccucaaggggcuaucaauucgucucugccauuccagaacguucaucccgugaccauuggagaguguccuaaguauguacgcuccgccaaauuaagaauggugacaggccugaggaauaucccaucaauccagagucggggccucuuuggggcaauugcuggauucauagaagguggcuggaccgggauggucgauggaugguacggcuaucaccaccagaacgagcaagguagcggguacgccgcggaccagaaguccacgcagaaugccaucaacggcauuacuaauaaagugaacucuguuaucgaaaagaugaauacacaguuuaccgcagugggaaaggaguucaacaaacuugagcgccgaauggaaaaccugaauaagaaagucgaugacggcuucauagauauuuggacuuacaacgcugaguugcuagugcugcucgaaaaugagagaacacuggacuuucaugauagcaacguaaagaaucuuuaugaaaaaguuaagucacaacugaagaacaaugccaaagagaucgggaacggaugcuucgaguuuuaccacaaguguaaugacgaaugcauggagagugugaaaaacgguaccuaugacuaccccaaguauuccgaagagagcaaauugaauagggagaagaucgauggcgucaagcucgaaucuauggggguguaccagauucuggcuaucuauucaacggucgccaguagcuuagugcugcuaguuucccucggagcaauuucuuucuggaugugcucgaacggcagccugcagugucggauaugcaucuga

SEQ ID NO: 129813 - RNA, 1698 nt, Artificial Sequence
  derived and/or modified sequence opt3 from hemagglutinin__InfluenzaA__AET84163
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaaagucucauuagcaaagaguccuggucuuacaucguugaaaagccaaacccggagaauggaaccuguuaucccggccauuuugcugauuacgaggaacugagagagcaacugucgucagugagcaguuucgaaagguuugagauuuucccuaaggaguccucuuggccaaaccacacugucacaggugugagcgccuccugcucacauaauggggaaaguagcuuuuaucggaaccucuuauggcugaccggaaagaauggccuuuaccccaacuugucuaaguccuaugcaaauaacaaagagaaggaaguacugguucuauggggcgugcaccacccuccaucaaucagcaaccagaaaacgcucuaccauacugagaaugccuacgucaguguggugucuucccacuauagccgcaaguucacccccgaagucgcuaagcgaccuaaaguucgugaccaggaggggagaauaaacuacuauuggacacugcuugagccaggagauacuaucauuuuugaagcaaaugguaaccugaucgccccgagguacgcuuucgccuugucgcggggcuuugggucuggaauuaucaauuccaacgcgcccauggacaagugugaugcaaaaugccagaccccucaaggcgccauaaauucaagucucccauuccagaacgugcaucccguaacaauuggugaguguccuaaguaugugcgcagcgcuaaacugagaauggucaccggguuaaggaauaucccauccauucagucucggggacuguuuggcgccaucgcaggcuucaucgaagggggauggacggguaugguggacggcugguacggguaucaccaccagaacgagcaaggaagcggcuacgcugccgaucagaagucaacucagaaugcgauuaacgguauaacaaauaaaguuaacagugugaucgaaaagaugaauacccaguuuacugccgucgggaaggaguucaacaaacucgagcgccgaauggaaaaccuuaauaagaaaguggacgauggcuucauugacaucuggacauacaacgcagagcuguugguacuacuggaaaaugagagaacccucgauuuucaugacuccaacguuaagaaucuguaugaaaaagugaaaagccaacuuaagaacaaugcuaaagagauaggaaacggcugcuucgaguuuuaccacaaguguaaugacgaaugcauggagucugucaaaaacgggacguaugauuaccccaaguauucagaagagaguaaacugaauagggagaagauugacggagugaaguuggaaagcaugggugucuaccagauccucgccaucuauuccaccguggcuucuucgcugguuuuacuggugagccuaggcgccauuuccuucuggaugugcucaaacgggagucuccagugucggaucugcauuuga

SEQ ID NO: 129814 - RNA, 1698 nt, Artificial Sequence
  derived and/or modified sequence opt3 from hemagglutinin__InfluenzaA__AET84174
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaagugcuaguucucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucauccgcggcuuugggucuggaauaauuaauuccaacgcgcccaugggcaagugugaugcaaaaugccagaccccucaaggugccaucaauagcucgcugccauuccagaacgugcaccccguaacaauuggggaguguccuaaguaugugagaucugcuaaauuaaggauggucaccggacugcggaauaucccauccauccagucacgcggccucuuuggcgccauugcaggguucauagaaggagguuggacgggcaugguggacgggugguacggauaucaucaccagaacgagcaaggcagugguuacgcugccgaucagaaaagcacucagaaugcgaucaacgggauuacaaauaaaguuaacuccgugaucgaaaagaugaauacccaguuuacugccgucggcaaggaguucaacaaacuugagcgaagaauggaaaaccugaauaagaaaguggacgauggauucauagacauuuggacauacaacgcagaguugcuaguacugcucgaaaaugagaggacccuggauuuucacgacucuaacguuaagaaucuuuaugaaaaaguaaagagccaacugaagaacaaugcuaaagagaucggcaacgggugcuucgaguuuuaccauaaguguaaugacgaaugcauggagucagucaaaaacggaacguaugauuaccccaaguauagugaagaguccaaauugaaucgggagaagaucgacggugugaagcucgaaagcaugggcgucuaccagauucuggccaucuauucuaccguggcuucaaguuuaguucugcuagugagccucggggccauuuccuucuggaugugcucuaacggaucgcugcagugucguauaugcaucuga

SEQ ID NO: 129815 - RNA, 1698 nt, Artificial Sequence
  derived and/or modified sequence opt3 from hemagglutinin__InfluenzaA__AET84196
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaaagucucauuagcaaagaguccuggucuuacaucguugaaaagccaaacccggagaauggaaccuguuaucccggccauuuugcugauuacgaggaacugagagagcaacugucgucagugagcaguuucgaaagguuugagauuuucccuaaggaguccucuuggccaaaccacacugucacaggugugagcgccuccugcucacauaauggggaaaguagcuuuuaucggaaccucuuauggcugacccgcaaaaauggacuuuaccccacguugucuaaguccuaugcaaacaauaaagagaaggaaguacugguucuauggggcgugcaccacccuccaucaaucaacgaccagaaaacucucuaccauaccgagaacgccuacgucagcguggugaguucucacuauucccgaaaguucacacccgaaauagcuaagcguccuaaagucagagaucaggagggcaggaucaauuacuauuggacucugcuugagccaggggacaccauuaucuuugaagcaaacggaaaucugauugccccgcgguacgcuuucgccuugagccgcgguuuuggcucggggaucauaaacucuuccgcgcccauggauaagugugacgcaaaaugccagacaccucaaggagccauuaauucaagucucccauuccagaacguucaucccgugaccaucggcgaguguccuaaguauguaagaagcgcuaaacugaggauggugacggguuuacggaauauuccauccauccagucucgcgggcuguuuggagccaucgcaggcuucauugaaggcggguggacuggaauggucgaugguugguacggcuaucaccaccagaacgagcaagggagcggauacgcugccgaccagaagucaacacagaaugcgauaaacggcaucaccaauaaagugaacaguguuauugaaaagaugaauacucaguuuacagccguggguaaggaguucaacaaacucgagcgaagaauggaaaaucuuaacaagaaagucgaugacggguucaucgauauauggaccuacaacgcagagcuguuggugcuacuggaaaaugagaggacgcucgacuuucauaacuccaauguaaagaaccuguaugaaaaaguuaagagccaacuuaagaauaacgcuaaagagauuggcaauggaugcuucgaguuuuaccacaaguguaacgacgaaugcauggagucugugaaaaauggcaccuaugauuaccccaaguauucagaagagaguaaacugaaccgggagaagaucgacggggucaaguuggaaagcaugggaguguaccagauccucgccauuuauuccacagucgcuucuucgcugguguuacugguuagccuaggugccaucuccuucuggaugugcucaaauggcagucuccagugucguauuugcauauga

SEQ ID NO: 129816 - RNA, 1698 nt, Artificial Sequence
  derived and/or modified sequence opt3 from hemagglutinin__InfluenzaA__AET84207
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugccuucauucgaaagguuugagauuuucccaaaggagagcaguuggcccaaccacacugucacagguguguccgccucuugcagccauaauggggaauccucauuuuaucggaacuuacuguggcuuaccggcaaaaauggauuguacccuaaccugaguaagagcuaugcaaauaacaaagagaaggaaguucuaguacucuggggcgugcaccacccacccucuaucaacgaccagaaaacgcuguaccauacugagaaugccuacgucuccguggugucaagccacuauagucgcaaguucaccccugaaauagcuaagcgaccaaaaguccgugaucaggaggggagaaucaacuacuauuggacacuucuggagccgagggacacuauuaucuuugaagcaaauggaaacuugauugcuccccgguacgccuucgcccucucucgcgguuuuggcuccgggaucauaaauagcaacgcgccuauggauaagugugacgcaaaaugccagaccccacaaggagccauuaauucgucucugcccuuccagaacguucauccugugacaaucggcgaguguccaaaguauguaagauccgcuaaauuaaggauggugaccggucugcggaauauucccucaauccagagucgcgggcucuuuggagccaucgcaggcuucauugaaggcggguggacgggaauggucgaugguugguacggcuaucaccaccagaacgagcaagggagcggauacgcugccgaccagaaguccacucagaaugcgauaaacggcaucacaaauaaagugaacucuguuauugaaaagaugaauacccaguuuacugccguggguaaggaguucaacaaacuugagcgaagaauggaaaaccugaauaagaaagucgaugacggguucaucgauauauggacauacaacgcagaguugcuagugcugcucgaaaaugagaggacccuggacuuucaugacagcaacguaaagaaucuuuaugaaaaaguuaagucacaacugaagaacaaugcuaaagagauuggcaacggaugcuucgaguuuuaccacaaguguaaugaugaaugcauggagagugugaaaaacggcacguaugacuacccgaaguauuccgaagagagcaaauugaaucgggagaagaucgauggggucaagcucgaaucuaugggaguguaccagauccuggccauuuauucaaccgucgcuaguagcuuagugcugcuaguuucccucggugccaucucuuucuggaugugcucgaacggcagccugcagugucguauuugcauauga

SEQ ID NO: 129817 - RNA, 1698 nt, Artificial Sequence
  derived and/or modified sequence opt3 from hemagglutinin__InfluenzaA__AET84218
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccaaacaucuccaaucagaaaacgcuguaccauacugagaacgccuacgucucaguggugagcagucacuauucucgcaaguucacccccgaaauagcuaagcgaccuaaaguccgugaccaggaggggagaaucaauuacuauuggacacuucuggagccaggagauacuauuaucuuugaagcauccgguaacuugauugccccgagguacgcuuucgcccucagccggggcuuugggucgggaaucauaaauucuaacgcgcccauggacaagugugaugcaaaaugccagaccccucaaggcgccauuaauuccucacugccauuccagaacguucaucccgugacaaucggugaguguccuaaguauguacgcagugcuaaauuaagaauggugaccgggcugaggaauauuccaagcauccagucccggggacucuuuggcgccaucgcaggcuucauugaagggggauggacggguauggucgacggcugguacggguaucaccaccagaacgagcaaggaucuggcuacgcugccgaucagaaaagcacucagaaugcgauaaacgguaucacaaauaaagugaacucaguuauugaaaagaugaauacccaguuuacugccguggggaaggaguucaacaaacuugagcgccgaauggaaaaccugaauaagaaagucgacgauggcuucaucgacauauggacauacaacgcagaguugcuagugcugcucgaaaaugagagaacccuggauuuucaugacaguaacguaaagaaucuuuaugaaaaaguuaagucccaacugaagaacaaugcuaaagagauuggaaacggcugcuucgaguuuuaccacaaguguaaugacgaaugcauggagagcgugaaaaacgggacguaugauuaccccaaguauucugaagagucaaaauugaauagggagaagaucgacggagucaagcucgaaaguauggguguguaccagauccuggccauuuauagcaccgucgcuuccucuuuagugcugcuaguuucgcucggcgccaucagcuucuggaugugcuccaacgggucacugcagugucggauuugcauauga

SEQ ID NO: 129818 - RNA, 1698 nt, Artificial Sequence
  derived and/or modified sequence opt3 from hemagglutinin__InfluenzaA__AET84229
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccacgcugagcaagucuuaugcaaacaauaaagagaaggaagugcuaguucucuggggcgugcaccacccuccaaacaucgucgaccagaaaacucuguaccgcaccgagaacgccuacguguccguggucucaagccauuauagucgaaaguucacacccgaaauagcuaagcguccuaaaguuagagaucaggaggggaggaucaauuacuauuggacucuucuggagccaggagacaccauuaucuuugaagcaaacgguaauuugauugccccgcgguacgcuuucgcccucucucgcggcuuuggguccggaaucauaaacagcaaugcgcccaugggcaagugugaugcaaaaugccagacaccucaaggugccauuaacucgucucugccauuccagaaugugcaccccguaaccaucggggaguguccuaaguaugugagauccgcuaaauuaaggauggucacgggacugcggaacauuccacccauccagucacgcggccucuuuggcgccaucgcaggguucauugaaggagguuggacuggcaugguggacgggugguacggauaucaucaccagaaugagcaaggcagugguuacgcugccgaucagaaaagcacacagaacgcgauaaaugggaucaccaacaaaguuaauuccgugauugaaaagaugaacacucaguuuacagccgucggcaaggaguucaauaaacuugagcgaagaauggaaaaccugaacaagaaaguggacgauggauucaucgacauauggaccuacaaugcagaguugcuaguacugcucgaaaacgagaggacgcuggauuuucacgacucuaauguuaagaaccuuuaugaaaaaguaaagagccaacugaagaauaacgcuaaagagauuggcaaugggugcuucgaguuuuaccauaaguguaacgacgaaugcauggagucagucaaaaauggaaccuaugauuacccgaaguauagugaagaguccaaauugaaccgggagaagaucgacggugugaagcucgaaagcaugggcgucuaccagauccuggccauuuauucuacaguggcuucaaguuuaguucugcuagugagccucggggccaucuccuucuggaugugcucuaauggaucgcugcagugucguauuugcauauga

SEQ ID NO: 129819 - RNA, 1698 nt, Artificial Sequence
  derived and/or modified sequence opt3 from hemagglutinin__InfluenzaA__AET84240
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggcuacuuugcugauuaugaggaacugagagagcaacucucuucggugagcucauucgaaagguuugagauuuucccuaaggagaguuccuggccaaaccauacugucacaggugugucugccagcugcucccacaauggggaaucaaguuuuuaccggaacuuacuguggcuuaccggcaaaaauggauuguaucccaaccugagcaagucuuacgcaaauaacaaagagaaggaaguucuaguacucuggggcgugcaucacccuccaaacaucgucgaccagaaaacgcuguaccgcacugagaaugccuauguguccguggucucaagccacuacagucgaaaguucacccccgaaauagcuaagcguccuaaaguuagagaucaggaggggaggaucaacuauuacuggacacuucuggagccaggagacacuauuaucuuugaagcaaaugguaacuugauugccccgcgguaugcuuucgcccucucucgcggcuuuggguccggaaucauaaauagcaacgcgcccaugggcaagugugaugcaaaaugccagaccccucaaggugccauuaauucgucucugccauuccagaacgugcaucccguaacaaucggggaguguccuaaguacgugagauccgcuaaauuaaggauggucaccggacugcggaauauuccaucaauccagagucgcggccucuuuggcgccaucgcaggguucauugaaggagguuggacgggcaugguggacgggugguauggauaccaccaucagaacgagcaaggcagcgguuacgcugccgaucagaaguccacucagaaugcgauaaacgggaucacaaauaaaguuaacucugugauugaaaagaugaauacccaguuuacugccgucggcaaggaguucaacaaacuugagcgaagaauggaaaaccugaauaagaaaguggacgauggauucaucgacauauggacauauaacgcagaguugcuaguacugcucgaaaaugagaggacccuggauuuucacgacagcaacguuaagaaucuuuacgaaaaagugaagucacaacugaagaacaaugcuaaagagauuggcaacgggugcuucgaguuuuaucacaaguguaauaacgaaugcauggagagugucaaaaauggaacguacgacuaucccaaguacuccgaagagagcaaauugaaccgggagaagaucgauggugugaagcucgaaucuaugggcgucuaucagauccuggccauuuacucaaccguggcuaguagcuuaguucugcuagugucccucggggccaucucuuucuggaugugcucgaauggaagccugcagugucguauuugcauauga

SEQ ID NO: 129820 - RNA, 1698 nt, Artificial Sequence
  derived and/or modified sequence opt3 from hemagglutinin__InfluenzaA__AET84251
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgucaaucagaaaacgcuguaccgcacugagaacgccuacguguccguggucucaagccauuauagucgaaaguucacccccgaaauagcuaagcguccuaaaguuagagaccaggaggggaggaucaauuacuauuggacacuucuggagccaggagauacuauuaucuuugaagcaaacgguaauuugauugccccgcgguacgcuuucgcccucucucgcggcuuuggguccggaaucauaaacagcaaugcgcccaugggcaagugugacgcaaaaugccagaccccucacggugccauuaacucgugucugccauuccaaaaugugcaucccguaacaaucggggagugcccuaaguaugugagaucugcuaaauuaaggauggucaccggacugcggaacauuccauccauccagucacgcggccucuuuggcgccaucgcaggguucauugaaggagguuggacgggcaugguggaugggugguacggauaucaccaccagaaugagcagggcagugguuacgcugccgaccaaaagagcacucagaacgcgauaaaugggaucacaaacaaaguuaauuccgugauugaaaagaugaacacccaguuuacugccgucggcaaggaguucaacaaacuugagcgaagaauggaaaaucugaacaagaaaguggaugacggauucaucgauauauggacauacaaugcagaguugcuaguacugcucgaaaacgagaggacccuggacuuucaugauucuaauguuaagaaccuuuaugaaaaaguaaagagccagcugaagaauaacgcuaaagagauuggcaauggguguuucgaguuuuaccacaagugcaacgacgaaugcauggagucagucaaaaauggaacguaugacuaccccaaguauagugaagaguccaaauugaacaaggagaagaucgauggugugaaacucgaaagcaugggcgucuaccaaauccuggccauuuauucuaccguggcuucaaguuuaguucugcuagugagccucggggccaucuccuucuggauguguucuaauggaucgcugcagugccggauuuguauauga

SEQ ID NO: 129821 - RNA, 1698 nt, Artificial Sequence
  derived and/or modified sequence opt3 from hemagglutinin__InfluenzaA__AET84262
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccauggauaagugugacgcaaaaugccagaccccucacggcgccauuaauucgugucugccauuccaaaacgugcaucccguaacaaucggugagugcccuaaguaugugagaucugcuaaauuaaggauggucaccgggcugcggaauauuccauccauccagucacgcggacucuuuggcgccaucgcaggcuucauugaagggggauggacggguaugguggauggcugguacggguaucaccaccagaacgagcagggaaguggcuacgcugccgaccaaaagagcacucagaaugcgauaaacgguaucacaaauaaaguuaacuccgugauugaaaagaugaauacccaguuuacugccgucgggaaggaguucaacaaacuugagcgaagaauggaaaaccugaauaagaaaguggaugacggcuucaucgauauauggacauacaacgcagaguugcuaguacugcucgaaaaugagaggacccuggacuuucaugacucuaacguuaagaaucuuuaugaaaaaguaaagagccagcugaagaacaaugcuaaagagauuggaaacggcuguuucgaguuuuaccacaagugcaaugaugaaugcauggagucagucaaaaacgggacguaugacuaccccaaguauagugaagaguccaaauugaaucgggagaagaucgauggagugaagcucgaaagcaugggugucuaccaaauccuggccauuuauucuaccguggcuucaaguuuaguucugcuagugagccucggcgccaucuccuucuggauguguucuaacgggucgcugcagugccguauuuguauauga

SEQ ID NO: 129822 - RNA, 1698 nt, Artificial Sequence; identical to SEQ ID NO: 129749
  derived and/or modified sequence opt3 from hemagglutinin__InfluenzaA__AET84284

SEQ ID NO: 129823 - RNA, 1698 nt, Artificial Sequence
  derived and/or modified sequence opt3 from hemagglutinin__InfluenzaA__AET84306
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgggaaucagaaagcccuguaccauacggagaacgcuuacgucuccguggugucaagccacuauaguauaaaguucacucccgaaaucgcaaagcgcccuaaaguccgagaccaggagggacguauuaauuacuauuggacccuucuggagccaggugauacaaucauuuuugaagccaacggcaauuugaucgcuccgagauacgccuucgcgcucucuaggggguuuggauccggcauaauuaacagcaaugcacccauggacaagugugaugccaaaugccagacuccucaaggugcuaucaacucgucucugccauuccagaauguucaucccgugaccauuggggaguguccuaaguauguacgguccgccaaauuacgcauggugacaggacugagaaacaucccaucaauccagaguaggggccucuuuggcgcaauugcuggguucauagaaggagguuggaccggcauggucgacgggugguacggauaucaccaccagaaugagcaaggcagcgguuacgccgcggaucagaaguccacgcagaacgccaucaaugggauuacuaacaaaguaaauucuguuaucgaaaagaugaacacacaguuuaccgcagugggcaaggaguucaacaaacuugagcggcgcauggaaaaucugaacaagaaagucgacgauggauucauagacauuuggacuuacaaugcugaguugcuagugcugcucgaaaacgagcgaacacuggauuuucaugacagcaauguaaagaaccuuuaugaaaaaguuaagucacaacugaagaauaacgccaaagagaucggcaaugggugcuucgaguuuuaccacaaguguaacgacgaaugcauggagagugugaaaaauggaaccuaugauuaccccaaguauuccgaagagagcaaauugaacagagagaagaucgacggugucaagcucgaaucuaugggcguguaccagauucuggcuaucuauucaacggucgccaguagcuuagugcugcuaguuucccucggggcaauuucuuucuggaugugcucgaauggaagccugcaguguaggauaugcaucuga

SEQ ID NO: 129824 - RNA, 1698 nt, Artificial Sequence
  derived and/or modified sequence opt3 from hemagglutinin__InfluenzaA__AET84339
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccaaccugaguaagagcuaugcaaauaacaaagagaaggaagugcuaguucucuggggcgugcaccacccuccaaacaucgggaaucagaaaacgcuguaccauacugagaacgccuacgucucugugguguccucacacuauagccgaaaguucacccccgaaauagcuaagcguccuaaagucagagaccaggagggaaggaucaauuacuauuggacacuucuggagccaggugauacuauuaucuuugaagcaaacggcaauuugauugccccgcgguacgcuuucgcccucagucgcggguuuggaucuggcaucauaaacuccaaugcgcccauggacaagugugaugcaaaaugccagaccccucaaggugccauuaacagcucgcugccauuccagaauguucaucccgugacaaucggggaguguccuaaguauguaagaucugcuaaauuaaggauggugaccggacugcggaacauuccauccauccagucacgcggccucuuuggcgccaucgcaggguucauugaaggagguuggacgggcauggucgacgggugguacggauaucaccaccagaaugagcaaggcagugguuacgcugccgaucagaaaagcacucagaacgcgauaaaugggaucacaaacaaaguaaauuccguuauugaaaagaugaacacccaguuuacugccgugggcaaggaguucaacaaacuugagcgaagaauggaaaaucugaacaagaaagucgacgauggauucaucgacauauggacauacaaugcagaguugcuagugcugcucgaaaacgagaggacccuggauuuucaugacucuaauguaaagaaccuuuaugaaaaaguuaagagccaacugaagaauaacgcuaaagagauuggcaaugggugcuucgaguuuuaccacaaguguaacgacgaaugcauggagucagugaaaaauggaacguaugauuaccccaaguauagugaagaguccaaauugaaccgggagaagaucgacggugucaagcucgaaagcaugggcguguaccagauccuggccauuuauucuaccgucgcuucaaguuuagugcugcuaguuagccucggggccaucuccuucuggaugugcucuaauggaucgcugcagugucguauuugcauauga

SEQ ID NO: 129825 - RNA, 1698 nt, Artificial Sequence; identical to SEQ ID NO: 129824
  derived and/or modified sequence opt3 from hemagglutinin__InfluenzaA__AET84361

SEQ ID NO: 129826 - RNA, 1698 nt, Artificial Sequence
  derived and/or modified sequence opt3 from hemagglutinin__InfluenzaA__AET84372
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccaaccugaguaagagcuaugcaaauaacaaagagaaggaaguucuaguacucuggggcgugcaccacccuccaaacaucggggaccagaaaacgcuguaccauacugagaaugccuacgucucugugguguccucacacuauagccgaaaguucacccccgaaauagcuaagcguccuaaagucagagaucaggagggaaggaucaacuacuauuggacacuucuggagccaggugacacuauuaucuuugaagcaaauggcaacuugauugccccgcgguacgcuuucgcccucagucgcggguuuggaucuggcaucauaaauuccaacgcgcccauggauaagugugacgcaaaaugccagaccccucaaggugccauuaauagcucgcugccauuccagaacguucaucccgugacaaucggggaguguccuaaguauguaagaucugcuaaauuaaggauggugaccggacugcggaauauuccauccauccagucacgcggccucuuuggcgccaucgcaggguucauugaaggagguuggacgggcauggucgaugggugguacggauaucaccaccagaacgagcaaggcagugguuacgcugccgaccagaaaagcacucagaaugcgauaaacgggaucacaaauaaagugaacuccguuauugaaaagaugaauacccaguuuacugccgugggcaaggaguucaacaaacuugagcgaagaauggaaaaccugaauaagaaagucgaugacggauucaucgauauauggacauacaacgcagaguugcuagugcugcucgaaaaugagaggacccuggacuuucaugacucuaacguaaagaaucuuuaugaaaaaguuaagagccaacugaagaacaaugcuaaagagauuggcaacgggugcuucgaguuuuaccacaaguguaaugaugaaugcauggagucagugaaaaacggaacguaugacuaccccaaguauagugaagaguccaaauugaaucgggagaagaucgauggugucaagcucgaaagcaugggcguguaccagauccuggccauuuauucuaccgucgcuucaaguuuagugcugcuaguuagccucggggccaucuccuucuggaugugcucuaacggaucgcugcagugucguauuugcauauga

SEQ ID NO: 129827 - RNA, 1698 nt, Artificial Sequence
  derived and/or modified sequence opt3 from hemagglutinin__InfluenzaA__AET84394
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccaaccugaguaagagcuaugcaaauaacaaagagaaggaaguucuaguacucuggggcgugcaccacccuccagacaucgggaaccagaaaacgcuguaccauacugagaaugccuacgucucugugguguccucacacuauagccgaaaguucacccccgaaauagcuaagcguccuaaagucagagaucaggagggaaggaucaacuacuauuggacacuucuggagccaggugacacuauuaucuuugaagcaaauggcaacuugauugccccgcgguacgcuuucgcccucagucgcggguuuggaucuggcaucauaaauuccaacgcgcccauggauaagugugacgcaaaaugccagaccccucaaggugccauuaauagcucgcugccauuccagaacguucaucccgugacaaucggggaguguccuaaguauguaagaucugaaaaauuaaggauggugaccggacugcggaauauuccauccauccagucacgcggccucuuuggcgcuaucgccggguucauugagggagguuggacgggcauggucgaugggugguacggauaucaccaccagaacgaacaaggcagugguuacgcagcugaccagaaaagcacucagaaugccauaaacgggaucacaaauaaagugaacuccguuauugagaagaugaauacccaguuuacugcggugggcaaggaguucaacaaacuugaacgaagaauggagaaccugaauaagaaagucgaugacggauucaucgauauauggacauacaacgccgaauugcuagugcugcucgagaaugaaaggacccuggacuuucaugacucuaacguaaagaaucuuuaugagaaaguuaagagccaacugaagaacaaugcaaaagagauuggcaacgggugcuucgaauuuuaccacaaguguaaugaugagugcauggaaucagugaaaaacggaacguaugacuaccccaaguauagugaggaguccaaauugaaucgggaaaagaucgauggugucaagcucgagagcaugggcguguaccagauccuggcuauuuauucuaccgucgccucaaguuuagugcugcuaguuagccucggggcuaucuccuucuggaugugcucuaacggaucgcugcagugucguauuugcauauga

SEQ ID NO: 129828 - RNA, 1698 nt, Artificial Sequence; identical to SEQ ID NO: 127532
  derived and/or modified sequence opt3 from hemagglutinin__InfluenzaA__AET84405

SEQ ID NO: 129829 - RNA, 1698 nt, Artificial Sequence
  derived and/or modified sequence opt3 from hemagglutinin__InfluenzaA__AET84416
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccacgcugaguaagagcuaugcaaacaauaaagagaaggaaguucuaguacucuggggcgugcaccacccuccagacaucggggaucagaaaacucuguaccauaccgagaacgccuacgucucugugguguccucacacuauagccgaaaguucacacccgaaauagcuaagcguccuaaagucagagaccaggagggaaggaucaacuacuauuggacucuucuggagccaggugauaccauuaucuuugaagcaaauggcaacuugauugccccgcgguacgcuuucgcccucagucgcggguuuggaucuggcaucauaaauuccaacgcgcccauggacaagugugaugcaaaaugccagacaccucaaggugccauuaauagcucgcugccauuccagaacguucaucccgugaccaucggggaguguccuaaguauguaagaucugcuaaauuaaggauggugacgggacugcggaauauuccauccauccagucacgcggccucuuuggcgccaucgcaggguucauugaaggagguuggacuggcauggucgacgggugguacggauaucaccaccagaacgagcaaggcagugguuacgcugccgaucagaaaagcacacagaaugcgauaaacgggaucaccaauaaagugaacuccguuauugaaaagaugaauacucaguuuacagccgugggcaaggaguucaacaaacuugagcgaagaauggaaaaucugaacaagaaagucgacgauggauucaucgacauauggaccuacaacgcagaguugcuagugcugcucgaaaaugagaggacgcuggacuuucaugauucuaacguaaagaaucuuuaugaaaaaguuaagagccaacugaagaacaaugcuaaagagauuggcaacgggugcuucgaguuuuaccacaaguguaaugacgaaugcauggagucagugaaaaacggaaccuaugauuaccccaaguauagugaagaguccaaauugaaucgggagaagaucgacggugucaagcucgaaagcaugggcguguaccagauccuggccauuuauucuacagucgcuucaaguuuagugcugcuaguuagccucggggccaucuccuucuggaugugcucuaacggaucgcugcagugucguauuugcauauga

SEQ ID NO: 129830 - RNA, 1698 nt, Artificial Sequence
  derived and/or modified sequence opt3 from hemagglutinin__InfluenzaA__AET84427
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucgggaaucagaaaacgcuguaccauacugagaacgccuacgucuccguggugucaagccacuauagucgcaaguucacccccgaaauagcuaagcgaccuaaaguccgugaccaggagggaagaaucaauuacuauuggacacuucuggagccaggugauacuauuaucuuugaagcaaacggcaauuugauugccccgagguacgcuuucgcccucucucggggguuuggauccggcaucauaaacagcaaugcgcccauggacaagugugaugcaaaaugccagaccccucaaggugccauuaacucgucucugccauuccagaauguucaucccgugacaaucggggaguguccuaaguauguacgcuccgcuaaauuaagaauggugaccggacugaggaacauuccaucaauccagagucggggccucuuuggcgccaucgcaggguucauugaaggagguuggacgggcauggucgacgggugguacggauaucaccaccagaaugagcaaggcagcgguuacgcugccgaucagaaguccacucagaacgcgauaaaugggaucacaaacaaaguaaauucuguuauugaaaagaugaacacccaguuuacugccgugggcaaggaguucaacaaacuugagcgccgaauggaaaaucugaacaagaaagucgacgauggauucaucgacauauggacauacaaugcagaguugcuagugcugcucgaaaacgagagaacccuggauuuucaugacagcaauguaaagaaccuuuaugaaaaaguuaagucacaacugaagaauaacgcuaaagagauuggcaaugggugcuucgaguuuuaccacaaguguaacgacgaaugcauggagagugugaaaaauggaacguaugauuaccccaaguauuccgaagagagcaaauugaacagggagaagaucgacggugucaagcucgaaucuaugggcguguaccagauccuggccauuuauucaaccgucgcuaguagcuuagugcugcuaguuucccucggggccaucucuuucuggaugugcucgaauggaagccugcagugucggauuugcauauga

SEQ ID NO: 129831 - RNA, 1698 nt, Artificial Sequence
  derived and/or modified sequence opt3 from hemagglutinin__InfluenzaA__AET84438
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgggguccagaaaacgcuguacaauacugagaacgccuacguguccguggucucaagccauuauagucgcaaguucacccccgaaauagcuaagcgaccuaaaguucgugaccaggagggaagaaucaauuacuauuggacacuucuggagccaggugauacuauuauguuugaagcaaacggcaauuugaucgccccgagguacgcuuucgcccucucucggggguuuggauccggcauuaucaacagcaaugcgcccauggacaagugugaugcaaaaugccagaccccucaaggugccauaaacucgucucugccauuccagaaugugcaccccguaacaauuggggaguguccuaaguaugugcgcuccgcuaaauuaagaauggucaccggacugaggaacaucccaucaauucagagucggggccucuuuggcgccaucgcaggguucaucgaaggagguuggacgggcaugguggacgggugguacggauaucaucaccagaaugagcaaggcagcgguuacgcugccgaucagaaguccacucagaacgcgauuaaugggauaacaaacaaaguuaauucugugaucgaaaagaugaacacccaguuuacugccgucggcaaggaguucaacaaacuugagcgccgaauggaaaaucugaacaagaaaguggacgauggauucauugacaucuggacauacaaugcagaguugcuaguacugcucgaaaacgagagaacccuggauuuucacgacagcaauguuaagaaccuuuaugaaaaagugaagucacaacugaagaauaacgcuaaagagauaggcaaugggugcuucgaguuuuaccauaaguguaacgacgaaugcauggagagugucaaaaauggaacguaugauuaccccaaguauuccgaagagagcaaauugaacagggagaagauugacggugugaagcucgaaucuaugggcgucuaccagauccuggccaucuauucaaccguggcuaguagcuuaguucugcuagugucccucggggccauuucuuucuggaugugcucgaauggaagccugcagugucggaucugcauuuga

SEQ ID NO: 129832 - RNA, 1698 nt, Artificial Sequence
  derived and/or modified sequence opt3 from hemagglutinin__InfluenzaA__AET84449
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucggggaucagcgcgcccuguaccauacugagaacgcuuacguguccgucgugucaagccacuauagucgaaaauucacccccgaaauagcaaagcguccuaaggugagagaccaggagggaaggaucaauuacuauuggacacuucuggagccaggugauacuauuaucuuugaagccaacggcaauuugauugcuccgcgguacgccuucgcgcucucucgcggguuuggauccggcaucauaaacagcaaugcacccauggacgguugugaugccaaaugccagaccccucaaggggcuauuaacucgucucugccauuccagaauguccaucccguuacaaucggagaguguccuaaguaugugagauccgccaaauuaaggaugguaaccggccugcggaacauuccaucaauccagagucgcggccucuuuggggcaaucgcuggauucauugaagguggcuggacggggaugguggacggaugguacggcuaucaccaccagaaugagcaagguagcggguacgccgcggaucagaaguccacucagaacgccauaaauggcaucacaaacaaagucaauucugugauugaaaagaugaacacccaguuuacugcaguuggaaaagaguucaauaaacuugagcgaagaauggaaaaccugaacaagaaaguggacgauggcuucaucgacauauggacauacaaugcugaguugcuaguccugcucgaaaacgagaggacccuggacuuucaugauagcaaugugaagaaccuuuaugaaaaaguaaagucacaacugaaaaauaacgccaaggagauugggaauggaugcuucgaguuuuaccacaaguguaacgacgaaugcauggagaguguuaaaaaugguacguaugauuaccccaaguauuccgaagagagcaaauugaaccgggagaagaucgacggcgugaaacucgaaucuaugggggucuaccagauccuggcuauuuauucaaccguggccaguagcuuaguccugcuagugucccucggagcaaucucuuucuggaugugcucgaauggcagccugcagugucguauuugcauauga

SEQ ID NO: 129833 - RNA, 1701 nt, Artificial Sequence
  derived and/or modified sequence opt3 from hemagglutinin__InfluenzaA__AET98600
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccguccccaacaaugagcaguucgacaaacuuuacauuuggggagugcaccauccuggcacagauaaggaccagaucuuuuuguaugcccaagcuagcggccguauuacuguaucuaccaagagaucccagcaggccguuaucccaaacauagggucaaggccccgggugcgcaauauuccuagcagaaucaguauuuacuggacaaucgucaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugugaaccgaaucacuuauggugccuguccuagauacgugaaacaaaguacacugaaacuugcuaccgggaugaggaaugucccagagaagcagacucggggaaucuucggcgccauugcaggcuuuaucgaaaacgggugggagggaaugguugaugguugguauggcuuccgucaccagaauagcgaggggcgcggacaagcugccgaccugaaguccacacaggcggccauugaucagauaaacggcaaauugaauagacucaucgguaagaccaacgaaaaauuccaccagauugagaaggaauuuucugagguggaagggaggauccaagaccuggagaaguacguagaggauacgaaaaucgacuuauggagcuauaacgcagaacugcucguggcucuugagaaucagcauaccauugaucugacagacucagaaaugaacaaguuguucgagaaaacuaagaaacagcuacgggaaaaugccgaggauaugggcaacggaugcuuuaccauauaccacaagugugacaaugcuugcaucggcaguauucgaaacgggacauaugaucauaaugucuaccgcgacgaggcccugaacaauagauuccagaucaagggaguggaacucaaauccgguuacaaggacuggauucuguggaucagcuuugcaauaucuugcuuccuucuguguguugccuugcucggcuuuaucaugugggcuugccaaaaagggaacauuagguguaauaucugcauuuga

SEQ ID NO: 129834 - RNA, 1701 nt, Artificial Sequence
  derived and/or modified sequence opt3 from hemagglutinin__InfluenzaA__AEV76874
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacagcaaguagcugguccuacauuguugagaccucuucgucagacaacggaacuugcuauccaggcgauuucaucgacuacgaagaguugagggagcagcucagcaguguguccucuuuugaacgguucgagauuuuuccgaagacaagcuccuggcccaaucacgauucaaacaagggugucaccgccgcuuguccucaugcaggggccaaaggauucuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguuugucggaacaagccgcuauaguaagaaauucaauccugagauugagauccgaccaaaggugcgugaucaggaagguagaaugaacuacuauuggacuuugguggagcccggcgacaaaauuaccuuugaagcgacagggaaccuggucguuccuagguacgcauucgccauggagcggaaugcuggaucuggcaucauaauuuccgauaccccagugcaugacugcaacacgacuugucaaacaccgaagggugccaucaauaccagccuacccuuucagaacauucacccuaucacuaucgggaaaugcccaaaguauguaaagucgacaaaacuccgccuggcaaccggacuuagaaaugugcccucuauucaguccaggggccuguucggcgcuauagccggguuuaucgaaggagguuggacgggcauggucgacgggugguacggauaucaucaccagaacgagcaaggcucagguuacgcggccgauuugaagaguacccagaaugcaauugacaaaaucacaaacaaggugaauagcguuauagagaaaaugaacacucaguucaccgcuguggggaaggaguucaaucaccucgaaaagcggauugaaaaccugaauaaaaaggucgaugacggcuuuuuagauaucuggacauacaacgccgagcugcucgugcuucuggaaaaugagcgcacuuuggacuaucaugauuccaacguuaaaaaccuauacgagaagguacgaaaucagcugaaaaacaaugcuaaggaaaucggaaacggcuguuucgaguuuuaucacaagugcgacaauaccuguauggaaucugugaaaaacgggacauacgauuauccuaaguacagcgaggaagccaaacucaauagagaggagauugacggagucaagcuggaaucaaccaggaucuaucaaauucuugcaauauacaguacuguggccuccagccuggucuuggugguuucucucggugcuaucucauucuggaugugcaguaacggcagccugcagugccggauuuguaucuga

SEQ ID NO: 129835 - RNA, 1701 nt, Artificial Sequence; identical to SEQ ID NO: 124685
  derived and/or modified sequence opt3 from hemagglutinin__InfluenzaA__AEW10574

SEQ ID NO: 129836 - RNA, 1701 nt, Artificial Sequence; identical to SEQ ID NO: 124685
  derived and/or modified sequence opt3 from hemagglutinin__InfluenzaA__AEW10584

SEQ ID NO: 129837 - RNA, 1701 nt, Artificial Sequence; identical to SEQ ID NO: 125038
  derived and/or modified sequence opt3 from hemagglutinin__InfluenzaA__AEW10594

SEQ ID NO: 129838 - RNA, 1701 nt, Artificial Sequence; identical to SEQ ID NO: 125038
  derived and/or modified sequence opt3 from hemagglutinin__InfluenzaA__AEW10604

SEQ ID NO: 129839 - RNA, 1701 nt, Artificial Sequence; identical to SEQ ID NO: 125038
  derived and/or modified sequence opt3 from hemagglutinin__InfluenzaA__AEW10614

SEQ ID NO: 129840 - RNA, 1701 nt, Artificial Sequence; identical to SEQ ID NO: 125038
  derived and/or modified sequence opt3 from hemagglutinin__InfluenzaA__AEW10624

SEQ ID NO: 129841 - RNA, 1701 nt, Artificial Sequence; identical to SEQ ID NO: 124685
  derived and/or modified sequence opt3 from hemagglutinin__InfluenzaA__AEW10634

SEQ ID NO: 129842 - RNA, 1701 nt, Artificial Sequence; identical to SEQ ID NO: 124672
  derived and/or modified sequence opt3 from hemagglutinin__InfluenzaA__AEW10644

SEQ ID NO: 129843 - RNA, 1701 nt, Artificial Sequence
  derived and/or modified sequence opt3 from hemagglutinin__InfluenzaA__AEW10654
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucagcugaucaacagagcuuguaccagaaugccgacgcguacguguucgucgggaguucucgcuauuccaagaaauuuaagccugagauugcaauccgaccaaaagugcgugaucaggagggaagaaugaacuacuauuggacucugguggaacccggugacaagauuaccuucgaggccacaggcaaccuagucguuccuagguacgcuuuugccauggaacggaaugcagggagcggaaucauaauuucggauacuccagugcaugacugcaacaccacaugucaaaccccgaaaggcgcuaucaauacgucucuccccuuccagaacauucacccuaucacuaucgguaagugcccaaaguauguaaaauccacaaagcugcgccuugccaccgggcugagaaaugugcccucaauucagaguaggggauuguuuggcgcgauagccggcuucaucgaagggggauggacugguauggucgacggcugguacggguaucaucaccagaacgaacaaggaagcggcuacgcagcugaucucaaauccacacagaaugccauugacgagaucaccaacaagguaaauucuguuauagagaaaaugaacacgcaguuuaccgcuguggguaaggaguucaaucaccuggaaaagcggauugaaaacuuaaauaaaaaggucgaugacggguuccuggauaucuggacauacaacgccgagcuccuugugcuguuggaaaaugagcgcacucuagacuaucaugauagcaacgugaaaaaccuguacgagaagguucgaucacagcucaaaaauaacgcaaaggaaaucggcaauggauguuuugaguucuaucacaagugcgacaacaccuguauggaaagugugaaaaauggcacauacgauuauccuaaguacuccgaggaagccaaacugaacagagaggagauugacggggucaaacuugaaagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 129844 - RNA, 1701 nt, Artificial Sequence; identical to SEQ ID NO: 124672
  derived and/or modified sequence opt3 from hemagglutinin__InfluenzaA__AEW10664

SEQ ID NO: 129845 - RNA, 1701 nt, Artificial Sequence
  derived and/or modified sequence opt3 from hemagglutinin__InfluenzaA__AEW10674
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcagaagccaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucgggaacggcuguuuugaguucuaucacaagugcgacaauacauguauggagagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 129846 - RNA, 1701 nt, Artificial Sequence; identical to SEQ ID NO: 124685
  derived and/or modified sequence opt3 from hemagglutinin__InfluenzaA__AEW10684

SEQ ID NO: 129847 - RNA, 1701 nt, Artificial Sequence; identical to SEQ ID NO: 124672
  derived and/or modified sequence opt3 from hemagglutinin__InfluenzaA__AEW10694

SEQ ID NO: 129848 - RNA, 1701 nt, Artificial Sequence; identical to SEQ ID NO: 124672
  derived and/or modified sequence opt3 from hemagglutinin__InfluenzaA__AEW10704

SEQ ID NO: 129849 - RNA, 1701 nt, Artificial Sequence; identical to SEQ ID NO: 129843
  derived and/or modified sequence opt3 from hemagglutinin__InfluenzaA__AEW10724

SEQ ID NO: 129850 - RNA, 1701 nt, Artificial Sequence; identical to SEQ ID NO: 124685
  derived and/or modified sequence opt3 from hemagglutinin__InfluenzaA__AEW10734

SEQ ID NO: 129851 - RNA, 1701 nt, Artificial Sequence
  derived and/or modified sequence opt3 from hemagglutinin__InfluenzaA__AEW10744
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacugagcaggggauuguuuggcgcgaucgccggcuucauugaagggggauggacugguauggucgacggcugguacggguaucaucaccagaaugaacagggauccggcuacgcagcugaucucaaaucuacacaaaacgccaucgacgagauaaccaauaaggugaacagcguuauugagaaaaugaauacgcaguuuaccgcuguggguaaggaguucaaccaccuggagaagcggaucgaaaauuuaaacaaaaaggucgaugacggguuccuggauaucuggacauacaaugccgagcuccuugugcuguuggaaaacgagcgcacucuagacuaucaugauucaaauguaaagaaccuguacgagaagguucgaagucagcucaaaaacaaugcaaaggaaauuggcaacggauguuuugaguucuaucacaagugcgacaauaccuguauggaauccgugaaaaacggcacauacgauuauccuaaguacagcgaggaagccaaacugaauagagaggagaucgacggggucaaacuugaaucuacuaggauuuaucagauacuggcuaucuacucaaccguggcgaguagcuugguccucgugguuucccugggagcaauuucuuuuuggaugugcucgaacgguagcuuacaaugccggaucuguaucuga

SEQ ID NO: 129852 - RNA, 1701 nt, Artificial Sequence; identical to SEQ ID NO: 129851
  derived and/or modified sequence opt3 from hemagglutinin__InfluenzaA__AEW10754

SEQ ID NO: 129853 - RNA, 1701 nt, Artificial Sequence
  derived and/or modified sequence opt3 from hemagglutinin__InfluenzaA__AEW10764
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccaaugcguacguguucgucgggucuucccgcuauagcaagaaauuuaagccugagaucgcaauucgaccaaaagugcgugaccaggagggaagaaugaacuacuauuggacuuugguggaacccggugauaagaucaccuucgaggccacaggcaaccuggucguuccuagguacgcuuuugccauggaacggaaugcagggucgggaauaauuaucucugacacuccagugcaugauugcaacaccacaugucaaaccccgaaaggcgcuauuaauacgucccuacccuuccagaacauccacccuaucacuauugguaagugcccaaaguauguaaaaucaacaaagcuccgccuggccaccgggcuuagaaaugugcccaguauacagagcaggggacuguuuggcgcgaucgccggcuucauugaagggggauggacugguauggucgacggcugguacggguaucaucaccagaacgaacaaggauccggcuacgcagcugacuugaaaucuacacagaaugccaucgaugagauaaccaacaaggugaauagcguuauugagaaaaugaacacgcaguuuaccgcuguggguaaggaguucaaucaccucgagaagcggaucgaaaaccugaauaaaaaggucgacgauggguucuuagacaucuggacauacaacgccgagcugcucgugcuucuggaaaaugagcgcacuuuggauuaucaugacucaaacguuaaaaaccuauacgagaagguacgaagucagcugaaaaauaacgcaaaggaaauuggcaauggauguuuugaguucuaucacaagugcgauaacaccuguauggaauccgugaaaaauggcacauacgacuauccuaaguacagcgaggaagccaaacucaacagagaggagaucgauggggucaagcuggaaucuacuaggauuuaucaaauacuugcuaucuacucaaccguggcgaguagccuggucuuggugguuucccucggagcaauuucuuuuuggaugugcucgaaugguagccugcagugccggaucuguaucuga

SEQ ID NO: 129854 - RNA, 1701 nt, Artificial Sequence; identical to SEQ ID NO: 124929
  derived and/or modified sequence opt3 from hemagglutinin__InfluenzaA__AEW10774

SEQ ID NO: 129855 - RNA, 1701 nt, Artificial Sequence; identical to SEQ ID NO: 124672
  derived and/or modified sequence opt3 from hemagglutinin__InfluenzaA__AEW10784

SEQ ID NO: 129856 - RNA, 1701 nt, Artificial Sequence; identical to SEQ ID NO: 124672
  derived and/or modified sequence opt3 from hemagglutinin__InfluenzaA__AEW10794

SEQ ID NO: 129857 - RNA, 1701 nt, Artificial Sequence; identical to SEQ ID NO: 124865
  derived and/or modified sequence opt3 from hemagglutinin__InfluenzaA__AEW10804

SEQ ID NO: 129858 - RNA, 1701 nt, Artificial Sequence; identical to SEQ ID NO: 124683
  derived and/or modified sequence opt3 from hemagglutinin__InfluenzaA__AEW10814

SEQ ID NO: 129859 - RNA, 1701 nt, Artificial Sequence; identical to SEQ ID NO: 124776
  derived and/or modified sequence opt3 from hemagglutinin__InfluenzaA__AEW10824

SEQ ID NO: 129860 - RNA, 1701 nt, Artificial Sequence; identical to SEQ ID NO: 124672
  derived and/or modified sequence opt3 from hemagglutinin__InfluenzaA__AEW10834

SEQ ID NO: 129861 - RNA, 1701 nt, Artificial Sequence; identical to SEQ ID NO: 124865
  derived and/or modified sequence opt3 from hemagglutinin__InfluenzaA__AEW10844

SEQ ID NO: 129862 - RNA, 1701 nt, Artificial Sequence
  derived and/or modified sequence opt3 from hemagglutinin__InfluenzaA__AEW10854
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucacuauucgaccaaaagugcgugaucaggagggaagaaugaauuacuauuggaccuugguggaacccggugacaagaucacauucgaggcaacuggcaaccuggucguuccuagguacgccuuugcuauggaacggaacgccgggucgggaauaauuaucucugauaccccagugcaugacugcaauacaaccugucaaacgccgaaaggcgcaauuaacacuucccuacccuuccagaauauccacccuaucacaauugguaagugcccaaaguauguaaaaucaaccaagcuccgccuggcuacugggcuuagaaacgugcccaguauacagagcaggggacuguuuggcgccaucgcgggcuucauugaagggggauggacagguauggucgacggcugguacggguaucaucaccagaaugaacaaggauccggcuacgccgcagauuugaaaucuacccagaacgcuaucgacgagauaacgaauaaggugaacagcguuauugagaaaaugaauacccaguuuacagccguggguaaggaguucaaccaccucgagaagcggaucgaaaaucugaacaaaaaggucgaugacggguucuuagauaucuggacuuacaaugcugagcugcucgugcuucuggaaaacgagcgcaccuuggacuaucaugauucaaauguuaaaaaccuauacgagaagguacgaagucagcugaaaaacaaugccaaggaaauuggcaacggauguuuugaguucuaucacaagugcgacaauacauguauggaauccgugaaaaacggcacuuacgauuauccuaaguacagcgaggaagcaaaacucaauagagaggagaucgacggggucaagcuggaaucuaccaggauuuaucaaauacuugccaucuacucaacaguggcuaguagccuggucuuggugguuucccucggagcgauuucuuuuuggaugugcucgaacgguagccugcagugccggaucuguaucuga

SEQ ID NO: 129863 - RNA, 1701 nt, Artificial Sequence; identical to SEQ ID NO: 124865
  derived and/or modified sequence opt3 from hemagglutinin__InfluenzaA__AEW10864

SEQ ID NO: 129864 - RNA, 1701 nt, Artificial Sequence; identical to SEQ ID NO: 124865
  derived and/or modified sequence opt3 from hemagglutinin__InfluenzaA__AEW10874

SEQ ID NO: 129865 - RNA, 1701 nt, Artificial Sequence; identical to SEQ ID NO: 124865
  derived and/or modified sequence opt3 from hemagglutinin__InfluenzaA__AEW10884

SEQ ID NO: 129866 - RNA, 1701 nt, Artificial Sequence; identical to SEQ ID NO: 124672
  derived and/or modified sequence opt3 from hemagglutinin__InfluenzaA__AEW10894

SEQ ID NO: 129867 - RNA, 1701 nt, Artificial Sequence; identical to SEQ ID NO: 124865
  derived and/or modified sequence opt3 from hemagglutinin__InfluenzaA__AEW10904

SEQ ID NO: 129868 - RNA, 1701 nt, Artificial Sequence; identical to SEQ ID NO: 124865
  derived and/or modified sequence opt3 from hemagglutinin__InfluenzaA__AEW10914

SEQ ID NO: 129869 - RNA, 1701 nt, Artificial Sequence; identical to SEQ ID NO: 124672
  derived and/or modified sequence opt3 from hemagglutinin__InfluenzaA__AEW10924

SEQ ID NO: 129870 - RNA, 1701 nt, Artificial Sequence; identical to SEQ ID NO: 124672
  derived and/or modified sequence opt3 from hemagglutinin__InfluenzaA__AEW10934

SEQ ID NO: 129871 - RNA, 1701 nt, Artificial Sequence; identical to SEQ ID NO: 124865
  derived and/or modified sequence opt3 from hemagglutinin__InfluenzaA__AEW10944

SEQ ID NO: 129872 - RNA, 1701 nt, Artificial Sequence; identical to SEQ ID NO: 124685
  derived and/or modified sequence opt3 from hemagglutinin__InfluenzaA__AEW10954

SEQ ID NO: 129873 - RNA, 1701 nt, Artificial Sequence; identical to SEQ ID NO: 124685
  derived and/or modified sequence opt3 from hemagglutinin__InfluenzaA__AEW10964

SEQ ID NO: 129874 - RNA, 1701 nt, Artificial Sequence; identical to SEQ ID NO: 124865
  derived and/or modified sequence opt3 from hemagglutinin__InfluenzaA__AEW10974

SEQ ID NO: 129875 - RNA, 1701 nt, Artificial Sequence; identical to SEQ ID NO: 124685
  derived and/or modified sequence opt3 from hemagglutinin__InfluenzaA__AEW10984

SEQ ID NO: 129876 - RNA, 1701 nt, Artificial Sequence; identical to SEQ ID NO: 124685
  derived and/or modified sequence opt3 from hemagglutinin__InfluenzaA__AEW10994

SEQ ID NO: 129877 - RNA, 1701 nt, Artificial Sequence; identical to SEQ ID NO: 124685
  derived and/or modified sequence opt3 from hemagglutinin__InfluenzaA__AEW11004

SEQ ID NO: 129878 - RNA, 1701 nt, Artificial Sequence; identical to SEQ ID NO: 124685
  derived and/or modified sequence opt3 from hemagglutinin__InfluenzaA__AEW11014

SEQ ID NO: 129879 - RNA, 1701 nt, Artificial Sequence; identical to SEQ ID NO: 124685
  derived and/or modified sequence opt3 from hemagglutinin__InfluenzaA__AEW11024

SEQ ID NO: 129880 - RNA, 1701 nt, Artificial Sequence; identical to SEQ ID NO: 124685
  derived and/or modified sequence opt3 from hemagglutinin__InfluenzaA__AEW11034

SEQ ID NO: 129881 - RNA, 1701 nt, Artificial Sequence; identical to SEQ ID NO: 124865
  derived and/or modified sequence opt3 from hemagglutinin__InfluenzaA__AEW11044

SEQ ID NO: 129882 - RNA, 1701 nt, Artificial Sequence; identical to SEQ ID NO: 124685
  derived and/or modified sequence opt3 from hemagglutinin__InfluenzaA__AEW11054

SEQ ID NO: 129883 - RNA, 1701 nt, Artificial Sequence; identical to SEQ ID NO: 124672
  derived and/or modified sequence opt3 from hemagglutinin__InfluenzaA__AEW11064

SEQ ID NO: 129884 - RNA, 1701 nt, Artificial Sequence; identical to SEQ ID NO: 124672
  derived and/or modified sequence opt3 from hemagglutinin__InfluenzaA__AEW11074

SEQ ID NO: 129885 - RNA, 1701 nt, Artificial Sequence
  derived and/or modified sequence opt3 from hemagglutinin__InfluenzaA__AEW11084
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuugucugcaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucaacgagcgcugaucaacagagucuguaccagaacgccgacgcguacguguucgucgggucuucccgcuauagcaagaaauuuaagcccgagauugcaauccgaccuaaagugcgugaucaggagggaagaaugaauuacuauuggacucuaguggaaccaggugacaagauuaccuucgaggccacaggcaaccucgucguucccagguacgcuuuugccauggaacggaacgcagggucgggaaucauaauuucugauacuccugugcaugacugcaauaccacaugucaaaccccaaaaggcgcuaucaacacgucccugccguuccagaauauucaccccaucacuaucgguaagugcccuaaguauguaaaaucaacaaaacuucgccuggccaccggguugagaaacgugccaaguauucagagcaggggacucuuuggcgcgauagccggcuucaucgaagggggauggacugguauggucgacggcugguacggguaucaucaccagaaugaacaaggauccggcuacgcagcugaucugaaaucuacacagaacgccauugacgagaucaccaauaaggugaacagcguuauagagaaaaugaauacgcaguuuaccgcuguggguaaggaguucaaccacuuagaaaagcggauugaaaaucugaacaaaaaggucgaugacggguuccucgauaucuggacauacaaugccgagcuucugguguugcuagaaaacgagcgcacucuggacuaucaugauucaaauguaaagaaccucuacgagaagguucgaagucagcugaaaaacaaugcaaaggaaaucggcaacggauguuuugaguucuaucacaagugcgacaauaccuguauggaauccgugaaaaacggcacauacgauuaucccaaguacagcgaggaagccaaacuuaauagagaggagauugacggggucaagcuggaaucuacuaggaucuaucaaauuuuggcuauauacucaaccguggcgaguagccucguccuggugguuuccuuaggagcaaucucuuuuuggaugugcucgaacgguagccugcagugccggauuuguaucuga

SEQ ID NO: 129886 - RNA, 1701 nt, Artificial Sequence; identical to SEQ ID NO: 124672
  derived and/or modified sequence opt3 from hemagglutinin__InfluenzaA__AEW11094

SEQ ID NO: 129887 - RNA, 1701 nt, Artificial Sequence; identical to SEQ ID NO: 124672
  derived and/or modified sequence opt3 from hemagglutinin__InfluenzaA__AEW11104

SEQ ID NO: 129888 - RNA, 1701 nt, Artificial Sequence; identical to SEQ ID NO: 124685
  derived and/or modified sequence opt3 from hemagglutinin__InfluenzaA__AEW11114

SEQ ID NO: 129889 - RNA, 1701 nt, Artificial Sequence
  derived and/or modified sequence opt3 from hemagglutinin__InfluenzaA__AEW11124
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguuuguaaaaucaacaaagcugcgccuugccaccgggcugagaaacgugcccaguauucagagcaggggauuguucggcgcgauagccggcuuuaucgaagggggauggacugguauggucgacggcugguauggguaccaucaccagaaugaacaaggauccggcuaugcagcugaucucaaaucuacacagaacgccauugacgagaucaccaauaaggugaacagcguuauagagaaaaugaauacgcaguucaccgcuguggguaaggaguucaaccaccuggaaaagcggauugaaaauuuaaacaaaaaggucgaugacggguuucuggauaucuggacauacaaugccgagcuccuugugcuguuggaaaacgagcgcacucuagacuaccaugauucaaauguaaagaaccuguaugagaagguucgaagucagcucaaaaacaaugcaaaggaaaucggcaacggauguuucgaguuuuaccacaagugcgacaauaccuguauggaauccgugaaaaacggcacauaugauuacccuaaguauagcgaggaagccaaacugaauagagaggagauugacggggucaaacuugaaucuacuaggaucuaccaaauucuggcuauauauucaaccguggcgaguagcuugguccucgugguuucccugggagcaaucucuuucuggaugugcucgaacgguagcuuacagugccggauuuguaucuga

SEQ ID NO: 129890 - RNA, 1701 nt, Artificial Sequence
  derived and/or modified sequence opt3 from hemagglutinin__InfluenzaA__AEW11134
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauaaggaggagaucgacggggucaaacuggaaucuacuagaauuuaucaaauacuugcuaucuacucaaccguggcgaguagccuggucuuggugguuucccucggagcaauuucuuuuuggaugugcucgaacgguagccugcagugcaggaucuguaucuga

SEQ ID NO: 129891 - RNA, 1701 nt, Artificial Sequence; identical to SEQ ID NO: 124685
  derived and/or modified sequence opt3 from hemagglutinin__InfluenzaA__AEW11144

SEQ ID NO: 129892 - RNA, 1701 nt, Artificial Sequence; identical to SEQ ID NO: 124685
  derived and/or modified sequence opt3 from hemagglutinin__InfluenzaA__AEW11154

SEQ ID NO: 129893 - RNA, 1701 nt, Artificial Sequence; identical to SEQ ID NO: 129885
  derived and/or modified sequence opt3 from hemagglutinin__InfluenzaA__AEW11164

SEQ ID NO: 129894 - RNA, 1701 nt, Artificial Sequence; identical to SEQ ID NO: 129885
  derived and/or modified sequence opt3 from hemagglutinin__InfluenzaA__AEW11174

SEQ ID NO: 129895 - RNA, 1701 nt, Artificial Sequence; identical to SEQ ID NO: 124685
  derived and/or modified sequence opt3 from hemagglutinin__InfluenzaA__AEW11184

SEQ ID NO: 129896 - RNA, 1701 nt, Artificial Sequence; identical to SEQ ID NO: 124672
  derived and/or modified sequence opt3 from hemagglutinin__InfluenzaA__AEW11194

SEQ ID NO: 129897 - RNA, 1701 nt, Artificial Sequence; identical to SEQ ID NO: 124685
  derived and/or modified sequence opt3 from hemagglutinin__InfluenzaA__AEW11204

SEQ ID NO: 129898 - RNA, 1701 nt, Artificial Sequence; identical to SEQ ID NO: 124685
  derived and/or modified sequence opt3 from hemagglutinin__InfluenzaA__AEW11214

SEQ ID NO: 129899 - RNA, 1701 nt, Artificial Sequence; identical to SEQ ID NO: 124865
  derived and/or modified sequence opt3 from hemagglutinin__InfluenzaA__AEW11224

SEQ ID NO: 129900 - RNA, 1701 nt, Artificial Sequence; identical to SEQ ID NO: 124685
  derived and/or modified sequence opt3 from hemagglutinin__InfluenzaA__AEW11234

SEQ ID NO: 129901 - RNA, 1701 nt, Artificial Sequence; identical to SEQ ID NO: 124685
  derived and/or modified sequence opt3 from hemagglutinin__InfluenzaA__AEW11244

SEQ ID NO: 129902 - RNA, 1701 nt, Artificial Sequence
  derived and/or modified sequence opt3 from hemagglutinin__InfluenzaA__AEW11254
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuugucugcaugcaggggccaaaaguuuuuauaagaaucucaucugguuagugaaaaagggaaacagcuacccuaaacugucuaaguccuauauaaaugacaagggcaaagaaguacuuguuuuguggggcauccaccacccaucagcuagcgccgaucaacagagucuguaccagaacgcggacgcauacguguucgucgggucuucccgcuauagcaagaaagugaagcccgagauugccauccgaccuaaagugcgugaucaggagggaagaaugaauuacuauuggacgcuagucgaaccaggugacaagauuacuuuugaggcuaccggcaaccucguugugcccagguacgccuucgcaauggaacggaacgcugggucgggaaucauaauuucugauacaccuguacaugacugcaauacuaccugucaaacaccaaaaggcgccaucaacaccucccugccguuucagaauauucaccccaucacgaucgguaagugcccuaaguaugugaaaucaacuaaacuucgccuggcgacaggguugagaaacgucccaaguauucagagcaggggacucuucggcgccauagcaggcuuuaucgaagggggauggaccgguaugguggacggcugguacggguaucaucaccagaaugaacaaggauccggcuacgcugccgaucugaagucuacucagaacgcuauugacgagaucacaaauaagguuaacagcgugauagagaaaaugaauacccaguucacggccgucgguaaggaauuuaaccacuuagagaagcggauugaaaaucugaacaaaaagguggaugacggguuccucgauaucuggaccuacaaugcagagcuucugguauugcuagaaaacgagcgcacacuggacuaucaugauucaaauguuaaaaaccucuacgagaaggugcgaagucagcugaaaaacaaugccaaggaaaucggcaacggauguuucgaguuuuaucacaagugcgacaauacuuguauggaauccgucaaaaacggcaccuacgauuaucccaaguacagcgaggaagcuaaacuuaauagagaggagauugacggggugaagcuggaaucuacaaggaucuaucaaauuuuggcgauauacucaacugucgcaaguagccucgugcugguuguguccuuaggagccaucucuuucuggaugugcucgaacgguagccugcagugccggauuuguaucuga

SEQ ID NO: 129903 - RNA, 1701 nt, Artificial Sequence; identical to SEQ ID NO: 124672
  derived and/or modified sequence opt3 from hemagglutinin__InfluenzaA__AEW11263

SEQ ID NO: 129904 - RNA, 1701 nt, Artificial Sequence; identical to SEQ ID NO: 124672
  derived and/or modified sequence opt3 from hemagglutinin__InfluenzaA__AEW11273

SEQ ID NO: 129905 - RNA, 1701 nt, Artificial Sequence; identical to SEQ ID NO: 124672
  derived and/or modified sequence opt3 from hemagglutinin__InfluenzaA__AEW11283

SEQ ID NO: 129906 - RNA, 1701 nt, Artificial Sequence; identical to SEQ ID NO: 124672
  derived and/or modified sequence opt3 from hemagglutinin__InfluenzaA__AEW11293

SEQ ID NO: 129907 - RNA, 1701 nt, Artificial Sequence
  derived and/or modified sequence opt3 from hemagglutinin__InfluenzaA__AEW11303
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggguguguauuuga

SEQ ID NO: 129908 - RNA, 1701 nt, Artificial Sequence; identical to SEQ ID NO: 124672
  derived and/or modified sequence opt3 from hemagglutinin__InfluenzaA__AEW11313

SEQ ID NO: 129909 - RNA, 1701 nt, Artificial Sequence
  derived and/or modified sequence opt3 from hemagglutinin__InfluenzaA__AEW11323
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcguggacaggaggguagaaugaauuacuauuggacccugguggaacccggcgauaagauuacauucgaggccacugggaaccuagucguuccuagguacgcuuuugccauggaacggaacgcaggaagcggcaucauaauuucggacaccccagugcaugauugcaauacaaccugucaaacgccgaaaggugcuguaaacacuucucuccccuuccagaauauccacccuauuacaaucgggaagugcccaaaguaugugaaauccaccaagcugcgccuugccacuggacugagaaacguccccucaauccagaguaggggcuuguuuggcgcgauugccggguucauagagggagguuggacaggcaugguggacgggugguacggauaucaucaccagaaugaacaaggcagcgguuacgcagcugaccucaaauccacccagaacgccaucgaugagauuacgaauaagguuaacucugugaucgagaaaaugaauacccaguuuacagcugucgggaaggaguucaaccaccuggagaagcggauagaaaauuuaaacaaaaagguggacgauggcuuccuggacauuuggacuuacaaugccgagcuccuuguacuguuggaaaacgagcgcacccuagauuaucaugacagcaauguuaaaaaccuguacgagaaggugcgaucacagcucaaaaacaaugcaaaggaaaucggaaacggcuguuuugaguucuaucacaagugcgauaauacauguauggaaagugucaaaaacgggacuuacgacuauccuaaguacuccgaggaagccaaacugaauagagaggagaucgauggagugaaacuugaaagcaccaggauuuaucaaauccuggcuauuuacucuacagucgcgucaaguuuggugcucguugugagccugggugcaauauccuuuuggaugugcucuaacggcucguuacagugccggaucuguauuuga

SEQ ID NO: 129910 - RNA, 1701 nt, Artificial Sequence
  derived and/or modified sequence opt3 from hemagglutinin__InfluenzaA__AEW22712
augaaggccauccuggugguccuccuuuacaccuucgcuacagcaaacgccgacacucugugcauuggcuaucacgcgaauaacagcacggauaccauagacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggaacucagggagcagcugagcaguguuuccucuuucgaacgguuugagaucuucccgaagacaagcuccuggcccaaucacgauucaaacaagggugugaccgccgcuuguccucaugcaggggccaaaggauuuuauaagaaucugauauggcucgucaaaaagggcaacaguuacccaaaauuaagcaagucuuauaucaaugacaagggcaaagaagugcugguacuuugggggauucaccaccccuccacgacugcugaucaacagucauuguaccagaacgccgacaccuacguuuucgugggaacaagccgcuauaguaagaaauuuaagccugagaucgcgauucgaccaaaaguccgugaucaggaggguagaaugaauuacuauuggacucuggugaagcccggcgacaaaaucaccuucgaagcaacagggaaccuaguggucccuagguacgccuuugcuauggagcggaacgccggaucuggcauaauuaucuccgauaccccaguucaugacugcaauacgacuugucaaacaccgaagggugcaauuaacaccagccuccccuuccagaauauccacccuaucacuauugggaagugcccaaaauaugugaagucgacaaaacugcgccuugcuaccggacugagaaacguacccucuauacaguccaggggcuuguuuggcgccaucgcgggguucauugaaggagguuggacgggcaugguggacgggugguacggauaucaucaccagaaugagcaaggcucagguuacgccgcagaucucaagaguacccagaacgcuaucgacaaaauaacaaauaaggucaacagcgugauugaaaagaugaauacucaguuuaccgccguugggaaagaguucaaccaccuggagaagcggaucgaaaauuuaaacaaaaagguggaugacggcuuccuggauaucuggacauacaaugcugagcuccuuguccuguuggaaaacgagcgcacucuagacuaucaugauuccaaugugaaaaaccuguacgaaaagguacgaaaccagcucaagaauaacgccaaagagauuggaaauggcuguuuugaguucuaucacaagugcgacaacaccuguauggaaucuguuaaaaaugggacauacgauuauccuaaguacagcgaggaagcaaaacugaacagagaggaaaucgacggagugaaacuugagucaaccaggauuuaucaaauacuggccaucuacaguacugucgcuuccagcuuggugcucgucgugucucugggugcgauuucauuuuggaugugcaguaauggcagcuuacagugccggaucuguaucuga

SEQ ID NO: 129911 - RNA, 1701 nt, Artificial Sequence
  derived and/or modified sequence opt3 from hemagglutinin__InfluenzaA__AEW22718
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucuggugaagcccggcgacaaaauuaccuucgaagcaacagggaaccuagucguuccuagguacgccuuugcuauggagcggaacgccggaucuggcaucauaauuuccgauaccccagugcaugacugcaauacgacuugucaaacaccgaagggugcaaucaacaccagccuccccuuccagaauauucacccuaucacuaucgggaagugcccaaaauauguaaagucgacaaaacugcgccuugcuaccggacugagaaacgugcccucuauucaguccaggggcuuguuuggcgccauagcgggguucaucgaaggagguuggacgggcauggucgacgggugguacggauaucaucaccagaaugagcaaggcucagguuacgccgcagaucucaagaguacccagaacgcuauugacaaaaucacaaauaaggugaacagcguuauagaaaagaugaauacucaguuuaccgccguggggaaagaguucaaccaccuggagaagcggauugaaaauuuaaacaaaaaggucgaugacggcuuccuggauaucuggacauacaaugcugagcuccuugugcuguuggaaaacgagcgcacucuagacuaucaugauuccaauguaaagaaccuguacgaaaagguucgaaaccagcucaagaauaacgccaaagagaucggaaauggcuguuuugaguucuaucacaagugcgacaacaccuguauggaaucugugaaaaaugggacauacgauuauccuaaguacagcgaggaagcaaaacugaacagagaggaaauugacggagucaaacuugagucaaccaggaucuaucaaauucuggccauauacaguacuguggcuuccagcuugguccucgugguuucucugggugcgaucucauuuuggaugugcaguaauggcagcuuacagugccggauuuguaucuga

SEQ ID NO: 129912 - RNA, 1701 nt, Artificial Sequence; identical to SEQ ID NO: 128470
  derived and/or modified sequence opt3 from hemagglutinin__InfluenzaA__AEW22720

SEQ ID NO: 129913 - RNA, 1701 nt, Artificial Sequence; identical to SEQ ID NO: 128470
  derived and/or modified sequence opt3 from hemagglutinin__InfluenzaA__AEW22722

SEQ ID NO: 129914 - RNA, 1701 nt, Artificial Sequence
  derived and/or modified sequence opt3 from hemagglutinin__InfluenzaA__AEW22724
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccagagagaucggaaauggcuguuuugaguucuaucacaagugcgacaacaccuguauggagucugugaaaaaugggacauacgauuauccuaaguacagcgaagaggcaaaacugaacagggaagagauugacggagucaaacuugagucaacccggaucuaucaaauucuggccauauacaguacuguggcuuccagcuugguccucgugguuucucugggugcgaucucauuuuggaugugcaguaauggcagcuuacagugccguauuuguaucuga

SEQ ID NO: 129915 - RNA, 1701 nt, Artificial Sequence
  derived and/or modified sequence opt3 from hemagglutinin__InfluenzaA__AEW25297
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggaucccugggaauccagagugugaaucucugucaacagcaaguagcugguccuacauuguugagaccucuucgucagacaacggaacuugcuauccgggcgauuuuaucgacuacgaagaguugagggagcagcucagcaguguguccucuuucgaacgguuugagauuuuccccaagacaagcuccuggccuaaucacgauccaaacaagggugucaccgccgcuuguccccaugcaggggccaaaucauuuuauaagaaucugaucuggcuggugaaaaagggaaacaguuacccuaaacucagcaagucuuauauaaaugacaagggcaaagaaguauuaguucuguggggcauccaccacccauccacgucagcugaucaacagagccuuuaccagaacgccgacgcguacguguucgucgggacuagccgcuauucuaagaaauuuaagcccgagauugcaauccgaccuaaagugcgugaucaggagggaagaaugaauuacuauuggaccuugguggaaccaggugacaagauuacauucgaggccacuggcaaccuggucguuccgagguacgcuuuugccauggaacggaacgcaggguccggaaucauaauuagcgauacccccgugcaugacugcaauacaaccugucaaacgccucgcggcgcuaucaacacuucgcuaccauuccagaauauucaccccaucacaaucgguaaaugcccuaaguauguaaagucuaccaaacucagacuggccacugggcuuaggaacgugccauccauucagucacggggacuguuuggcgcgauagccggcuucaucgaagggggauggacagguauggucgacggcugguacggguaucaucaccagaaugaacaaggaaguggcuacgcagcugauuugaagaguacccagaacgccauugacgagaucacgaauaaagugaacuccguuauagagaagaugaauacccaguuuacagcuguggguaaagaguucaaccaccucgagaagcgcauugaaaaucugaacaagaaagucgaugacggguucuuagauaucuggacuuacaaugccgagcugcucgugcuucuggaaaacgagcgaaccuuggacuaucaugauucuaauguaaagaaccuauacgagaaaguuagaagccagcugaagaacaaugcaaaagaaaucggcaacggauguuuugaguucuaucacaagugcgacaauacauguauggaaucagugaagaacggcacuuacgauuaucccaaauacagugaggaagccaagcucaauagggaggagauugacggggucaaacuggaauccacccggaucuaucaaauucuugcuauauacagcacaguggcgucuucacuggucuuggugguuagucucggagcaaucagcuuuuggaugugcuccaacgguucucugcagugccguauuuguaucuga

SEQ ID NO: 129916 - RNA, 1701 nt, Artificial Sequence; identical to SEQ ID NO: 125483
  derived and/or modified sequence opt3 from hemagglutinin__InfluenzaA__AEW25306

SEQ ID NO: 129917 - RNA, 1701 nt, Artificial Sequence
  derived and/or modified sequence opt3 from hemagglutinin__InfluenzaA__AEW25315
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaaucggcaacggauguuuugaguucuaucacaagugcgacaauacauguauggaaucagugaaaaacggcacuuacgauuauccaaaguacagugaggaagccaaacugaauagagaggagauugacggggucaaacuugaauccaccaggaucuaucaaauucuggcuauauacagcacaguggcgucuucauugguccucgugguuagucugggagcaaucagcuuuugggugugcuccaacgguucuuuacagugccggauuuguaucuga

SEQ ID NO: 129918 - RNA, 1701 nt, Artificial Sequence
  derived and/or modified sequence opt3 from hemagglutinin__InfluenzaA__AEW25331
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaguagcuccuggucuuacauuguugagaccucgucaagcgacaacggaacuugcuauccaggcgauuucaucgacuacgaagaguugagggagcagcucaguuccgugucuagcuuugaacgguucgagauuuuuccgaagacauccucauggcccaaucacgauaguaacaagggugucaccgcagccuguccucaugcuggggcaaagagcuucuauaaaaaucugaucuggcuggugaaaaagggaaacucuuacccaaaacucuccaagucauauauaaaugacaagggcaaagaaguauuaguucuguggggcauccaccaccccagcacgagugccgaucaacagucucuuuaccagaacgcugacgccuacguguuugucgggacuucccgcuauagcaagaaauucaagccugagauugcgauccgaccaaaagugcgugaucaggagggaagaaugaauuacuauuggaccuugguggaacccggugacaagauuacauuugaggcaacuggcaaccuggucguuccuagguacgccuucgcuauggaacggaacgccgggucgggaaucauaauuucugauaccccagugcaugacugcaauacaaccugucaaacgccgaaaggcgcaaucaacacuucccuacccuuucagaauauuccuccaaucacaaucgguaagugccccaaguauguaaaaucaaccaagcuccgccuggcuacugggcuuagaaacgugccuaguauucagagcaggggacuguucggcgccauagcgggcuuuaucgaagggggauggacagguauggucgacggcugguacggguaucaccaucagaaugaacaaggauccggcuacgccgcagauuugaaaucuacccagaacgcuauugacgagaucacgaauaaggugaacagcguuauagagaaaaugaauacccaguucacagccguggguaaggaguucaaccaccucgagaagcggauugaaaaucugaacaaaaaggucgaugacggguuuuuagauaucuggacuuacaaugcugagcugcucgugcuucuggaaaacgagcgcaccuuggacuaucacgauucaaauguuaaaaaccuauacgagaagguacgaagucagcugaaaaacaaugccaaggaaaucggcaacggauguuucgaguuuuaucauaagugcgacaauacauguauggaauccgugaaaaacggcacuuacgauuauccaaaguacagcgaggaagcaaaacucaauagagaggagauugacggggucaagcuggaaucuaccaggaucuaucaaauucuugccauauacucaacaguggcuaguagccuggucuuggugguuucccucggagcgaucucuuucuggaugugcucgaacgguagccugcagugccggauuuguaucuga

SEQ ID NO: 129919 - RNA, 1701 nt, Artificial Sequence
  derived and/or modified sequence opt3 from hemagglutinin__InfluenzaA__AEW25349
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaguagcuccuggucuuacauuguugagaccucgucaagcgacaacggaacuugcuauccaggcgauuucaucgacuacgaagaguugagggagcagcucaguuccgugucuagcuuugaacgguucgagauuuuuccgaagacauccucauggcccaaucacgauaguaacaagggugucaccgcagccuguccucaugcuggggcaaagagcuucuauaaaaaucugaucuggcuggugaaaaagggaaacucuuacccaaaacucuccaagucauauauaaaugacaagggcaaagaaguauuaguucuguggggcauccaccaccccagcacgagugccgaucaacagucucuuuaccagaacgcugacgccuacguguuugucgggacuucccgcuauagcaagaaauucaagccugagauugcgauccgaccaaaagugcgugaucaggagggaagaaugaauuacuauuggaccuugguggaacccggugacaagauuacauuugaggcaacuggcaaccuggucguuccuagguacgccuucgcuauggaacggaacgccgggucgggaaucauaauuucugauaccccagugcaugacugcaauacaaccugucaaacgccgaaaggcgcaaucaacacuucccuacccuuucagaauauucacccuaucacaaucgguaagugcccaaaguauguaaaaucaaccaagcuccgccuggcuacugggcuuagaaacgugcccaguauucagagcaggggacuguucggcgccauagcgggcuuuaucgaagggggauggacagguauggucgacggcugguacggguaucaucaccagaaugaacaaggauccggcuacgccgcagauuugaaaucuacccagaacgcuauugacgagaucacgaauaaggugaacagcguuauagagaaaaugaauacccaguucacagccguggguaaggaguucaaccaccucgagaagcggauugaaaaucugaacaaaaaggucgaugacggguuuuuagauaucuggacuuacaaugcugagcugcucgugcuucuggaaaacgagcgcaccuuggacuaucaugauucaaauguuaaaaaccuauacgagaagguacgaagucagcugaaaaacaaugccaaggaaaucggcaacggauguuucgaguuuuaucacaagugcgacaauacauguauggaauccgugaaaaacggcacuuacgauuauccuaaguacagcgaggaagcaaaacucaauagagaggagauugacggggucaagcuggaaucuaccaggaucuaucaaauucuugccauauacucaacaguggcuaguagccuggucuuggugguuucccucggagcgaucucuuucuggaugugcucgaacgguagccugcagugccggauuuguaucuga

SEQ ID NO: 129920 - RNA, 1701 nt, Artificial Sequence
  derived and/or modified sequence opt3 from hemagglutinin__InfluenzaA__AEW25367
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaguagcuccuggucuuacauuguugagaccucgucaagcgacaacggaacuugcuauccaggcgauuucaucgacuacgaagaguugagggagcagcucaguuccgugucuagcuuugaacgguucgagauuuuuccgaagacauccucauggcccaaucacgauaguaacaagggugucaccgcagccuguccucaugcuggggcaaagagcuucuauaaaaaucugaucuggcuggugaaaaagggaaacucuuacccaaaacucuccaagucauauauaaaugacaagggcaaagaaguauuaguucuguggggcauccaccaccccagcacgagugccgaucaacagcgccuuuaccagaacgcugacgccuacguguuugucgggacuucucgauauuccaagaaauucaagccugagauugcgauccguccaaaagugagagaucaggagggaaggaugaauuacuauuggaccuugguggaacccggugacaagauuacauuugaggcaacuggcaaccuggucguuccucgguacgccuucgcuauggaacgcaacgccgggagcggaaucauaauuucggauaccccagugcaugacugcaauacaaccugucaaacgccgaaaggcgcaaucaacacuucucuacccuuucagaauauucacccuaucacaaucgguaagugcccaaaguauguaaaauccaccaagcucagacuggcuacugggcuuaggaacgugcccucaauucagagucggggacuguucggcgccauagcgggcuuuaucgaagggggauggacagguauggucgacggcugguacggguaucaucaccagaaugaacaaggaagcggcuacaccgccgauuugaaauccacgcagaacgcaauugacgagaucaccaauaaggugaacucuguuauagagaaaaugaauacacaguucacugcuguggguaaggaguucaaccaccucgagaagcgcauugaaaaucugaacaaaaaggucgaugacggguuuuuagauaucuggaccuacaaugccgagcugcucgugcuucuggaaaacgagcgaacauuggacuaucaugauagcaauguuaaaaaccuauacgagaagguaagaucacagcugaaaaacaaugcuaaggaaaucggcaacggauguuucgaguuuuaucacaagugcgacaauacuuguauggaaagugugaaaaacggcaccuacgauuauccuaaguacuccgaggaagccaaacucaauagggaggagauugacggggucaagcuggaaagcacacggaucuaucaaauucuugcaauauacucuaccguggccucaagucuggucuuggugguuagccucggagcuaucuccuucuggaugugcucuaacgguucgcugcagugccguauuuguaucuga

SEQ ID NO: 129921 - RNA, 1701 nt, Artificial Sequence
  derived and/or modified sequence opt3 from hemagglutinin__InfluenzaA__AEW25377
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguuaaaaaccuguacgagaagguaaaaucacagcucaagaacaaugccaaggaaaucggcaacggauguuuugaguucuaucacaaaugcgacaaugcauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 129922 - RNA, 1701 nt, Artificial Sequence
  derived and/or modified sequence opt3 from hemagglutinin__InfluenzaA__AEW25385
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcagugugccguccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacaagaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggaaucagugaagaacggcacuuacgauuauccaaaauacagugaagaggccaagcugaauagagaagagauugacggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129923 - RNA, 1701 nt, Artificial Sequence; identical to SEQ ID NO: 129919
  derived and/or modified sequence opt3 from hemagglutinin__InfluenzaA__AEW25416

SEQ ID NO: 129924 - RNA, 1701 nt, Artificial Sequence
  derived and/or modified sequence opt3 from hemagglutinin__InfluenzaA__AEW25446
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauaagcaguuuaccgcuguggguaaggaguucaaccaccuggaaaaacggauugaaaauuuaaacaagaaagucgaugacggguuccuggauaucuggacauacaaugccgagcuccuugugcuguuggaaaacgagcgcacucuagacuaucaugauucuaauguaaagaaccuguacgagaaaguucgaagccagcucaagaacaaugcaaaggaaaucggcaacggauguuuugaguucuaucacaaaugcgacaauaccuguauggaaucagugaagaacggcacauacgauuauccaaaauacagugaggaagccaagcugaauagagaggagauugacggggucaaacuugaauccacuaggaucuaucaaauucuggcuauauacagcaccguggcgucuucauugguccucgugguuagucugggagcaaucagcuuuuggaugugcuccaacgguucuuuacagugccggauuuguaucuga

SEQ ID NO: 129925 - RNA, 1701 nt, Artificial Sequence; identical to SEQ ID NO: 129919
  derived and/or modified sequence opt3 from hemagglutinin__InfluenzaA__AEW25454

SEQ ID NO: 129926 - RNA, 1701 nt, Artificial Sequence
  derived and/or modified sequence opt3 from hemagglutinin__InfluenzaA__AEW25462
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagccuuauacgaaugacaagggcaaagaaguacugguucuuuggggcauacaccacccaucuacuuccgcugaucaacagucauuguaccagaacgccgacgcguacguguucgucgggaccagccgcuauaguaagaaauuuaagcccgagaucgcaauucgaccuaaagugcgugaucaggagggaagaaugaauuacuauuggacacugguggaaccaggugacaagaucacuuucgaggccaccggcaaccuagucguuccgagguacgcuuuugccauggaacggaacgcagggucuggaauuaucauauccgauacacccgugcaugacugcaauaccacgugucaaacuccuaaaggcgcuauuaacacaagccucccauuccagaauauccaccccauuaccaucgguaagugcccuaaguauguaaaaucgacuaagcugcgccuugccacagggcugagaaacgugccaucuauccaguccaggggauuguuuggcgcgauugccggcuucauagaagggggauggaccgguauggucgacggcugguacggguaucaucaccagaaugaacaaggaucaggcuacgcagcugaucucaaaaguacgcagaacgccaucgacgagauuaccaauaaggugaacagcguuaucgagaaaaugaauacacaguuuacugcuguggguaaggaguucaaccaccuggaaaagcggauagaaaauuuaaacaaaaaggucgaugacggguuccuggauauuuggaccuacaaugccgagcuccuugugcuguuggaaaacgagcgcacacuagacuaucaugauuccaauguaaagaaccuguacgagaagguucgaucucagcucaaaaacaaugcaaaggaaaucggcaacggauguuuugaguucuaucacaagugcgacaauacuuguauggaaagcgugaaaaacggcaccuacgauuaucccaaguacucagaggaagccaaacugaauagagaggagaucgacggggucaaacuugaaaguacaaggauuuaucaaauccuggcuauuuacuccaccguggcgagcucuuugguccucgugguuucacugggagcaauaaguuuuuggaugugcagcaacgguuccuuacagugccggaucuguauuuga

SEQ ID NO: 129927 - RNA, 1701 nt, Artificial Sequence; identical to SEQ ID NO: 125483
  derived and/or modified sequence opt3 from hemagglutinin__InfluenzaA__AEW25472

SEQ ID NO: 129928 - RNA, 1701 nt, Artificial Sequence
  derived and/or modified sequence opt3 from hemagglutinin__InfluenzaA__AEW25482
augaaggccauccuggugguccuccuuuacaccuucgcuacagcaaacgccgacacucugugcauuggcuaucacgcgaauaacagcacggauaccguugacacaguguuggagaaaaagguaacugugacccauuccgucaauuuacuggaagauaaacacaacgggaagcuauguaaacucagaggaguggcuccccugcaucuugguaagugcaauauagccggcuggauccuggggaacccugagugugaaucuuugucaacagcaaguagcugguccuacauuguugagaccucuaauucggacaacggaacuugcuauccaggcgauuuuaucgacuacgaggaacucagggagcagcugucaagcgugaguuccuucgaacgguuugagauuuucccgaagacaucuagcuggcccaaucacgauccuaacaaaggugucaccgccgcuuguccacaugcaggggccaaguccuuuuauaaaaaucugaucuggcucgugaagaaaggaaacucauaccccaaguuaaguaagagcuauauaaaugacaaaggcaaggaaguacugguucuuuggggcauccaccacccuucuacguccgcugaucaacagucauuguaccagaacgccgacgcguacguguucgucgggacuagccgcuauaguaaaaaguuuaaaccagagauugcaauccgacccaaggugcgugaucagggagguagaaugaauuacuauuggacccugguggagccuggcgacaaaauuacauucgaagccacugggaaccuagucguuccaagguacgcuuuugccauggagcggaacgcaggaucuggcaucauaauuuccgauaccccggugcaugacugcaauacaaccugucaaacgcccaagggugcuaucaacacuagccucccuuuccagaauauucacccaaucacaaucgggaagugccccaaauauguaaagucgaccaaacugcgccuugccacuggacugagaaacgugccuucuauucaguccaggggcuuguuuggcgcgauagccggguucaucgaaggagguuggacaggcauggucgacgggugguacggauaucaucaccagaaugagcaaggcucagguuacgcagcugaucucaagaguacccagaacgccauugacgaaaucacgaauaaagugaacagcguuauagagaagaugaauacccaguuuacagcuguggggaaggaguucaaccaccuggaaaaacggauugagaauuuaaacaagaaagucgaugacggcuuccuggauaucuggacuuacaaugccgaacuccuugugcuguuggagaacgaacgcacccuagacuaucaugauuccaauguaaagaaccuguacgagaaaguucgaucucagcucaagaacaaugcaaaggagaucggaaacggcuguuuugaacuguaucacaaaugcgacaauacauguauggagagcgugaagaacgggacuuacgauuauccaaaauacucagaagaggccaaacuuaauagagaagagauugacggagucaagcuggagaguaccaggaucuaucaaauuuuggcuauauacuccacaguggcgagcucucucguccuggugguuucauuaggugcaaucaguuucuggaugugcagcaacggcucccugcagugccggauuuguaucuga

SEQ ID NO: 129929 - RNA, 1701 nt, Artificial Sequence
  derived and/or modified sequence opt3 from hemagglutinin__InfluenzaA__AEW25492
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacauuuucguggggaccagucgcuauucuaagaaauuuaagccagagaucgcaauucgacccaaaguccgugaucaggagggaagaaugaauuacuauuggacucugguggaaccuggugacaagaucacauucgaggccacuggcaaccuaguggucccaagguacgcuuuugccauggaacggaacgcaggguccggaauaauuaucagcgauaccccgguucaugacugcaauacaaccugucaaacgcccaaaggcgcuauuaacacuucgcucccuuuccagaauauccacccaaucacaauugguaagugccccaaguaugugaaaucuaccaagcugcgccuugccacugggcugagaaacguaccuuccauacagucaaggggauuguuuggcgcgaucgccggcuucauugaagggggauggacagguaugguggacggcugguacggguaucaucaccagaaugaacaaggaaguggcuacgcagcugaucucaaaagcacccagaacgccaucgacgagauaacgaauaaggucaacuccgugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaauuggcaacggauguuuugaguucuaucacaagugcgacaauacauguauggaaucaguuaaaaacggcacuuacgauuauccaaaguacagugaggaagccaaacugaauagagaggagaucgacggggugaaacuugaauccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 129930 - RNA, 1701 nt, Artificial Sequence
  derived and/or modified sequence opt3 from hemagglutinin__InfluenzaA__AEW25501
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucugccucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacuguaauacaaccugccaaacgccgaagggcgcuaucaacacuucucuccccuuccagaauauucacccuaucacaaucgguaaguguccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucaugauagcaauguaaagaaccuguacgagaagguucgcucacagcucaagaacaaugcaaaagagaucggcaacggaugcuuugaguucuaucacaagugugacaauacaugcauggaaagugugaaaaacggcacuuacgauuauccuaaguacuccgaagaggccaaacugaaucgagaagagauugacggggucaaacuugagagcaccagaaucuaucaaauucuggcuauauacucuacaguggcgucaaguuugguccucgugguuagccugggagcaaucuccuuuuggaugugcucuaacgguucguuacaguguaggauuugcaucuga

SEQ ID NO: 129931 - RNA, 1701 nt, Artificial Sequence; identical to SEQ ID NO: 129919
  derived and/or modified sequence opt3 from hemagglutinin__InfluenzaA__AEW25509

SEQ ID NO: 129932 - RNA, 1701 nt, Artificial Sequence
  derived and/or modified sequence opt3 from hemagglutinin__InfluenzaA__AEW25519
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacauacgggggcaaaaucauuuuauaagaaucugaucuggcucgugaaaaagggaaacaguuaccccaaauuaagcaagucuuauauaaaugacaagggcaaagaaguacugguucuuuggggcauccaccacccuuccacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcaugacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgagaucaccaauaaggugaacuccguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauucuaauguuaaaaaccuguacgagaagguacgaagccagcucaaaaacaaugccaaggaaaucggcaacggauguuuugaguucuaucacaagugcgacaauacuuguauggaaucagugaaaaacggcaccuacgauuauccaaaguacagugaggaagcaaaacugaauagagagaagauugacggggucaaacuugaguccacaaggaucuaucaaauucuggccauauacagcaccguggcuucuucauugguccucgugguuagucugggagcgaucagcuuuuggaugugcuccaacgguucuuuacagugccggauuuguaucuga

SEQ ID NO: 129933 - RNA, 1701 nt, Artificial Sequence
  derived and/or modified sequence opt3 from hemagglutinin__InfluenzaA__AEW25528
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuuuucaacaaguagcuccuggucuuacauuguugagaccucgucaagcgacaacggaacuugcuauccaggcgauuucaucgacuacgaagaguugagggagcagcucaguuccgugucuagcuuugaacgguucgagauuuuuccgaagacauccucauggcccaaucacgauaguaacaagggugucaccgcagccuguccucaugcuggggcaaagagcuucuauaaaaaucugaucuggcuggugaaaaagggaaacucuuacccaaaacucuccaagucauauauaaaugacaagggcaaagaaguauuaguucuguggggcauccaccaccccagcacgagugccgaucaacagucucuuuaccagaacgcugacgccuacguguuugucgggacuucccgcuauagcaagaaauucaagccugagauugcgauccgaccaaaagugcgugaucaggagagaaggaugaauuacuauuggaccuugguggaacccggagacaagauuacauuugaggcaacugguaaccuggucguuccucgguacgccuucgcuauggaacgcaacgccggcucggggaucauaauuucugauaccccagugcaugacugcaauacaaccugucaaacgccgaaaggagcaaucaacacuucccuacccuuucagaauauucacccuaucacaaucggcaagugcccaaaguauguaaaaucaaccaagcucagacuggcuacuggucuuaggaacgugcccaguauucagagccgggggcuguucggagccauagcgggcuuuaucgagggcggguggacaggaauggucgacgguugguacggcuaucaucaccagaaugaacaaggguccggauacgccgcagauuugaaaucuacccagaacgcuauugacgagaucacgaauaaggugaacagcguuauagagaaaaugaauacccaguucacagccgugggcaaggaauuuaaccaccucgagaagcgcauugaaaaucugaacaaaaaggucgaugacgguuucuuagauaucuggacuuacaaugcugagcugcucgugcuucuggaaaacgagcgaaccuuggacuaucaugauucaaauguuaaaaaccuauacgagaagguaagaagucagcugaaaaacaaugccaaggaaaucgggaacggcuguuucgaguuuuaucacaagugcgacaauacauguauggaauccgugaaaaacggaacuuacgauuauccuaaguacagcgaggaagcaaaacucaauagggaggagauugacggcgucaagcuggaaucuacccggaucuaucaaauucuugccauauacucaacaguggcuaguagccuggucuuggugguuucccucggggcgaucucuuucuggaugugcucgaacggaagccugcagugccguauuuguaucuga

SEQ ID NO: 129934 - RNA, 1701 nt, Artificial Sequence
  derived and/or modified sequence opt3 from hemagglutinin__InfluenzaA__AEW25545
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacaagaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggaaucagugaagaacggcaguuacgauuauccaaaauacuccgaagaggccaagcugaauagagaagagauugacggggucaaacuugagagcacuaggaucuaucaaauucuggcuauauacucuaccguggcgucaaguuuggucauggugguuagccucggagcaaucuccuuuuggaugugcucuaacgguucgcugcagugccggauuuguaucuga

SEQ ID NO: 129935 - RNA, 1701 nt, Artificial Sequence
  derived and/or modified sequence opt3 from hemagglutinin__InfluenzaA__AEW25555
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcauuauugcaauacaaccugucaaacgcccaaaggcgcuaucaacacuucgcucccuuuccagaauauucacccaaucacaaucgguaagugccccaaguacguaaaaucuaccaagcugcgccuugccacugggcugagaaacgugccuuccauucagucaaggggauuguuuggcgcgauagccggcuucaucgaagggggauggacagguauggucgacggcugguauggguaccaucaccagaaugaacaaggaaguggcuacgcagcugaccucaaaagcacccagaacgccauugaugagaucacgaauaaggugaacuccguuauagagaaaaugaauacccaguuuacagcuguggguaaggaguucaaccaccuggaaaagcggauugaaaauuuaaacaaaaaggucgacgauggguuccuggacaucuggacuuauaaugccgagcuccuugugcuguuggaaaacgagcgcacccuagauuaccaugacucuaauguaaagaaccuguaugagaagguucgaagccagcucaaaaacaaugcaaaggaaaucggcaacggauguuuugaguucuaccacaagugcgauaauacauguauggaaucagugaaaaacggcacuuaugacuacccaaaguauagugaggaagccaaacugaauagagaggagauugauggggucaaacuugaauccaccaggaucuaccaaauucuggcuauauacagcacaguggcgucuucauugguccucgugguuagucugggagcaaucagcuuuuggaugugcuccaacgguucuuuacagugccggauuuguaucuga

SEQ ID NO: 129936 - RNA, 1701 nt, Artificial Sequence
  derived and/or modified sequence opt3 from hemagglutinin__InfluenzaA__AEW25564
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcucucaacacuucucugcccuuccagaauauccacccuauuacaaucgguaagugcccaaaguauguaaaauccaccaaacuucgccuggccacuggguugagaaacgugcccucaauccagaguaggggacucuuuggcgcgauugccggcuucauagaagggggauggacagguauggucgacggcugguacggguaucaucaccagaaugaacaaggaagcggcuacgcagcugaucugaaguccacccagaacgccaucgacgagauuacgaauaaggugaacucuguuaucgagaaaaugaauacccaguuuacagcuguggguaaggaguucaaccacuuagaaaagcggauagaaaaucugaaccgcaaagucgaugacggguuccucgauauuuggacuuacaaugccgagcuucugguguugcuagaaaacgagcgaacccuggacuaucaugauagcaauguaaagaaccucuacgagaaaguuagaucacagcugaagaacaaugcaaaagaaaucggcaacggauguuuugaguucuaucacaagugcgacaauacauguauggaaagugugaagaacggcacuuacgauuauccuaaauacuccgaggaagccaaacuuaauagggaggagaucgacggggucaagcuggaaagcaccggaauuuaucaaaucuuggcuauuuacucuacaguggcgucaagucucguccuggugguuagcuuaggugcaauauccuuuuggaugugcucuaacggcucgcugcagugccggaucuguauuuga

SEQ ID NO: 129937 - RNA, 1701 nt, Artificial Sequence; identical to SEQ ID NO: 125483
  derived and/or modified sequence opt3 from hemagglutinin__InfluenzaA__AEW25573

SEQ ID NO: 129938 - RNA, 1701 nt, Artificial Sequence
  derived and/or modified sequence opt3 from hemagglutinin__InfluenzaA__AEW25582
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauacucucggauaccccagugcaugacugcaauacaaccugucaaacgccgaaaggcgcuauuaacacuucucugcccuuccagaauauccacccuauuacaaucgguaagugcccaaaguauguaaaauccaccaaacuucgccuggccacuggguugagaaacgugcccucaauccagaguaggggacucuuuggcgcgauugccggcuucauagaagggggauggacagguauggucgacggcugguacggguaucaucaccagaauggacaaggcagcgguuacgcagcugaucugaaguccacccagaacgccaucgacaagauuacgaauaaagugaacucuguuaucgaaaagaugaauacccaguuuacagcuguggggaaggaguucaaccacuuagagaaacggauagaaaaucugaacaagaaagucgaugacggcuuccucgauauuuggacuuacaaugccgagcuucugguguugcuagaaaacgagcgcacccuggacuaucaugauagcaauguaaagaaccucuacgaaaaaguucgaucacagcugaagaacaaugcaaaggagaucggaaacggcuguuuugaguucuaucacaaaugcgacaauacauguauggaaagugugaagaacgggacuuacgauuauccuaaauacuccgaggaagccaaacuuaauagagaggaaaucgacggagucaagcuggagagcaccaggauuuaucaaaucuuggcuauuuacucuacaguggcgucaagucucguccuggugguuagcuuaggugcaauauccuuuuggaugugcucuaacggcucgcugcagugccggaucuguauuuga

SEQ ID NO: 129939 - RNA, 1701 nt, Artificial Sequence
  derived and/or modified sequence opt3 from hemagglutinin__InfluenzaA__AEW25590
augaaggccauccuggugguccuccuuuacaccuucgcuacagcaaacgccgacacucugugcauuggcuaucacgcgaauaacagcacggauaccguugacacaguguuggagaagaauguaacugugacccaguccgucaacuuacuggaagauaagcauaaugggaaacuauguaagcucagaggaguggcuccccugcaccuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcaacugagcaguguguccucuuucgaacgguuugagauuuucccgaagacaagcuccuggcccaaucaugauucaaacaagggugucaccgccgcuuguccucacgcaggggccaaaaguuuuuauaagaaucugaucuggcucgugaaaaagggaaacagcuacccaaaauuaucuaaguccuauauaaaugacaagggcaaagaaguacugguucuuuggggcauccaucaccccucaacgagcgcugaucagcagaguuuguaccagaacgccgacgcguacguguucgucgggacuucucgcuauuccaagaaauuuaagccugagauugcaauccgaccaaaagugcgugaucaagaggccagaaugaauuacuauuggacccugguggaacccggagacaagauuacauucgaggcuacugguaaccuagucguuccuagguacgccuuugcaauggaacgggaugcuggcagcgggaucauaauuucggacaccccagugcacgacugcaacacaaccugucagacgccgaaaggagccaucaauacuucucuccccuuccagaacauucauccuaucacaaucggcaagugcccaaaguauguaaaauccaccaagcugcgccuugcgacuggucugagaaaugugcccucaauucagaguaggggguuguuuggagccauagcaggcuucaucgagggcggguggacaggaauggucgaugguugguacggcuaucaccaucaaaacgaacaggggagcggauacgcugccgaccucaaauccacccagaaugcuauugaugagaucacgaacaagguaaauucuguuauagagaaaaugaacacccaguuuacagccgugggcaaggaguucaaucaccuggagaagcggauugaaaacuuaaauaaaaaggucgacgaugguuuccuggacaucuggacuuacaacgcagagcuccuugugcuguuggaaaaugagcgcacccuagauuaucacgacagcaacgugaaaaaucugcaugagaagguucgaucacaacucaaaaacaacgccaaggaaaucgggaauggcuguuuugaguucuaccacaagugcgauaacacauguauggaaagugugaaaaauggaacuuaugacuacccuaaguauuccgaggaagcuaaacugaacagagaggagauugauggcgucaaacuugaaagcaccaggaucuaccagauucuggcgauauauucuacaguggcaucaaguuugguccucgugguuagccugggggccaucuccuuuuggaugugcucuaauggaucguuacagugccggauuuguaucuga

SEQ ID NO: 129940 - RNA, 1701 nt, Artificial Sequence; identical to SEQ ID NO: 125483
  derived and/or modified sequence opt3 from hemagglutinin__InfluenzaA__AEW25600

SEQ ID NO: 129941 - RNA, 1701 nt, Artificial Sequence; identical to SEQ ID NO: 125483
  derived and/or modified sequence opt3 from hemagglutinin__InfluenzaA__AEW25620

SEQ ID NO: 129942 - RNA, 1701 nt, Artificial Sequence
  derived and/or modified sequence opt3 from hemagglutinin__InfluenzaA__AEW25629
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcagaagccaaaucauuuuauaagaaucugaucuggcucgugaaaaaggggaacaguuaccccaaauuaagcaagucuuauauaaaugacaagggaaaagagguacugguucuuuggggcauccaccacccuuccacgucagcugaucaacagagcuuguaccagaacgccgacgcguacguguucgucggcaccagucgcuauucuaagaaauuuaagccagagauugcaauccgacccaaagugcgugaucaggaagggagaaugaauuacuauuggacucugguggagccuggagacaagauuacauucgaagccacugguaaccuagucguuccaagguacgcuuuugccauggagcggaacgcaggcuccgggaucauaauuagcgauaccccggugcaugacugcaauacaaccugucaaacgcccaaaggagcuaucaacacuucgcucccuuuccagaauauucacccaaucacaaucggcaagugccccaaguauguaaaaucuaccaagcugcgccuugccacuggucugagaaacgugccuuccauucagucaaggggguuguuuggagcgauagccggcuucaucgaaggcggguggacaggaauggucgacgguugguacggcuaucaucaccagaaugagcaagggaguggauacgcagcugaucucaaaagcacccagaacgccauugacgagaucacgaauaaggugaacuccguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauucuaauguuaaaaaccuguacgaaaagguacgaagccagcucaaaaacaaugcaaaggagaucgggaacggcuguuuugaguucuaucacaagugcgacaauauguguauggagucagugaaaaacggaacauacgauuauccaaaguacagugaagaggccaaacugaauagagaggaaauugacggcgucaaacuugaguccacuaggaucuaucaaauucuggcuauauacagcaccguggcgucuucauugguccucgugguuagucugggggcaaucagcuuuuggaugugcuccaacggaucuuuacagugccggauuuguaucuga

SEQ ID NO: 129943 - RNA, 1701 nt, Artificial Sequence; identical to SEQ ID NO: 124685
  derived and/or modified sequence opt3 from hemagglutinin__InfluenzaA__AEW25637

SEQ ID NO: 129944 - RNA, 1701 nt, Artificial Sequence
  derived and/or modified sequence opt3 from hemagglutinin__InfluenzaA__AEW25646
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacaagaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucuaauguaaagaaccuguacgagaaaguucgaagccagcucaagaacaaugcaaaggagaucggcaacggauguuuugaguucuaucacaaaugcgacaauacauguauggaaucagugaagaacggcacuuacgauuauccaaaauacagugaagaggccaagcugaauagagaagagauugacggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129945 - RNA, 1701 nt, Artificial Sequence
  derived and/or modified sequence opt3 from hemagglutinin__InfluenzaA__AEW25654
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucccccuuuccagaauauucacccaaucacaaucgguaagugccccaaguauguaaaauccaccaagcuccgccuggccacugggcuuagaaacauuccuucaauacagaguaggggacuguuuggcgcgaucgccggcuucauugaagggggauggacagguaugguggacggcugguacggguaucaucaccagaaugaacaaggaagcggcuacgcagcugauuugaaauccacccagaacgccaucgacgagauaacgaauaaggucaacucugugauugagaaaaugaauacccaguuuacagcuguugguaaggaguucaaccaccucgaaaagcggaucgaaaaucugaacaaaaagguggaugacggguucuuagauaucuggacuuacaaugccgagcugcucguccuucuggaaaacgagcgcaccuuggacuaucaugauagcaaugugaaaaaccuauacgagaagguacgaucacagcugaaaaacaaugcaaaggaaauuggcaacggauguuuugaguucuaucacaagugcgacaauacauguauggaaaguguuaaaaacggcacuuacgauuauccaaaguacuccgaggaagccaaacucaauagagaggagaucgacggggugaagcuggaaagcaccaggauuuaucaaauacuugcuaucuacucuacagucgcgucaagucugguguuggucgugagccucggagcaauuuccuuuuggaugugcucuaacgguucgcugcagugccggaucuguaucuga

SEQ ID NO: 129946 - RNA, 1701 nt, Artificial Sequence
  derived and/or modified sequence opt3 from hemagglutinin__InfluenzaA__AEW25662
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaaggguaucaccgccgcuuguccacaugcaggggccaaaucauuuuauaagaaucugauauggcucgucaaaaagggaaacaguuaccccaaauuaagcaagucuuauaucaaugacaagggcaaagaagugcugguacuuuggggcauucaccacccuuccacgucagcugaucaacagagcuuguaccagaacgccgacgcguacguuuucguggggaccagucgcuauucuaagaaauuuaagccagagaucgcaauucgacccaaaguccgugaucaggagggaagaaugaauuacuauuggacucugguggaaccuggugacaagaucacauucgaggccacuggcaaccuaguggucccaagguacgcuuuugccauggaacggaacgcaggguccggaauaauuaucagcgauaccccgguucaugacugcaauacaaccugucaaacgcccaaaggcgcuauuaacacuucgcucccuuuccagaauauccacccaaucacaauugguaagugccccaaguaugugaaaucuaccaagcugcgccuugccacugggcugagaaacguaccuuccauacagucaaggggauuguuuggcgcgaucgccggcuucauugaagggggauggacagguaugguggacggcugguacggguaucaucaccagaaugaacaaggaaguggcuacgcagcugaucucaaaagcacccagaacgccaucgacgagauaacgaauaaggucaacuccgugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaauuggcaacggauguuuugaguucuaucacaagugcgacaauacauguauggaaucaguuaaaaacggcacuuacgauuauccaaaguacagugaggaagccaaacugaauagagaggagaucgacggggugaaacuugaauccaccaggauuuaucaaauacuggcuaucuacagcacagucgcgucuucauuggugcucgucgugagucugggagcaauuagcuuuuggaugugcuccaacgguucuuuacagugccggaucuguaucuga

SEQ ID NO: 129947 - RNA, 1701 nt, Artificial Sequence
  derived and/or modified sequence opt3 from hemagglutinin__InfluenzaA__AEW25669
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgaaggcugguacggguaucaucaccagaaugagcaaggaaguggcuacgcagcugaccucaaaagcacccagaacgccauugaugagaucacgaauaaggugaacuccguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagcgcacccuagauuaucaugacucuaauguaaagaaccuguacgaaaagguucgaagccagcucaaaaacaaugcaaaggagaucggcaacggauguuuugaguucuaucacaagugcgauaauacauguauggagucagugaaaaacggcacuuacgacuauccaaaguacagugaagaggccaaacugaauagagaggaaauugauggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129948 - RNA, 1701 nt, Artificial Sequence
  derived and/or modified sequence opt3 from hemagglutinin__InfluenzaA__AEW25678
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuucgaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugagggcaaucuccuuuuggaugugcucuaacggaucguuacagugccggauuuguaucuga

SEQ ID NO: 129949 - RNA, 1701 nt, Artificial Sequence
  derived and/or modified sequence opt3 from hemagglutinin__InfluenzaA__AEW25687
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccauaugcaggggccaaaucauuuuacaagaaucugaucuggcucgugaaaaagggaaacaguuaucccaaauuaagcaagucuuacauaaaugacaagggcaaagaaguacugguucuuuggggcauccaucacccuuccacgucagcugaucaacagagcuuguaccagaacgccgacgcguauguguucgucgggaccagucgcuacucuaagaaauuuaagccagagauugcaauccgacccaaagugcgugaucaggagggaagaaugaauuauuacuggacucugguggaaccuggugacaagauuacauucgaggccacuggcaaccuagucguuccaagguaugcuuuugccauggaacggaacgcaggguccggaaucauaauuagcgauaccccggugcacgacugcaauacaaccugucaaacgcccaaaggcgcuaucaacacuucgcucccuuuccagaauauucauccaaucacaaucgguaagugccccaaguacguaaaaucuaccaagcugcgccuugccacugggcugagaaacgugccuuccauucagucaaggggauuguuuggcgcgauagccggcuucaucgaagggggauggacagguauggucgacggcugguauggguaccaccaucagaaugaacaaggaaguggcuacgcagcugaucucaaaagcacccagaacgccauugacaagaucacgaauaaagugaacuccguuauagagaagaugaauacccaguuuacagcuguggguaaggaguucaaccaccuggaaaaacggauugagaauuuaaacaagaaagucgaugacggguuccuggauaucuggacuuauaaugccgaacuccuugugcuguuggagaacgaacgcacccuagacuaccacgauucuaauguaaagaaccuguaugagaaaguucgaagccagcucaagaacaaugcaaaggagaucggcaacggauguuuugaguucuaccauaaaugcgacaauacauguauggaaucagugaagaacggcacuuaugauuacccaaaauauagugaagaggccaagcugaauagagaagagauugacggggucaaacuugaguccaccaggaucuaccaaauucuggcuauauacagcacaguggcgucuucauugguccucgugguuagucugggagcaaucagcuuuuggaugugcuccaacgguucuuuacagugccggauuuguaucuga

SEQ ID NO: 129950 - RNA, 1701 nt, Artificial Sequence; identical to SEQ ID NO: 129919
  derived and/or modified sequence opt3 from hemagglutinin__InfluenzaA__AEW25696

SEQ ID NO: 129951 - RNA, 1701 nt, Artificial Sequence; identical to SEQ ID NO: 125483
  derived and/or modified sequence opt3 from hemagglutinin__InfluenzaA__AEW25706

SEQ ID NO: 129952 - RNA, 1695 nt, Artificial Sequence
  derived and/or modified sequence opt3 from hemagglutinin__InfluenzaA__AEW91908
auggagaagaucgugcuucucuucgccaccauuagccuugucaaauccgaccacauaugcaucggcuaccaugcuaacaauucuacagaacagguugauacuauuauggagaagaacgugacgguaacccacgcacaagacauccuggaaaagacacauaaugggaaguugugugauuuaaacggagugaaaccccugauucuaaaggacugcucagucgccgguuggcuccugggcaauccuaugugugaugaguuuaucaacgugccagaauggaguuauauaguugagaaggcgaauccggcuaacgaccuuugcuaccccgggaauuucaacgauuaugaggaacugaaacacuugcucagcagaaucaaucauuuugagaagauucagaucauuccuaaaaacuccuggucugaccacgaagccucgcugggagugucagcagccuguccauaccagggcaagagcaguuucuuuaggaaugucguguggcugaucaaaaaggauaacgcuuaucccacuauaaagaaagguuacaauaacaccaaccaggaggaccucuuaguacugugggggauucaccauccuaaugaugaggcagaacaaacacggcuuuaucagaacccaaccacuuacaucuccauuggaacaucuaccuugaaucagcgccugguucccaagaucgccacgcgaagcaaaaucaacggccaguccggccguauugacuucuuuuggacuauacuaaagccuaaugaugcuauccacuucgagucaaacgggaauuuuauugccccagaauacgcguauaaaaucgugaagaaaggagacaguaccauaaugaaaagcgaggucgaauacgguaacugcaauacaagaugucaaacuccgauuggcgcaaucaacucuuccaugcccuuccauaauauccacccucucaccauuggggagugcccaaaguaugugaaaucaaacaagcuggugcuugccacaggacugaggaauagcccccagggcgagacccgggguuuguuuggggcuaucgccggauucauugaaggcggcuggcaggggauggucgacggaugguacgguuaucaccauaguaacgagcagggcucuggguacgcagcugauaaagaauccacgcaaaaggccauagacggaguuacuaauaaagugaacagcaucauugauaagaugaacacacaguuugaggcgguaggccgcgaguucaauaaccucgaaagaaggaucgagaaucugaacaagaaaauggaagacgguuucuuagauguguggaccuauaaugccgagcugcucguccuuauggaaaacgagcggacucuggacuuucacgauucgaaugugcgcaacuuguacgacaagguucgacuacagcugaaagauaaugcaaaggaacucgggaacggcuguuucgaguuuuaccauaaaugcgacaaugaguguauggaaucugugagaaacggaacauaugauuacccucaauauuccgaggaagcuaggcugaagcgggaggagaucucaggcgucaagcuggaaaguauugggauauaccagauccugagcauuuauuccaccguggccucuagcuugguacucgcuaucaugauggccggacugucauuauggaugugcaguaaugguucccugcagugccguauuuguaucuga

SEQ ID NO: 129953 - RNA, 1701 nt, Artificial Sequence
  derived and/or modified sequence opt3 from hemagglutinin__InfluenzaA__AEX09175
augaaggccauccuggugguccuccuuuacaccuucgcuacagcaaacgccgacacucugugcauuggcuaucacgcgaauaacagcacggauaccguugacacaguguuggagaaaaauguagcugugacucauuccgucaacuuacuggaagauaagcacaaugggaaacuauguaagcucagaggaguggcaccccugcaucuugguaaaugcaacauagccggcuggauccuggggaauccugagugugaaucuuugucaaccgccaguagcugguccuacauuguugagacaucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugauagagagggaaggaugaauuacuauuggacucugguggaacccggugacaagauuaccuucgaggcuacaggcaaccuagucguuccucgguacgccuuugcaauggaacgcaacgcugggagcggaaucauaauuucggauacuccagugcaugacugcaauaccacaugucagaccccgaaaggcgccaucaacacgucucuccccuuccaaaauauucacccuaucacuaucgguaagugcccaaaguauguaaaauccacaaagcugagacuugcgaccgggcugaggaacgugcccucaauucagagucggggauuguuuggcgccauagcaggcuucaucgaagggggauggacugguauggucgacggcugguacggguaucaucaccagaaugaacagggaagcggcuacgcugccgaucucaaauccacacaaaacgcuauugacgagaucaccaauaaggugaacucuguuauagagaaaaugaauacgcaguuuaccgccguggguaaggaguucaaccaccuggaaaagcgcauugaaaauuuaaacaaaaaggucgaugacggguuccuggauaucuggacauacaaugcagagcuccuugugcuguuggaaaacgagcgaacucuagacuaucaugauagcaauguaaagaaccuguacgagaagguuagaucacagcucaaaaacaaugccaaggaaaucggcaacggauguuuugaguucuaucacaagugcgacaauaccuguauggaaagugugaaaaacggcacauacgauuauccuaaguacuccgaggaagcuaaacugaauagggaggagauugacggggucaaacuugaaagcacucggaucuaucagauucuggcgauauacucuaccguggcaucaaguuugguccucgugguuagccugggagccaucuccuuuuggaugugcucuaacgguucguuacaaugccguauuuguaucuga

SEQ ID NO: 129954 - RNA, 1701 nt, Artificial Sequence; identical to SEQ ID NO: 124685
  derived and/or modified sequence opt3 from hemagglutinin__InfluenzaA__AEX25795

SEQ ID NO: 129955 - RNA, 1701 nt, Artificial Sequence
  derived and/or modified sequence opt3 from hemagglutinin__InfluenzaA__AEX25797
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuaacucggacaauggaacuugcuauccaggcgauuuuaucgacuacgaggagcucagggaacagcugucaagcgugaguuccuucgagcgguuugaaauuuucccgaaaacaucuagcuggcccaaccacgauuccaauaagggugucaccgccgcuuguccucaugcaggggccaagucauuuuauaaaaaccugaucuggcucgugaagaaaggaaauaguuacccaaaguuaagcaaaucuuauauaaacgacaagggcaaggagguacugguucuuuggggcauccaccaccccuccacgucagcugaucaacagagcuuguaccagaaugccgacgcguacguguucgucgggaguucucgcuauuccaaaaaguuuaaaccugagauugcaauccgaccaaaggugcgugaucaggaaggaagaaugaacuacuauuggacucugguggagcccggugacaaaauuaccuucgaagccacaggcaaccuagucguuccuagguacgcuuuugccauggagcggaaugcagggagcggaaucauaauuucggauacuccagugcaugacugcaacaccacaugucaaaccccgaagggcgcuaucaauacgucucuccccuuccacaacauucauccuaucacuaucgguaaaugcccaaaguauguaaaguccacaaaacugcgccuugccaccgggcugagaaaugugcccucaauucagaguaggggauuguuuggcgcgauagccggcuucaucgaagggggauggacugguauggucgacggcugguacggguaucaccaccagaacgagcagggaagcggcuacgcagcugaucucaaguccacacaaaaugccauugacgagaucaccaacaaaguuaauucugugauagaaaagaugaacacgcaguuuaccgcuguggguaaagaguucaaucaucuggaaaagcggauugagaacuuaaauaagaaagucgaugacggguuccuggauaucuggacauacaacgccgaacuccuugugcuguuggagaaugagcgcacucuagacuaucacgauagcaacguaaagaaccuguacgaaaaaguucgaucacagcucaagaauaacgcaaaagagaucggcaauggauguuuugaguucuaucauaagugcgacaacaccuguauggaaagugugaagaauggcacauacgauuauccuaaauacuccgaagaggccaagcugaacagagaggaaauugacggggucaaacuugagagcacuaggaucuaucagauucuggcuauauacucuaccguggcgucaaguuugguccucgugguuagccugggagcaaucuccuuuuggaugugcucuaaugguucguuacaaugccggauuuguaucuga

SEQ ID NO: 129956 - RNA, 1701 nt, Artificial Sequence
  derived and/or modified sequence opt3 from hemagglutinin__InfluenzaA__AEX25798
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccacaacauucauccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaccaccagaacgaacagggaagcggcuacgcagcugaccucaaauccacccaaaaugccauugaugagaucacgaacaagguaaauucuguuauagagaaaaugaacacccaguuuacagcuguggguaaggaguucaaucaucuggaaaagcggauugaaaacuuaaauaaaaaggucgacgauggguuccuggacaucuggacuuacaacgccgagcuccuugugcuguuggaaaaugagcgcacccuagauuaucacgacagcaacgugaaaaaccuguacgagaagguucgaucacagcucaaaaauaacgcaaaggaaaucggcaauggauguuuugaguucuaucauaagugcgauaacacauguauggaaagugugaaaaauggcacuuacgacuauccuaaguacuccgaggaagccaaacugaacagagaggagauugauggggucaaacuugaaagcaccaggaucuaucagauucuggcuauauacucuacaguggcgucaaguuugguccucgugguuagccugggagcaaucuccuuuuggaugugcucuaaugguucguuacaaugccggauuuguaucuga

SEQ ID NO: 129957 - RNA, 1701 nt, Artificial Sequence; identical to SEQ ID NO: 124685
  derived and/or modified sequence opt3 from hemagglutinin__InfluenzaA__AEX25800

SEQ ID NO: 129958 - RNA, 1701 nt, Artificial Sequence; identical to SEQ ID NO: 124685
  derived and/or modified sequence opt3 from hemagglutinin__InfluenzaA__AEX25803

SEQ ID NO: 129959 - RNA, 1701 nt, Artificial Sequence; identical to SEQ ID NO: 124927
  derived and/or modified sequence opt3 from hemagglutinin__InfluenzaA__AEX25808

SEQ ID NO: 129960 - RNA, 1701 nt, Artificial Sequence; identical to SEQ ID NO: 127655
  derived and/or modified sequence opt3 from hemagglutinin__InfluenzaA__AEX25810

SEQ ID NO: 129961 - RNA, 1701 nt, Artificial Sequence
  derived and/or modified sequence opt3 from hemagglutinin__InfluenzaA__AEX25811
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuuguuuacagcaucaaguuggagcuacauuguugaaaccuccucuucggacaacggaacuugcuauccaggcgauuucaucgacuacgaggagcucagggaacagcugucaagcgugaguuccuuugagcgguucgaaauuuuuccgaaaacaucuagcuggcccaaucacgauuccaacaagggugucaccgccgcuuguccucaugcaggggccaagucauucuauaaaaaucugaucuggcucgugaagaaaggaaacaguuacccaaaguuaagcaaaucuuauauaaaugacaagggcaaggagguacugguucuuuggggcauccaccaccccuccacgucagcugaucaacagagcuuguaccagaacgccgacgcguacguguuugucgggaguucucgcuauuccaaaaaguucaaaccugagauugcaauccgaccaaaggugcgugaucaggaaggaagaaugaauuacuauuggacucugguggagcccggugacaaaauuaccuuugaagccacaggcaaccuagucguuccuagguacgcuuucgccauggagcggaaggcagggagcggaaucauaauuucggauacuccagugcaugacugcaacaccacaugucaaaccccgaaaggcgcuaucaauacgucucuccccuuucacaacauucauccuaucacuaucgguaagugcccaaaguauguaaaauccacaaagcugcgccuugccaccgggcugagaaaugugcccucaauucagaguaggggauuguucggcgcgauagccggcuuuaucgaagggggauggacugguauggucgacggcugguacggguaucaccaccagaacgagcagggaagcggcuacgcagcugaucucaaauccacacaaaaugccauugacgagaucaccaacaagguaaauucuguuauagaaaagaugaacacgcaguucaccgcuguggguaaggaguucaaucaucuggaaaagcggauugagaacuuaaauaaaaaggucgaugacggguuucuggauaucuggacauacaacgccgaacuccuugugcuguuggagaaugagcgcacucuagacuaucacgauagcaacgugaaaaaucuguacgaaaagguucgaucacagcucaaaaacaacgcaaaggagaucggcaauggauguuucgaauuuuaucauaagugcgacaacaccuguauggagagugugaaaaauggcacauacgauuauccuaaguacuccgaagaggccaaacugaacagagaggaaauugacggggucaaacuugagagcacuaggaucuaucagauucuggcuauauacucuaccguggcgucaaguuugguccucgugguuagccugggagcaaucuccuucuggaugugcucuaaugguucguuacaaugccggauuuguaucuga

SEQ ID NO: 129962 - RNA, 1701 nt, Artificial Sequence; identical to SEQ ID NO: 127655
  derived and/or modified sequence opt3 from hemagglutinin__InfluenzaA__AEX25814

SEQ ID NO: 129963 - RNA, 1701 nt, Artificial Sequence
  derived and/or modified sequence opt3 from hemagglutinin__InfluenzaA__AEX25816
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucaacuacgaggagcucagggagcagcugucaagcgugaguuccuucgaacgguuugagauuuucccgaagacaucuagcuggcccaaucacgacuccaacaagggugucaccgccgcuuguccucaugcaggggccaaaucauuuuauaagaaucugaucuggcucgugaaaaagggaaacaguuacccaaaauuaagcaagucuuauauaaaugauaagggcaaagaaguacugguucuuuggggcauccaccaccccuccacgucagcugaccaacagagcuuguaccagaacgccgaugcguacguguucgucgggaccagucgcuauucuaagaaauuuaagccugagauugcaauccgaccaaaagugcgugaccaggagggaagaaugaacuacuauuggacucugguggaacccggugauaagauuacauucgaggccacuggcaaucuagucguuccuagguacgcuuuugccauggaacggaacgcaggguccggaaucauaauuagcgacaccccagugcaugauugcaauacaaccugucaaacgccgaaaggcgcuaucaacacuucgcuccccuuccagaauauucacccuaucacaaucgguaagugcccaaaguauguaaaaucuaccaagcugcgccuugccacugggcugagaaacgugcccuccauucagucaaggggauuguuuggcgcgauagccggcuucaucgaagggggauggacagguauggucgacggcugguacggguaucaucaccagaaugaacaaggaaguggcuacgcagcugaccucaaaagcacccagaacgccauugaugagaucacgaauaaggugaacuccguuauagagaaaaugaauacccaguuuacagcuguggguaaggaguucaaccaccuggaaaagcggauugaaaauuuaaacaaaaaggucgacgauggguuccuggacaucuggacuuacaaugccgagcuccuugugcuguuggaaaacgagcgcacccuagauuaucaugacucuaacguaaagaaucuguacgagaagguucgaagccagcucaaaaacaaugcaaaggaaaucggcaacggauguuuugaguucuaucacaagugcgauaauacauguauggaaucagugaaaaacggcacuuacgacuauccuaaguacagugaggaagccaaacugaauagagaggagauugauggggucaaacuugaauccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 129964 - RNA, 1701 nt, Artificial Sequence
  derived and/or modified sequence opt3 from hemagglutinin__InfluenzaA__AEX25818
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuaacucggacaauggaacuugcuauccaggcgauuuuaucgacuacgaggagcucagggaacagcugucaagcgugaguuccuucgagcgguuugaaauuuucccgaaaacaucuagcuggcccaaccacgauuccaauaagggugucaccgccgcuuguccucaugcaggggccaagucauuuuauaaaaaccugaucuggcucgugaagaaaggaaauaguuacccaaaguuaagcaaaucuuauauaaacgacaagggcaaggagguacugguucuuuggggcauccaccaccaauccacgucagcugaucagcagagcuuguaccagaaugccgacgcguacguguucgucgggaguucucgcuauuccaaaaaguuuaaacccgagauugcaauccgaccuaaggugcgugaucaagaaggaagaaugaacuacuauuggacucugguggagccaggugacaaaauuaccuucgaagccacaggcaaccuagucguucccagguacgcuuuugccauggagcggaaugcagggagcggaaucauaauuucggauacuccugugcaugacugcaacaccacaugucagaccccaaagggcgcuaucaauacgucucucccguuccacaacauucaucccaucacuaucgguaaaugcccuaaguauguaaaguccacaaaacugcgccuugccaccgggcugagaaaugugccaucaauucagaguaggggauuguuuggcgcgauagccggcuucaucgaagggggauggacugguauggucgacggcugguacggguaucaccaccagaacgagcaaggaagcggcuacgcagcugaucucaaguccacacagaaugccauugacgagaucaccaacaaaguuaauucugugauagaaaagaugaacacgcaguuuaccgcuguggguaaagaguucaaucaucuggaaaagcggauugagaacuuaaauaagaaagucgaugacggguuccuggauaucuggacauacaacgccgaacuccuugugcuguuggagaaugagcgcacucuagacuaucacgauagcaacguaaagaaccuguacgaaaaaguucgaucacagcucaagaauaacgcaaaagagaucggcaauggauguuuugaguucuaucauaagugcgacaacaccuguauggaaagugugaagaauggcacauacgauuaucccaaauacuccgaagaggccaagcugaacagagaggaaauugacggggucaaacuugagagcacuaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 129965 - RNA, 1701 nt, Artificial Sequence
  derived and/or modified sequence opt3 from hemagglutinin__InfluenzaA__AEX25824
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguagaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 129966 - RNA, 1698 nt, Artificial Sequence
  derived and/or modified sequence opt3 from hemagglutinin__InfluenzaA__AEX33420
augaaggugaaacugcucguccuucugugcaucuucaccgccacauacgcugacacuauuuguauaggcuaucacgcaaacaauagcacggauaccguugacacaguguuggagaagaacguaacugugacccauuccgucaauuuacuggaagauucucacaacgggaaacuaugccuccugaagggaaucgcgccccuucagcuggguaauuguucaguggccggcuggauuuuggggaacccugagugcgaacuccugaucaguaaagagagcugguccuacauuguugaaacaccaaauccggagaacggaaccuguuaucccggcuacuuugcugacuaugaggaacugagagagcaacucucuucggugagcucauucgaaagguuugagaucuucccuaaggagaguuccuggccaaaucauacugucacaggugugucugccagcugcucccacaacgggaagucaaguuuuuaccggaauuuacuguggcuuaccggaaaaagcggcuuguaucccaaccugucuaaguccuacgcaaauaacaaagaaaaggagguacuuguucucuggggcgugcaucacccuccaaauauaggggaucagcgcgcccuguaccacacggaaaacgcuuaugucucaguggugagcagucauuacucucgacguuucacucccgagaucgcaaaaagaccuaaggucagggaccaggaaggacggauuaacuauuacuggacccuucuggagccaggugauacaaucauuuuugaggccaauggcaacuugaucgcuccgcgcuaugccuucgcgcucuccagaggguuuggaagcggcauaauuacuucgaaugcacccauggacgaaugugaugccaagugccagaccccucaaggugcuaucaacucuucccugccauuccagaauguucaccccgugacaauuggggaguguccuaaauacguaaagucagccaaauuaaggauggugaccggacugcggaacaucccaaguauccagagccgcggccucuuuggcgcaauugcuggguucauagaaggagguuggacgggcauggucgacgggugguauggauaccaucaccagaaugagcaaggcuccgguuacgccgcggaucagaagucuacucagaacgccaucaaugggauuacaaacaaagugaauagcguuaucgaaaagaugaacacccaguuuacugcagugggcaaagaguucaauaagcuagagcgaagaauggaaaaccugaauaagaaagucgacgauggauucuuggacauauggacauauaacgcugagcuacuggugcuccuggaaaacgagaggacccuugacuuucacgauucaaauguaaagaaccuguacgaaaaaguuaagagucaauugaaaaauaacgccaaggagauuggcaaugggugcuucgaguuuuaucauaaguguaacgacgaaugcauggaguccgugaaaaauggaacguacgauuaucccaaguacagcgaagagucuaaacucaaccgggagaagaucgacggugucaaacuggaaucaaugggcguguaucagaucuuagcuauuuacaguaccgucgccagcucccuggugcuacucguuucucugggggcaaucucguucuggaugugcagcaauggaucccuucagugucguauuugcauauga

SEQ ID NO: 129967 - RNA, 1701 nt, Artificial Sequence
  derived and/or modified sequence opt3 from hemagglutinin__InfluenzaA__AEX33453
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccgacaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucaccagauagaaaaggaguucucagaaguggagggcagaauccaggaucuggaaaaauauguagaggacacaaagauugauuuauggaguuacaaugccgagcugcucguggcacuugaaaaccaacauacuaucgaccugaccgauuccgagaugaacaaauuguucgaaaggacaaagaagcagcuacgggagaaugcugaagacaugggaaacggcugcuuuaaaaucuaucacaagugugauaaugccugcauugggagcauacgaaacggaacuuacgaccaugacgucuaccgcgaugaggcucugaauaacagauuccagaucaaagguguggagcucaagucuggcuauaaagacuggauucuguggaucucauuugccauuaguugcuuccuucuguguguugcauugcucggguuuaucaugugggccugccagaagggaaauauaagguguaacaucugcauuuga

SEQ ID NO: 129968 - RNA, 1701 nt, Artificial Sequence; identical to SEQ ID NO: 123811
  derived and/or modified sequence opt3 from hemagglutinin__InfluenzaA__AEX33464

SEQ ID NO: 129969 - RNA, 1701 nt, Artificial Sequence; identical to SEQ ID NO: 123811
  derived and/or modified sequence opt3 from hemagglutinin__InfluenzaA__AEX33475

SEQ ID NO: 129970 - RNA, 1701 nt, Artificial Sequence; identical to SEQ ID NO: 123811
  derived and/or modified sequence opt3 from hemagglutinin__InfluenzaA__AEX33486

SEQ ID NO: 129971 - RNA, 1701 nt, Artificial Sequence; identical to SEQ ID NO: 123811
  derived and/or modified sequence opt3 from hemagglutinin__InfluenzaA__AEX33497

SEQ ID NO: 129972 - RNA, 1701 nt, Artificial Sequence; identical to SEQ ID NO: 123811
  derived and/or modified sequence opt3 from hemagglutinin__InfluenzaA__AEX33508

SEQ ID NO: 129973 - RNA, 1701 nt, Artificial Sequence; identical to SEQ ID NO: 123811
  derived and/or modified sequence opt3 from hemagglutinin__InfluenzaA__AEX33519

SEQ ID NO: 129974 - RNA, 1701 nt, Artificial Sequence
  derived and/or modified sequence opt3 from hemagglutinin__InfluenzaA__AEX33541
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucuagcugcaagcggcgcuccaauaagucauuuuucagucgacugaacuggcucacucauuuaaaauauaaguacccagcucugaaugugaccaugcccaacaaugagaaauuugauaaacuuuauauuuggggcguccaccauccuggcacagacagcgaucagaucucuuuguacgcacaggccuccgggcguauuacugugucaaccaagagaagccaacagacaguaaucccaaacauaggaaguaggccccggguucgcgacgugucuuccagaauuagcaucuacuggaccauugucaagccuggugacauccugcuaaucaacucgacgggcaaucucauugcuccaaggggguauuucaagauacggucuggaaaauccucaaucaugcgcagugaugccccgauuggcaaguguaacagcgagugcaucacucccaaugguuccauaccuaacgacaaaccauuucagaaugugaaccgaauuacauacggggcgugucccagauaugugaagcagaauacccugaaacuugcaacuggaaugaggaacgucccugaaaagcaaacacggggcaucuucggcgccaucgcuggguuuauugagaauggaugggaagguaugguugauggcugguacggguuccgucaccagaacucugagggaaccggccaggccgcagaccugaaaagcacgcaagcugccaucaaucagauuaacgguaaguugaaucgccucauagggaagaccaacgagaaauuucaccagaucgaaaaggaguucucagaaguggagggcaggauucaggaucuggaaaaauauguagaggacacaaagaucgauuuauggaguuacaaugcggagcugcucguggcccuugaaaaccaacauacuaucgaccugaccgauuccgagaugaacaaauuguucgaaagaacaaagaagcagcuacgggagaaugcagaagacaugggaaacggcugcuuuaaaauuuaucacaagugugauaaugcuugcauagggagcauccgaaacggaacuuacgaccaugacgucuaccgcgaugaggcccugaauaacagauuccagauuaaagguguggagcucaagucuggcuauaaagacuggauccuguggauuucauuugcuaucaguugcuuccuucuguguguugccuugcucggguuuauaaugugggcaugccagaagggaaauaucagguguaacauuugcaucuga

SEQ ID NO: 129975 - RNA, 1701 nt, Artificial Sequence
  derived and/or modified sequence opt3 from hemagglutinin__InfluenzaA__AEX33574
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgaugugccuaguagaauaucuauuuacuggaccaucgucaagccaggugacauucugcuaaucaacuccacgggcaaucucaucgccccgaggggguacuuuaagauucggagcggaaaaucgucuauaaugcgcuccgacgcgcccaucggcaaguguaacucagagugcauuacuccuaaugguaguaucccaaacgauaaacccuuccagaaugugaaccgaauaacauauggggcauguccuagauacgugaagcagaauacccugaaacuugccacuggaaugaggaacgucccagaaaagcaaacacggggcauuuuuggcgcuaucgccggguucaucgagaauggaugggaagguaugguugacggcugguauggguuucgucaccagaacagcgagggaaccggccaggcagcugaucugaaauccacgcaagccgcgauuaaucagaucaacgguaaguugaaucgccucauugggaagaccaacgagaaauuccaccagauagaaaaggaguucucugaaguggagggcagaauccaggaccuggaaaaauacguagaggauacaaagauugacuuauggagcuauaacgccgagcugcucguggcacuugaaaaucaacauacuaucgaucugaccgacucagagaugaacaaauuguuugaaaggacaaagaagcagcuacgggagaaugcugaagauaugggaaacggcugcuucaaaaucuaccacaagugugacaaugauugcauugggaguauacgaaacggaacuuaugaccaugacgucuaccgcgaugaggcccugaauaacagauuucagaucaaagguguggagcucaaguccggcuacaaagacuggauucuguggaucagcuucgcuauuucuugcuuucuucuguguguugccuugcucggguucaucaugugggcaugccagaagggaaauauaagguguaacaucugcauuuga

SEQ ID NO: 129976 - RNA, 1701 nt, Artificial Sequence; identical to SEQ ID NO: 123811
  derived and/or modified sequence opt3 from hemagglutinin__InfluenzaA__AEX33585

SEQ ID NO: 129977 - RNA, 1701 nt, Artificial Sequence
  derived and/or modified sequence opt3 from hemagglutinin__InfluenzaA__AEX33596
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuagcuuguaugcccaggcuucugggcguaucacuguguccaccaagagaucacaacagacaguaauuccaaauaucggaagcaggccccggguucgcgauauaccuaguagaauuucuaucuacuggaccauugugaagccaggugacauccugcuaaucaacuccacgggcaaucucauugccccgaggggguacuuuaagauacggagcggaaaaucgucuaucaugcgcuccgacgcgcccauuggcaaguguaacucagagugcaucacuccuaaugguaguauaccaaacgauaaacccuuccagaaugucaaccgaauuacauauggggcauguccuagauacgugaagcagaauacccugaaacuugccacuggaaugaggaacgugccagaaaagcaaacacggggcaucuuuggcgcuaucgccggguucauugagaauggaugggaagguauggucgacggcugguauggguuucgucaccagaacagcgagggaaccggccaggcagcugaucugaaauccacgcaagccgcgaucaaucagauuaacgguaaguugaaucgccucauagggaagaccaacgagaaauuccaccagaucgaaaaggaguucucugaaguugagggcaggauucaggaccuggaaaaauacguggaggauacaaagaucgacuuauggagcuauaacgccgagcugcucguagcacuugaaaaucaacauacuaucgaucugaccgacucagagaugaacaaauuguuugaaagaacaaagaagcagcuacgggagaaugcugaagauaugggaaacggcugcuucaaaauuuaccacaagugugacaaugccugcauagggaguauccgaaacggaacuuaugaucaugacguguaccgcgacgaggcucugaauaacagauuucagauuaaaggugucgagcucaaguccggcuacaaagauuggauccuguggauuagcuucgccaucucuugcuuucuucuguguguggcauugcucggguucauaaugugggccugccagaagggaaauaucagguguaacauuugcaucuga

SEQ ID NO: 129978 - RNA, 1701 nt, Artificial Sequence; identical to SEQ ID NO: 123811
  derived and/or modified sequence opt3 from hemagglutinin__InfluenzaA__AEX33618

SEQ ID NO: 129979 - RNA, 1701 nt, Artificial Sequence; identical to SEQ ID NO: 123811
  derived and/or modified sequence opt3 from hemagglutinin__InfluenzaA__AEX33629

SEQ ID NO: 129980 - RNA, 1701 nt, Artificial Sequence; identical to SEQ ID NO: 129977
  derived and/or modified sequence opt3 from hemagglutinin__InfluenzaA__AEX33640

SEQ ID NO: 129981 - RNA, 1701 nt, Artificial Sequence
  derived and/or modified sequence opt3 from hemagglutinin__InfluenzaA__AEX33836
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauaucuuccugaucaacucuacgggcaaucuaauugccccgaggggguacuuuaagauacgguccggaaagagcucgaucaugcgcucugacgcgcccauuggcaaauguaacuccgagugcaucacuccuaaugguucaauaccaaacgacaagcccuuccagaaugucaaccgaauuacauauggggcauguccuagauacgugaaacagaauacccucaagcuggccacuggaaugaggaacgugccagaaaaacaaacacggggcaucuuuggcgcuaucgccggguucauugagaauggaugggaagguauggucgauggcugguauggguuccgucaccagaacagugagggaaucggccaggcagcugaccuuaagagcacccaagccgcgauuaaucagauaaacgguaaacugaaccgcuugaucgggaagacgaaugagaaguuucaccagauugaaaaagaguucuccgaaguugagggcagaauccaggaucucgaaaaguacguggaggacaccaaaaucgaucuguggucuuauaacgccgaguuacugguagcacucgaaaaucaacauacaauugaccuuacugauagcgagaugaacaagcuguuugaaaggaccaaaaagcaguugcgggagaaugcugaagacaugggaaacggcugcuucaagauauaccacaaaugugauaaugccugcaucgggucaauucgaaacggaacauaugaccaugauguguaccgcgacgaggcucuaaauaacagauuucagaucaagggugucgagcugaaaaguggcuacaaggacuggauucucuggaucuccuucgccauaagcugcuuucugcuuuguguggcacuguugggguucaucaugugggccugccagaaaggaaauauuagguguaacaucugcauuuga

SEQ ID NO: 129982 - RNA, 1701 nt, Artificial Sequence; identical to SEQ ID NO: 122646
  derived and/or modified sequence opt3 from hemagglutinin__InfluenzaA__AEX33880

SEQ ID NO: 129983 - RNA, 1698 nt, Artificial Sequence
  derived and/or modified sequence opt3 from hemagglutinin__InfluenzaA__AEX33913
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaauaguuggccaaaccacacuacaaccggugucuccgccucuugcagccauaauggggaauccucauuuuauaagaacuuacuguggcuuacgggcaaaaauggauuguaccccaaccugaguaagagcuaugcaaauaacaaaaagaaagaggugcuaguacucuggggcguucaccacccuccaaacaucgggaaucagcgcgcccuguaccauacugaaaacgcuuacgugucugucguguccucacacuauagccgaaaguucacccccgagauagcaaagcguccuaaagugagagaucaggaaggaaggaucaauuacuauuggacacuucuggagccaggugacacuauuaucuuugaggccaacggcaauuugauugcuccgcgguacgccuucgcgcucagucgcggguuuggaucuggcaucauaaacuccaaugcacccauggaugaaugugacgccaagugccagaccccucaaggugcuauuaacagcucgcugccauuccagaauguccaucccguuacaaucggggaguguccuaaauaugugagaucugccaaguuaaggaugguaaccggacugcggaacauuccauccauccagucacgcggccucuuuggcgcaaucgcuggguucauugaaggagguuggacgggcaugguggaugggugguacggauaucaccaccagaaugagcaaggcagugguuacgccgcggaccagaaaagcacucagaacgccauaaaugggaucacaaacaaggucaauuccgugauugaaaagaugaacacccaguuuacugcaguuggcaaggaguucaacaaacuugagcgaagaauggaaaaucugaacaaaaagguggaugacggauucaucgauauauggacauacaaugcugaguugcuaguccugcucgaaaacgagaggacccuggacuuucaugacucuaaugugaaaaaccuuuaugaaaagguaaaaagccaacugaagaauaacgccaaggagauuggcaaugggugcuucgaguuuuaccacaaauguaacgaugaaugcauggagucaguuaagaauggaacguaugacuaccccaaauauagugaagaguccaaguugaaccgggagaaaaucgauggugugaaguucgaaagcaugggcgucuaccagauccucgcuauuuauucuaccguggccucaagucuggucuuacuggugagccuaggggcaaucuccuuuuggaugugcucuaauggaucgcuccagugucguauuugcauauga

SEQ ID NO: 129984 - RNA, 1698 nt, Artificial Sequence
  derived and/or modified sequence opt3 from hemagglutinin__InfluenzaA__AEX33924
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaaagucucauuagcagagaguccuggucuuacaucguugaaaaaccaucgccggagaauggaaccuguuaucccggccauuuugcugacuacgaggaacugagggagcaacugucaagcgugaguuccuucgaacgguuugagauuuucccuaaggagucuagcuggccaaaccacacugccacaggugucuccgcaucaugcagucauaauggaaagagcucuuuuuauaaaaaccucuuauggcugaccgggaagaauggccuuuaccccaacuuguccaaaucauaugccaauaacaaggaaaaagaggugcugguacuauggggcguucaccacccuccaaauaucggggaucagcgcgcucucuaccauacggaaaacgcauacgugagcgucgugaguucucacuauucccgaaaguucacucccgagauagccaagcguccuaaagugagagaccagaagggaaggaucaacuacuauuggacccugcuugaaccaggugauacaauuaucuuugaggcuaauggcaaccugauugccccgcgguacgcguucgcauugagccgcggguuuggaucgggcaucauaaauucuaacgcccccauggacgagugugaugcuaaaugccagacuccucaaggugccauuaauuccucacucccauuccagaacguccaucccguuaccaucggggaauguccuaaguaugugagaagugcaaaacugaggaugguaacaggauuacggaauauuccaagcauccagucccgcggccuguuuggcgcuaucgccggguucauugagggagguuggaccggcaugguggacgggugguacggauaucaccaccagaacgaacaaggcucugguuacgcggccgaucaaaagagcacgcagaaugcaauaaacgggaucacuaauaaagucaacucagugauugagaagaugaauacacaguuuaccgcuguuggcaaggaguucaacaaacucgaacgaagaauggagaaucuuaacaagaaaguggacgauggauucaucgacauauggacuuacaacgccgaacuguugguccuacuggagaaugaaaggacacucgacuuucaugauaguaacgugaagaaucuguaugagaaaguaaagucccagcuuaagaacaaugcuaaagaaauuggcaacgggugcuucgaguuuuaccacaaguguaaugacgagugcauggaaagcguuaaaaacggaaccuaugauuaccccaaguauucugaggaaucaaaacugaaucgggagaagaucgacggugugaaguuggagaguaugggcgucuaccagauccucgccauuuauagcacgguggcauccucucuggucuuacuggugucgcuaggggccaucagcuucuggaugugcuccaacggaucacuccagugucguauuugcauauga

SEQ ID NO: 129985 - RNA, 1701 nt, Artificial Sequence
  derived and/or modified sequence opt3 from hemagglutinin__InfluenzaA__AEX33957
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaguggagguaacuaaugcgaccgaacuggugcagaacucuucaacagguggcauuugcgacaguccacaccagauccuagauggggagaauuguacccucauagacgcucugcuuggagauccgcagugcgacggcuuucaaaacaaaaagugggaucuguucgucgaaagaagcaaagccuauuccaauuguuaccccuaugacgugccugauuacgcaucuuugaggucgcucguugccucaagcgguacucuggaguuuaacaaugaaaguuucaacuggacaggggugacccagaauggaacguccucugcuugcaagcggggcagcaacaauuccuuuuucucacgccugaacuggcucacucauaguaaguuuaaauauccagcauuaaaugucaccaugcccaacaacgaggaguucgacaagcuguacaucuggggcgugcaccauccugggacagauaaugaccagauuuuucuuuaugcccaggcuagcggacgaaucacuguaucuaccaaacguucccaacagacaguuauuccaaacaucgguucaagacccagggugcggaauauaccuagccgcauuaguaucuacuggaccauugucaagccaggcgauaucuugcugaucaacucuacggggaaucuaauugccccgagaggauacuucaaaauaagguccggcaagagcucgaucaugcggucugacgcgcccauugguaaguguaacuccgaaugcaucacuccuaaugggucaauaccaaacgacaaacccuuucagaaugugaaccgcauuacauauggagcauguccucgauacgugaagcagaauacccucaaacuggccacuggcaugagaaacgucccagagaagcaaacaaggggcaucuucggggcuaucgccggauuuauugaaaaugguugggagggcaugguugaugggugguauggauuccggcaccagaacagugagggcaucggucaggcagcugaccuuaaaagcacccaagccgcgauugaucagauaaaugggaagcugaaccguuugaucggcaaaacgaacgaaaaguuccaccagauugagaaggaauuuuccgagguggaaggacgcauccaggaccucgagaaauacguagaggauaccaagaucgaccuguggucuuauaaugccgaauuacugguggcacucgagaaccaacauacaauugaucuuacugacagcgaaaugaauaaacuguucgagaagaccaaaaagcaguugagagaaaacgcugaggauaugggcaaugggugcuuuaagauauaccacaaaugugacaacgccugcaucggaucaauuaggaaugguacauaugaucaugacgucuaccgggacgaggcucuaaacaaucgauuccagaucaagggcguggaacugaaaaguggguacaaggauuggauucucuggaucuccuuugccauaagcugcuuccugcuuuguguugcacuguugggauuuaucaugugggccugccagaaaggcaacauucgcuguaauaucugcauuuga

SEQ ID NO: 129986 - RNA, 1701 nt, Artificial Sequence
  derived and/or modified sequence opt3 from hemagglutinin__InfluenzaA__AEX33968
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuucuucacgcccaggcuagcggacgaauuacugugucuaccaaacguucccaacagacaguaaucccaaacauagguucaagacccaggguucggaauauuccuagccgcaucaguauuuauuggaccaucgugaagccaggcgauaucuugcugauuaacucuacggggaaucuaauagccccgagaggauacuucaaaaucagguccggcaagagcucgauuaugcggucugacgcgcccaucgguaaguguaacuccgaaugcauaacuccuaaugggucaauuccaaacgacaaacccuuucagaaugucaaccgcaucacauacggagcauguccucgauaugugaagcagaauacccucaaacuggccacuggcaugagaaacgugccagagaagcaaacaaggggcaucuucggggcuauugccggauuuaucgaaaaugguugggagggcauggucgaugggugguacggauuccggcaccagaacagugagggcauuggucaggcagcugaccuuaaaagcacccaagccgcgauagaucagaucaaugggaagcugaaccguuugauuggcaaaacgaacgaaaaguuccaucagaucgagaaggaauuuuccgagguugaaggacgcauccaggaccucgagaaauauguggaggauaccaagauugaccuguggucuuacaaugccgaauuacugguagcacucgagaaccaacacacaauagaucuuacugacagcgaaaugaauaaacuguucgagaagaccaaaaagcaguugagagaaaacgcugaggauaugggcaaugggugcuuuaagaucuaucauaaaugugacaacgccugcauuggaucaaucaggaaugguacauacgaucacgacguguaucgggacgaggcucuaaacaaucgauuccagauuaagggcgucgaacugaaaaguggguacaaggauuggauccucuggauauccuuugccaucagcugcuuccugcuuuguguggcacuguugggauuuauuaugugggccugccagaaaggcaacauccgcuguaauauuugcaucuga

SEQ ID NO: 129987 - RNA, 1701 nt, Artificial Sequence
  derived and/or modified sequence opt3 from hemagglutinin__InfluenzaA__AEX33979
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagauugacuuauggucuuauaaugccgaacugcucguagcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguguaccgagacgaggcucugaacaaucgcuuccagauuaacggagucgaacucaagagugguuacaaagauuggauccuguggauauccuuugccaucagcugcuuccuucuguguguggcauugcucggcuuuauuaugugggccugccagaaggggaauaucagauguaacauuugcaucuga

SEQ ID NO: 129988 - RNA, 1701 nt, Artificial Sequence
  derived and/or modified sequence opt3 from hemagglutinin__InfluenzaA__AEX33990
augaagaccaucauugcccugagcuacauacucuaucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacaggugagauuugugacagcccacaccagauccuagauggcgaaaauugcacccucauagacgcucugcuuggggauccgcagugugacggauuucaaaacaaaaagugggaucuguucguggagagauccaaagccuacucuaauugcuaucccuacgacgucccugauuaugcaucguugaggucacucguggccagcaguggcacucuggaauuuaacaaugaguccuucaacuggacagguguuacccagaaugggacgucuagcgcuuguauccggcgcuccaacaauucauuuuucagucgacugaacuggcucacucauuuaaaguuuaaguacccagcacugaaugugaccaugcccaacaacgagaaauucgacaaacuuuauauuuggggaguccaccauccuggcacagauaaugaccagaucuuuuuguacgcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuauuucaaaauccaguccggaaagagcucgauuaugcggucugacgcgcccaucgggaagugcaacuccgaauguauaacuccuaauggcucaauuccaaacgacaaacccuuucagaaugucaaccgcaucacauacggugcaugcccucgauaugugaagcaagauacccugaaacuugccacugggaugagaaaugugccagagaagcagacaaggggaaucuucggcgcuauugccggcuuuaucgaaaacgggugggagggaauggucgacgguugguacggcuuccggcaccagaauagugaggggauuggacaagcagcugaucugaaaagcacccaggccgcgauagaccagaucaacggcaaguugaaucgucucauugguaaaacgaacgaaaaguuccaccagaucgagaaggaauuuuccgagguugaagggcgcauccaagaucuggagaaauauguggaggacaccaagauugauuuauggucuuacaacgccgaacugcucguagcacuugagaaucagcauacaauagaccugacugauagcgaaaugaacaaauuguucgagaagaccaaaaagcagcuaagagaaaaugcugaggacaugggcaacggauguuuuaagaucuaucacaaaugcgauaaugccuguauuggcucaaucaggaacgggacauacgaccaugacguguaccgggaugaggcucugaauaaccgauuccagauuaagagugucgaacucaaauccggauauaaggacuggauccuguggaucagcuuugccauaucuugcuuccuucugugcguggcauugcucgguuuuauuaugugggccugucaaaaaggcaauauccgcugcaacauuuguaucuga

SEQ ID NO: 129989 - RNA, 1701 nt, Artificial Sequence
  derived and/or modified sequence opt3 from hemagglutinin__InfluenzaA__AEX34001
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacuccgaaucuuucaauuggacagggguuacccagaacggaacgagcuccgcuugcaagcggcgcucaaauaacagcuuuuucagccgacugaauuggcucacucauuuaaaguuuaaauauccagcacugaacgugaccaugcccaauaacgagaaguucgacaaacuuuacaucuggggcguccaccauccuggcacagauaacgaccagauuuuucuuuaugcccaggcuucugggcguaucacuguguccaccaagagaucacaacagacaguaauuccaaauaucggaagcaggccccggguucgcaacauaccuaguagaauuucuaucuacuggaccauugugaaaccaggugauauccugcuaaucaauuccacgggcaaccucauugccccgaggggguacuucaagauacggagcggaaagucgucuaucaugcgcuccgacgcgcccauuggcaaauguaauucagagugcaucacuccuaacgguaguauaccaaaugacaagcccuuucagaacgucaaucgaauuacauauggggcauguccuagauacgugaaacagaacacccugaaguuggccacuggaaugaggaaugugccagaaaaacaaacacggggcaucuucggcgcuaucgccggguuuauugagaacggaugggaagguauggucgauggcugguauggguuccgucaccagaaugcagagggaaucggccaggcugccgaccugaagaguacccaagcggccauuaaccagauaaaugguaaauugaaccgccucaucgggaagacgaacgagaaguuccaccagauugaaaaagaguuuuccgaaguugagggcagaauccaggaucuggaaaaguacguggaggacaccaaaaucgauuuauggucuuauaaugcagagcugcucguagcucuugaaaaccaacauacaauugaccugacugauagcgagaugaauaaguuguucgaaaggaccaaaaagcagcuacgggagaacgccgaagacaugggaaauggcugcuuuaagauauaccacaaaugugauaacgcuugcaucgggucaauucgaaauggaacauaugaccaugauguguaccgcgacgaggcccugaacaauagauuccagaucaagggugucgagcucaaaaguggcuacaaggacuggauucuguggaucuccuuugcaauaagcugcuuccuucuguguguggccuugcucggguuuaucaugugggcuugccagaaaggaaacauuagguguaauaucugcauuuga

SEQ ID NO: 129990 - RNA, 1701 nt, Artificial Sequence
  derived and/or modified sequence opt3 from hemagglutinin__InfluenzaA__AEX34012
augaagaccaucauugcccugagcuacauacucuaucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacagucuucaaguacaggugagauuugugacagcccacaccagauccuagauggcgaaaauugcacccucauagacgcucugcuuggggauccgcagugugacggauuucaaaacaaaaagugggaucuguucguggagagauccaaagccuacucuaauugcuaucccuacgacgucccugauuaugcaucguugaggucacucguggccagcaguggcacucuggaauuuaacaaugaguccuucaacuggacagguguuacccagaaugggacgucuagcgcuuguauccggcgcuccaacaauucauuuuucagucgacugaacuggcucacucauuuaaaguuuaaguacccagcacugaaugugaccaugcccaacaacgagaaauucgacaaacuuuauauuuggggaguccaccauccuggcacagauaaugaccagaucuuuuuguacgcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuauuucaaaauccaguccggaaagagcucgauuaugcggucugacgcgcccaucgggaagugcaacuccgaauguauaacuccuaauggcucaauuccaaacgacaaacccuuucagaaugucaaccgcaucacauacggugcaugcccucgauaugugaagcaaaauacccugaaacuugccacugggaugagaaacgugccagagaagcagacaaggggaaucuucggcgcuauugccggcuuuaucgaaaaugggugggagggaauggucgaugguugguacggcuuccggcaccagaacagugaggggauuggacaagcagcugaccugaaaagcacccaggccgcgauagaucagaucaauggcaaguugaaccgucucauugguaaaacgaacgaaaaguuccaccagaucgagaaggaauuuuccgagguugaagggcgcauccaagaccuggagaaauauguggaggauaccaagauugacuuauggucuuacaaugccgaacugcucguagcacuugagaaccagcauacaauagaucugacugacagcgaaaugaauaaauuguucgagaagaccaaaaagcagcuaagagaaaacgcugaggauaugggcaauggauguuuuaagaucuaucacaaaugcgacaacgccuguauuggcucaaucaggaaugggacauacgaucaugacguguaccgggacgaggcucugaacaaucgauuccagauuaagggagucgaacucaaaagugguuauaaggauuggauccuguggauauccuuugccaucagcugcuuccuucugugcguggcauugcucggcuuuauuaugugggccugucaaaaagggaacauccgcugcaauauuuguaucuga

SEQ ID NO: 129991 - RNA, 1701 nt, Artificial Sequence; identical to SEQ ID NO: 124450
  derived and/or modified sequence opt3 from hemagglutinin__InfluenzaA__AEX34023

SEQ ID NO: 129992 - RNA, 1701 nt, Artificial Sequence
  derived and/or modified sequence opt3 from hemagglutinin__InfluenzaA__AEX34044
augaagaccaucauugccuucagcuacauacugugccucguguuugcucagaaacuucccggcaucgacaacuccacagcaacucuguguuuggggcaccaugccgucccuaauggaacgauuguuaagaccaucacaaacgaucaaauugaggugacuaaugcgaccgaauuaguacagucuucaaguacagguggcaucugcgacagcccacaccagauacuggauggggagaacuguacccuaaucgacgcucuccugggagauccgcagugcgacggcuuccaaaauaaaaagugggaucuuuuuguggaaagauccaaagccuauucuaacuguuaccccuaugacgucccugauuacgcaucgcugaggucauugguggccagcagugguacucucgaguucaauaacgaauccuuuaauuggacagggguuacccagaacggaacgucuagcgcuugcaagcggggcuccaauaacucauucuuuagucgccugaauuggcugacucauagcaaguucaaauauccagcacucaacgugaccaugcccaauaacgaggaguuugacaaguuauacauuuggggcguccaccauccugggacagauaacgaccagaucuuccuguaugcccaggcuucuggacgaauuacuguguccaccaaacguucacaacagacaguaaucccaaauauagguagcagacccaggguucggaacauuccuagucgcaucucuauuuacuggaccaucgugaagccaggcgauauccuuuugauuaauuccacggggaaccugauagccccgagaggauacuuuaaaaucaggagcggcaagucgucuauuaugcgguccgacgcgcccaucgguaaguguaauucagaaugcauaacuccuaacgggaguauuccaaaugacaaacccuuccagaacgucaaucgcaucacauauggagcauguccucgauacgugaagcagaacacccuaaaacucgccacuggcaugagaaaugugccagagaagcaaacaaggggcaucuuuggggcuauugccggauucaucgaaaacgguugggagggcauggucgaugggugguauggauuccggcaccagaauagcgagggcauuggucaggcagcugaccugaaauccacccaagccgcgauagaucagaucaacgggaaacuuaaucgucugauuggcaagacgaacgaaaaguuucaccagaucgagaaggaguucucugaaguugaaggacgcauccaggacuuggagaaauacguggaggauaccaagauugaccucuggagcuauaacgccgaacuguuaguagcacuggagaaucaacauacaauagaucucacugacucagaaaugaacaaacuuuuugagaagaccaaaaagcagcugagagaaaaugcugaggauaugggcaacgggugcuucaagaucuaccacaaaugugacaaugccugcauuggaaguaucaggaacgguacauaugaucaugacguguaccgggacgaggcuuugaauaaccgauuucagauuaagggcgucgaacuaaaauccggguacaaggauuggauccuguggaucagcuucgccauaucuugcuuucuccuguguguggcacuucugggauucauuaugugggccugccagaaaggcaauauccgcuguaacauuugcaucuga

SEQ ID NO: 129993 - RNA, 1701 nt, Artificial Sequence
  derived and/or modified sequence opt3 from hemagglutinin__InfluenzaA__AEX34089
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcuccaacucauuuuucagucgccugaauuggcucacucauagcaaguuuaaauauccagcauuaaacgugaccaugcccaauaacgaggaguucgacaagcuguacauuuggggcguccaccauccugggacagauaacgaccagaucuuucuuuaugcccaggcuucuggacgaauuacuguguccaccaaacguucacaacagacaguaaucccaaauauagguagcagacccaggguucggaacauuccuagucgcaucucuauuuacuggaccaucgugaagccaggcgauaucuugcugauuaauuccacggggaaccuaauagccccgagaggauacuucaaaaucaggagcggcaagucgucuauuaugcgguccgacgcgcccaucgguaaguguaauucagaaugcauaacuccuaacgggaguauuccaaaugacaaacccuuucagaacgucaaucgcaucacauauggagcauguccucgauacgugaagcagaacacccucaaacuggccacuggcaugagaaaugugccagagaagcaaacaaggggcaucuucggggcuauugccggauuuaucgaaaacgguugggagggcauggucgaugggugguauggauuccggcaccagaauagcgagggcauuggucaggcagcugaccuuaaauccacccaagccgcgauagaucagaucaacgggaagcugaaucguuugauuggcaaaacgaacgaaaaguuccaccagaucgagaaggaauuuucugagguugaaggacgcauccaggaccucgagaaauacguggaggauaccaagauugaccuguggagcuauaacgccgaauuacugguagcacucgagaaucaacauacaauagaucuuacugacucagaaaugaacaaacuguucgagaagaccaaaaagcaguugagagaaaaugcugaggauaugggcaacgggugcuuuaagaucuaccacaaaugugacaaugccugcauuggaaguaucaggaacgguacauaugaucaugacguguaccgggacgaggcucuaaauaaccgauuccagauuaagggcgucgaacugaaauccggguacaaggauuggauccucuggaucagcuuugccauaucuugcuuccugcuuuguguggcacuguugggauuuauuaugugggccugccagaaaggcaauauccgcuguaacauuugcaucuga

SEQ ID NO: 129994 - RNA, 1701 nt, Artificial Sequence
  derived and/or modified sequence opt3 from hemagglutinin__InfluenzaA__AEX34123
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuucuuuaugcccaggcuagcggacgaauuacugugucuaccaaacguucccaacagacaguaaucccaaacauagguucaagacccaggguucggaauauuccuagccgcaucaguauuuacuggaccaucgugaagccaggcgauaucuugcugauuaacucuacggggaaucuaauagccccgagaggauacuucaaaaucagguccggcaagagcucgauuaugcggucugacgcgcccaucgguaaguguaacuccgaaugcauaacuccuaaugggucaauuccaaacgacaaacccuuucagaaugucaaccgcaucacauauggagcauguccucgauacgugaagcagaauacccucaaacuggccacuggcaugagaaacgugccagagaagcaaacaaggggcaucuucggggcuauugccggauuuaucgaaaaugguugggagggcauggucgaugggugguauggauuccggcaccagaacagugagggcauuggucaggcagcugaccuuaaaagcacccaagccgcgauagaucagaucaaugggaagcugaaccguuugauuggcaaaacgaacgaaaaguuccaccagaucgagaaggaauuuuccgagguugaaggacgcauccaggaccucgagaaauacguggaggauaccaagauugaccuguggucuuauaaugccgaauuacugguagcacucgagaaccaacauacaauagaucuuacugacagcgaaaugaauaaacuguucgagaagaccaaaaagcaguugagagaaaacgcugaggauaugggcaaugggugcuuuaagaucuaccacaaaugugacaacgccugcauuggaucaaucaggaaugguacauaugaucaugacguguaccgggacgaggcucuaaacaaucgauuccagauuaagggcgucgaacugaaaaguggguacaaggauuggauccucuggauauccuuugccaucagcugcuuccugcuuuguguggcacuguugggauuuauuaugugggccugccagaaaggcaacauccgcuguaauauuugcaucuga

SEQ ID NO: 129995 - RNA, 1701 nt, Artificial Sequence
  derived and/or modified sequence opt3 from hemagglutinin__InfluenzaA__AEX34134
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacagucuucaaguaccggugagauuugcgacagcccacaccagauccuagauggcgaaaauuguacacucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacccuggaauuuaacaaugaguccuucaacuggacugguguuacacagaaugggaccucuagcgcuugcauccggcgcuccaacaauucauuuuucagucgacugaacuggcucacgcauuuaaaguuuaaguauccagcacugaaugugacuaugcccaacaacgagaaauucgacaaacuuuacauuuggggaguccaccauccuggcaccgauaaugaccagaucuuuuuguaugcccaggcuagcggccguauuacagugucuacuaagagaucccaacagaccguaaucccaaacauagggucaaggccccggguucgcaauauuccuagcagaaucaguauuuacuggacaaucgugaagccaggagauauccugcuaauuaacucuaccgguaaucucauagccccgaggggcuacuucaaaauccgguccggaaagagcucgauuaugcgcucugacgcgcccaucgggaaguguaacuccgaaugcauaacgccuaauggcucaauuccaaacgacaaacccuuucagaaugucaaccgaaucacuuauggugcauguccuagauacgugaagcagaauacacugaaacuugccaccgggaugaggaacgugccagagaagcaaacucggggaaucuucggcgcuauugccggcuuuaucgaaaaugggugggagggaauggucgaugguugguauggcuuccgucaccagaacagugaggggauuggacaggcagcugaccugaaaagcacacaagccgcgauagaucagaucaauggcaaguugaaccgccucauugguaaaaccaacgaaaaguuccaccagaucgagaaggaauuuuccgagguugaagggagaauccaggaccuggagaaauacguggaggauacgaagauugacuuauggucuuauaaugccgaacugcucguagcacuugagaaccaacauaccauagaucugacagacagcgaaaugaauaaauuguucgagaagacuaaaaagcagcuaagggaaaacgcugaggauaugggcaauggaugcuuuaagaucuaccacaaaugugacaacgccugcauuggcucaauccggaaugggaccuaugaucaugacguguaccgagacgaggcucugaacaaucgcuuccagauuaagggagucgaacucaaaagugguuacaaggauuggauccuguggauauccuuugccaucagcugcuuccuucuguguguggcauugcucggcuuuauuaugugggccugccagaaagggaacaucagauguaauauuugcaucuga

SEQ ID NO: 129996 - RNA, 1701 nt, Artificial Sequence; identical to SEQ ID NO: 129994
  derived and/or modified sequence opt3 from hemagglutinin__InfluenzaA__AEX34145

SEQ ID NO: 129997 - RNA, 1701 nt, Artificial Sequence
  derived and/or modified sequence opt3 from hemagglutinin__InfluenzaA__AEX34156
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcggcagcccacaccagauccuagacggggaaaauuguacccucauagaugcucugcuuggagacccgcagugcgauggcuuucaaaacaaaaagugggaccuguucguggagagauccaaagccuauucuaauuguuaccccuaugaugucccugacuacgcaucguugaggucacucguggccagcagugguacucuggaauuuaacaaugaguccuucaacuggacagggguuacccagaauggaacgucuagcgcuugcauccggcgcuccaacaauucauuuuucagucgacugaacuggcucacucauuuaaaguuuaaguauccagcacugaaugugaccaugcccaacaacgagaaauucgauaaacuuuacauuuggggcguccaccauccuggcacagacaaugaucagaucuuuuuguaugcccaggcuagcgggcguauuacugugucuaccaaaagaucccaacagacaguaaucccaaacauaggaucaaggccccggguucgcaauauuccuagcagaaucaguauuuacuggaccaucgugaagccaggugacauccugcuaauuaacucuacgggcaaucucauagccccgaggggguacuucaaaauccgguccggaaagagcucgauuaugcgcucugaugcgcccaucggcaaguguaacuccgaaugcauaacuccuaaugguucaauuccaaacgacaaacccuuucagaaugucaaccgaaucacauauggggcauguccuagauacgugaagcagaauacccugaaacuugccacuggaaugaggaacgugccagagaagcaaacacggggcaucuucggcgcuauugccggguuuaucgaaaauggaugggaggguauggucgacggcugguauggguuccgucaccagaacagugagggaaccggccaggcagcugaucugaaaagcacgcaagccgcgauugaccagauaaaugguaaguugaaccgccucaucgggaaaaccaacgaaaaguuccaccagauugagaaggaauuuuccgagguugaaggcagaauccaggaucuggagaaauacguggaggacacaaagaucgauuuauggucuuauaaugccgaacugcucguagcacuugagaaccaacauacuauugaccugaccgauagcgaaaugaauaaauuguucgagaagacaaagaagcagcuaagggaaaacgcugaggacaugggaaauggcugcuuuaagauauaccacaaaugugauaacgccugcaucgggucaauucggaauggaacuuaugaccaugauguguaccgagacgaggcucugaacaaucgcuuccagaucaagggugucgaacucaaaaguggcuacaaggacuggauucuguggaucuccuuugccauaagcugcuuccuucugugugugguuuugcucggguuuaucaugugggcaugccagaaaggaaacauuagauguaauaucugcauuuga

SEQ ID NO: 129998 - RNA, 1701 nt, Artificial Sequence; identical to SEQ ID NO: 123944
  derived and/or modified sequence opt3 from hemagglutinin__InfluenzaA__AEX34178

SEQ ID NO: 129999 - RNA, 1701 nt, Artificial Sequence
  derived and/or modified sequence opt3 from hemagglutinin__InfluenzaA__AEX34188
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacaggugagauuugcgacagcccacaccagauccuggauggcgaaaauuguacccuaauagacgcucuccugggggauccgcagugcgacggauuccaaaacaaaaauugggaucuuuuuguggagagauccaaggccuauucuaacuguuaccccuaugacgucccugauuacgcaucgcugaggucauugguggccagcaguggcacucucgaguucaauaacgaauccuuuaauuggacagguguuacccagaacgggacgucuagcgcuugcauccggcgcuccaauaacucauucuuuagucgacugaauuggcugacucaucucaaauucaaguauccagcauuaaacgugaccaugcccaacaaugagaacuuugacaagcuguacauuuggggaguccaccauccuggcacagauaaugaccagaucuuccuuuaugcccaggcuagcggccguauuacugugucuaccaaaagaucccaacagacaguaaucccaaacauagggucaaggccccggguucgcaauauuccuagcagaaucaguauuuacuggaccaucgugaagccaggagauaucuugcugauuaacucuacggguaaucuaauagccccgaggggcuacuuuaaaauccgguccggaaagagcucgauuaugcgcucugacgcgcccaucgggaaauguaacuccgaaugcauaacuccuaauggcucaauuccaaacgacaagcccuuccagaaugucaaccgaaucacauauggugcauguccuagauacgugaagcagaauacccucaaacuggccacugggaugaggaacgugccagagaagcaaacacggggaaucuuuggcgcuauugccggcuucaucgaaaaugggugggagggaauggucgaugguugguauggcuuccgucaccagaacagugaggggauuggacaggcagcugaccuuaaaagcacccaagccgcgauagaucagaucaacggcaagcugaaucgcuugauugguaaaacgaacgaaaaguuucaccagaucgagaaagaguucuccgaaguugaagggagaauccaggaccucgagaaguacguggaggauaccaagauugaccuguggucuuauaaugccgaauuacugguagcacucgagaaccaacauacaauagaucuuacugacagcgaaaugaauaaacuguuugagaagaccaaaaagcaguugagggaaaacgcugaggauaugggcaauggaugcuucaaaaucuaccacaagugugacaacgccugcauuggcucaauccggaaugggacauaugaucaugacguguaccgagacgaggcucuaaacaaucgcuuucagauuaagggagucgaacugaaaagugguuacaaggauuggauccucuggauauccuucgccaucagcugcuuucugcuuuguauugcacuguugggcuucaucaugugggccugccagaaagggaacauuagauguaauaucugcauauga

SEQ ID NO: 130000 - RNA, 1701 nt, Artificial Sequence; identical to SEQ ID NO: 124450
  derived and/or modified sequence opt3 from hemagglutinin__InfluenzaA__AEX34199

SEQ ID NO: 130001 - RNA, 1701 nt, Artificial Sequence
  derived and/or modified sequence opt3 from hemagglutinin__InfluenzaA__AEX34221
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauuggacagggguuacccagaacggaacgucuagcgcuugcaagcggggcuccaauaacucauuuuucagucgccugaauuggcucacucauagcaaguuuaaauauccagcauuaaacgugaccaugcccaauaacgaggaguucgacaagcuguacauuuggggcguccaccauccugggacagauaacgaccagaucuuucuuuaugcccaggcuucuggacgaauuacuguguccaccaaacguucacaacagacaguaaucccaaauauagguagcagacccaggguucggaacauuccuagucgcaucucuauuuacuggaccaucgugaagccaggcgauaucuugcugauuaauuccacggggaaccuaauagccccgagaggauacuucaaaaucaggagcggcaagucgucuauuaugcgguccgacgcgcccaucgguaagugugacucagaaugcauaacuccuaaugggaguauuccaaacgauaaacccuuucagaaugucaaccgcaucacauauggagcauguccucgauacgugaagcagaauacccucaaacuggccacuggcaugagaaacgugccagagaagcaaacaaggggcaucuucggggcuauugccggauuuaucgaaaaugguugggagggcauggucgacgggugguauggauuccggcaccagaacagcgagggcauuggucaggcagcugaucuuaaauccacccaagccgcgauagaccagaucaaugggaagcugaaccguuugauuggcaaaacgaaugaaaaguuccaccagaucgagaaggaauuuucugagguugaaggacgcauccaggaucucgagaaauacguggaggacaccaagauugaucuguggagcuauaacgccgaauuacugguagcacucgagaaccaacauacaauagaccuuacugauucagaaaugaauaaacuguucgagaagaccaaaaagcaguugagagaaaacgcugaggacaugggcaaugggugcuuuaagaucuaccacaaaugugauaacgccugcauuggaaguaucaggaaugguacauaugaccaugacguguaccgggaugaggcucuaaacaaucgauuccagauuaagggcgucgaacugaaauccggguacaaggacuggauccucuggaucagcuuugccauaucuugcuuccugcuuuguguggcacuguugggauuuauuaugugggccugccagaaaggcaacauccgcuguaauauuugcaucuga

SEQ ID NO: 130002 - RNA, 1701 nt, Artificial Sequence; identical to SEQ ID NO: 123944
  derived and/or modified sequence opt3 from hemagglutinin__InfluenzaA__AEX34243

SEQ ID NO: 130003 - RNA, 1701 nt, Artificial Sequence; identical to SEQ ID NO: 129999
  derived and/or modified sequence opt3 from hemagglutinin__InfluenzaA__AEX34254

SEQ ID NO: 130004 - RNA, 1701 nt, Artificial Sequence; identical to SEQ ID NO: 123944
  derived and/or modified sequence opt3 from hemagglutinin__InfluenzaA__AEX34265

SEQ ID NO: 130005 - RNA, 1701 nt, Artificial Sequence
  derived and/or modified sequence opt3 from hemagglutinin__InfluenzaA__AEX34275
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccuucacccugggacagauaaugaccagaucuuuuuguaugcccaggcuagcggacgaauuacugugucuaccaaacguucccaacagacaguaaucccaaacauagguucaagacccaggguucggaauauuccuagccgcaucaguauuuacuggaccaucgugaagccaggcgauauccugcuaauuaacucuacggggaaucucauagccccgagaggauacuucaaaaucagguccggcaagagcucgauuaugcggucugacgcgcccaucgguaaguguaacuccgaaugcauaacuccuaaugggucaauuccaaacgacaaacccuuucagaaugucaaccgcaucacauauggagcauguccucgauacgugaagcagaauacccugaaacuugccacuggcaugagaaacgugccagagaagcaaacaaggggcaucuucggggcuauugccggauuuaucgaaaaugguugggagggcauggucgaugggugguauggauuccggcaucagaacagugagggcauuggucaggcagcugaccugaaaagcacccaagccgcgauagaucagaucaaugggaaguugaaccgucucauuggcaaaacgaacgaaaaguuccaccagaucgagaaggaauuuuccgagguugaaggacgcauccaggaccuggagaaauacguggaggauaccaagauugacuuauggucuuauaaugccgaacugcucguagcacuugagaaccaacacacaauagaucugacugacagcgaaaugaauaaauuguucgagaagaccaaaaagcagcuaagagaaaacgcugaggauaugggcaaugggugcuuuaagaucuaccauaaaugugacaacgccugcauuggaucaaucaggaaugguacauaugaucacuacguguaccgggacgaggcucugaacaaucgauuccagauuaagggcgucgaacucaaaaguggguauaaggacuggauccuguggauauccuuugccaucagcugcuuccuucuguguguggcauugcucggauuuauuaugugggccugccagaaaggcaacauccgcuguaauauuugcaucuga

SEQ ID NO: 130006 - RNA, 1698 nt, Artificial Sequence; identical to SEQ ID NO: 124504
  derived and/or modified sequence opt3 from hemagglutinin__InfluenzaA__AEX34318

SEQ ID NO: 130007 - RNA, 1698 nt, Artificial Sequence
  derived and/or modified sequence opt3 from hemagglutinin__InfluenzaA__AEX34329
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugguuaguaaagagagcugguccuacauuguggaaaagccaaacccggagaauggaaccuguuaucccggccauuuugcugauuacgaggaacugagagagcaacucucuucggucagcucauucgaaagguuugagaucuucccuaaggagaguuccuggccaaaccacacugugacagguguaucugccagcugcucccauaauggggaaucaaguuuuuaucggaacuuacuguggcuuaccggcaaaaauggauuguaccccaaccugagcaagucuuaugcaaauaacaaagagaaggaaguucuagugcucuggggcguccaccacccuccaaacauuggggaccagaaagcccuguaccauacggagaaugcuuacguguccguggucucaagccacuauagucgcaaguucacucccgaaaucgcaaagcgaccuaaaguucgugaucaggagggaagaauaaacuacuauuggacccuucuggagccaggugacacaaucauuuuugaagccaauggcaacuugaucgcuccgagguacgccuucgcgcucucucggggguuuggauccggcauuaucaauagcaacgcacccauggauaagugugacgccaaaugccagacuccucaaggugcuauaaauucgucucugccauuccagaacgugcaucccguaaccauuggggaguguccuaaguaugugcgcuccgccaaauuaagaauggucacaggacugaggaauaucccaucaauucagagucggggccucuuuggcgcaaucgcuggguucaucgaaggagguuggaccggcaugguggaugggugguacggauaucaccaccagaacgagcaaggcagcgguuacgccgcggaccagaaguccacgcagaaugccauuaacgggauaacuaauaaaguuaacucugugaucgaaaagaugaauacacaguuuaccgcagucggcaaggaguucaacaaacuugagcgccgaauggaaaaccugaauaagaaaguggaugacggauucauugauaucuggacuuacaacgcugaguugcuaguacugcucgaaaaugagagaacacuggacuuucaugacagcaacguuaagaaucuuuaugaaaaagugaagucacaacugaagaacaaugccaaagagauaggcaacgggugcuucgaguuuuaccacaaguguaaugaugaaugcauggagagugucaaaaacggaaccuaugacuaccccaaguauuccgaagagagcaaauugaauagggagaagauugaaggugugaagcucgagucuaugggcgucuaccagauccuggcuaucuauucaacgguggccaguagcuuaguucugcuagugucccucggggcaauuucuuucuggaugugcucgaacggaagccugcagugucggaucugcauuuga

SEQ ID NO: 130008 - RNA, 1701 nt, Artificial Sequence
  derived and/or modified sequence opt3 from hemagglutinin__InfluenzaA__AEX34352
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauucugaacgacaaaccauuucagaaugucaaccgaaucacauauggugcaugucccagauacgugaagcagaauacccuuaaacuggccacugggaugaggaacgugccugagaagcaaacacggggaaucuucggcgcuauugccggcuuuaucgaaaaugggugggagggaauggucgaugguugguauggcuuccgucaccagaacagugaggggauuggacaggcagcugacuugaaaagcacccaagccgcgauagaucagaucaauggcaagcucaaccgccugauugguaaaacgaacgaaaaguuccaccagaucgagaaggaauuuuccgagguugaagggagaauccaggacuuagagaaauacguggaggauaccaagauugaccuguggucuuauaaugccgaacuccuuguagcacuggagaaccaacauacaauagauuugacugacagcgaaaugaauaaacuauucgagaagaccaaaaagcagcugagggaaaacgcugaggauaugggcaauggaugcuuuaagaucuaccacaaaugugacaacgccugcauuggcucaauccggaaugggacauaugaucaugacguguaccgagacgaggcucucaacaaucgcuuccagauuaagggagucgaacugaaaagugguuacaaggauuggauccuuuggauauccuuugccaucagcugcuuccuguuguguguggcacuccugggcuuuauuaugugggccugccagaaagggaacaucagauguaauauuugcaucuga

SEQ ID NO: 130009 - RNA, 1701 nt, Artificial Sequence; identical to SEQ ID NO: 124450
  derived and/or modified sequence opt3 from hemagglutinin__InfluenzaA__AEX34364

SEQ ID NO: 130010 - RNA, 1701 nt, Artificial Sequence; identical to SEQ ID NO: 124450
  derived and/or modified sequence opt3 from hemagglutinin__InfluenzaA__AEX34375

SEQ ID NO: 130011 - RNA, 1701 nt, Artificial Sequence
  derived and/or modified sequence opt3 from hemagglutinin__InfluenzaA__AEX34386
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucaucgagagauccaaagccuauucuaauuguuaccccuaugacgugccugauuacgcaucguugaggucacucgucgccagcaguggcacucuggaauuuaacaaugaguccuucaacuggacaggugugacccagaaugggacgucuagcgcuugcauucggcgcuccaacaauucauuuuucagucgacugaacuggcucacucauuuaaaguuuaaguauccagcacugaauguuaccaugcccaacaacgagcaguucgacaaacuuuacaucuggggagugcaccauccuggcacagauaaugaccagaucuuuuuguaugcccaagcuagcggccguauuacugucucuaccaagagaucccagcagacagugauaccaaacauugggucaaggccccggguacgcaauaucccuagcagaauuaguaucuacuggaccaucguuaaaccaggagauauucugcuaauaaacucuacggguaaucucaucgccccgaggggcuacuucaagauucgguccgggaaaagcucgaucaugcgcucugacgcgcccauaggaaaguguaacuccgaaugcauuacuccuaauggcucaaucccaaacgacaagcccuuucagaaugugaaccgaaucacauauggugcauguccuagauacgucaaacaaaauacccugaagcuggccacugggaugaggaacgugccagagaaacagacacggggaauuuucggcgcuaucgccggcuuuauugaaaaugggugggagggaaugguggaugguugguauggcuuccgucaccagaacagugaggggcgcggacaagcagcugaccuuaagagcacccaggccgcgauagaucagaucaauggcaaauugaacagacucauugguaagacgaacgaaaaauuccaccagaucgagaaggaauuuuccgaggucgaagggaggauccaagaccuggagaaguacguugaggauaccaaaauugacuuauggucuuauaaugccgaacugcucguggcacuugagaaccagcauacaauagaucugacugacagcgaaaugaauaaguuguucgagaaaaccaagaaacagcuacgggaaaacgcugaggauaugggcaauggaugcuuuaagaucuaccacaagugugacaacgccugcauuggcucaauccgaaaugggacauaugaucaugacguauaccgcgacgaggcucugaacaauagauuccagauuaaaggaguggaacucaagagugguuacaaagauuggauccuguggauauccuuugccaucagcugcuuccuucugugugucgcauugcucggcuuuauuaugugggccugccaaaaggggaacaucagguguaauauuugcaucuga

SEQ ID NO: 130012 - RNA, 1701 nt, Artificial Sequence
  derived and/or modified sequence opt3 from hemagglutinin__InfluenzaA__AEX34407
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacagucuucaaguaccggugagauuugcgacagcccacaccagauccuagauggcgaaaauuguacacucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacccuggaauuuaacaaugaguccuucaacuggacugguguuacacagaaugggaccucuagcgcuugcauccggcgcuccaacaauucauuuuucagucgacugaacuggcucacgcauuuaaaguuuaaguauccagcacugaaugugacuaugcccaacaacgagcaguucgacaaacuuuacauuuggggaguccaccauccuggcaccgauaaugaccagaucuuuuuguaugcccaagcuagcggccguauuacagugucuacuaagagaucccagcagaccguaaucccaaacauagggucaaggccccggguucgcaauauuccuagcagaaucaguauuuacuggacaaucgugaaaccaggagauauccugcuaauuaacucuaccgguaaucucauagccccgaggggcuacuucaagauccuguccgggaaaagcucgauuaugcggucugacgcgcccaucggaaaguguaacuccgaaugcauaacgccuaauggcucaauuccaaacgacaagcccuuucagaaugucaaccgcaucacuuauggugcauguccucgauacgugaaacaaaauacacuuaagcuggccaccgggaugagaaacgugccagagaaacagacuaggggaaucuucggcgcuauugccggcuuuaucgaaaaugggugggagggaauggucgaugguugguauggcuuccggcaccagaacagugaggggcguggacaagcagcugaccucaagagcacacaggccgcgauugaucagauaaauggcaaauugaaccgccugaucgguaagaccaacgaaaaauuccaccagauugagaaggaauuuuccgagguugaagggagaauccaagacuuagagaaguacguggaggauacgaaaguagaccuguggucuuauaaugccgaacuccuuguggcacuggagaaccagcauaccaucgauuugacagacagcgaaaugaauaagcuauucgagaaaacuaagaaacagcugagggaaaacgcugaggauaugggcaauggaugcuuuaagauuuaccacaagugugacaacgccugcauaggcucaauccggaaugggaccuaugaucaugacgucuaccgagacgaggcucucaacaaucgcuuccagauuaaaggaguggaacugaagagugguuacaaagauuggauccuuuggauuuccuuugccaucagcugcuuccuguuguguguugcacuccugggcuuuauaaugugggccugccaaaaggggaacaucagauguaauauuugcaucuga

SEQ ID NO: 130013 - RNA, 1698 nt, Artificial Sequence
  derived and/or modified sequence opt3 from hemagglutinin__InfluenzaA__AEX34440
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugaccaguagagagagcugguccuacauuguugaaaaaccaaauccggagaacggaacuuguuaucccggccauuuugcugacuacgaggaacugagggagcaacucucuucggugagcucauucgaacgguuugagaucuucccuaaggagaguuccuggccaaaucacacaaccacgggugucucugccagcugcucccauaacggggaaucaaguuuuuauaagaauuuacuguggcuuacuggaaagaacggcuuguaccccaaucugagcaagucuuaugcaaacaauaaagagaaggaagugcuaguacucuggggcguucaccacccuccaaacauugggaaccagcgcgcccuguaccauaccgagaaugcuuacguguccgucgugucaagccacuauagucgaaaauucacacccgaaaucgcaaagcguccuaaggugagagaucaggagggaaggauaaacuacuauuggacucuucuggagccaggugacaccaucauuuuugaagccaauggcaacuugaucgcuccgcgguacgccuucgcgcucucucgcggguuuggauccggcauuaucaauagcaacgcacccauggaugagugugacgccaaaugccagacaccucaaggugcuauaaauucgucucugccauuccagaacguccaucccguuaccauuggggaauguccuaaguaugugagauccgccaaauuaaggaugguaacgggacugcggaauaucccaucaauucagagucgcggccucuuuggcgcaaucgcuggguucaucgagggagguuggacuggcaugguggaugggugguacggauaucaccaccagaacgaacaaggcagcgguuacgccgcggaccagaaguccacacagaaugccauuaacgggauaaccaauaaagucaacucugugaucgagaagaugaauacucaguuuacagcaguuggcaaagaguucaacaaacuugaacgaagaauggagaaccugaauaagaaaguggaugacggauucauugauaucuggaccuacaacgcugaauugcuaguccugcucgagaaugaaaggacgcuggacuuucaugacagcaacgugaagaaucuuuaugagaaaguaaagucacaacugaaaaacaaugccaaggagauaggcaacgggugcuucgaauuuuaccacaaguguaaugaugagugcauggaaaguguuaaaaacggaaccuaugacuaccccaaguauuccgaggagagcaaauugaaucgggaaaagauugauggugugaaacucgagucuaugggcgucuaccagauccuggcuaucuauucaacaguggccaguagcuuaguccugcuagugucccucggggcaauuucuuucuggaugugcucgaacggaagccugcagugucguaucugcauuuga

SEQ ID NO: 130014 - RNA, 1698 nt, Artificial Sequence; identical to SEQ ID NO: 122315
  derived and/or modified sequence opt3 from hemagglutinin__InfluenzaA__AEX34462

SEQ ID NO: 130015 - RNA, 1698 nt, Artificial Sequence
  derived and/or modified sequence opt3 from hemagglutinin__InfluenzaA__AEX34473
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaaaagcggcuuguaucccaaccugucuaaguccuacgcaaauaacaaagaaaaggagguacuuguucucuggggcgugcaucacccuccaaauaucggggaucagcgcgcccuguaccacacugaaaacgcuuaugucucaguggugagcagucauuacucucgacguuucacccccgagauagcaaaaagaccuaaggucagggaccaggaaggacggaucaacuauuacuggacacuucuggagccaggugauacuauuaucuuugaggccaauggcaacuugauugcuccgcgcuaugccuucgcgcucuccagaggguuuggaagcggcaucauaaccucgaaugcacccauggacgaaugugaugccaagugccagacaccucaaggugcuauuaacucuucccugccauuccagaauguucaccccgugaccaucggggaguguccuaaauacguaaagucagccaaauuaaggauggugacgggacugcggaacauuccaaguauccagagccgcggccucuuuggcgcaaucgcuggguucauugaaggagguuggacuggcauggucgacgggugguauggauaccaucaccagaaugagcaaggcuccgguuacgccgcggaucagaagucuacacagagcgccauaaacgggaucaccaauaaagugaacucaguuauugaaaagaugaauacucaguuuacagcagugggcaaagaguucaacaagcuagagcgaagaauggaaaaucugaacaagaaagucgacgauggauucuuggacaucuggaccuauaaugcugagcuacuggugcuccuggaaaacgagaggacgcuugacuuucacgauaguaacguaaagaaucuguacgaaaaaguuaagucccaauugaaaaacaaugccaaggagauaggcaacgggugcuucgaguuuuaucauaaguguaaugacgaaugcauggagagcgugaaaaacggaaccuacgauuaucccaaguacucugaagagucaaaacucaaucgggagaagauugacggugucaaacuggaaaguaugggcguguaucagaucuuagcuaucuacagcacagucgccuccucucuggugcuacucguuucgcugggggcaauuagcuucuggaugugcuccaacggaucacuucagugucguaucugcauuuga

SEQ ID NO: 130016 - RNA, 1698 nt, Artificial Sequence
  derived and/or modified sequence opt3 from hemagglutinin__InfluenzaA__AEX34495
augaaggugaaacugcucguccuucugugcaucuucaccgccacauacgcugacacuauuuguauaggcuaucacgcaaacaauagcacggauaccguugacacaguguuggagaagaacguaacugugacccauuccgucaauuuacuggaagauucucacaacgggaaacuaugccuccugaagggaaucgcgccccuucagcuggguaauuguucaguggccggcuggauuuuggggaacccugagugcgaacuccugaucaguaaagagagcugguccuacauuguugaaacaccaaauccggagaacggaaccuguuaucccggcuacuuugcugacuaugaggaacugagagagcaacucucuucggugagcucauucgaaagguuugagaucuucccuaaggagaguuccuggccaaaucauacugucacaggugugucugccagcugcucccacaacgggaagucaaguuuuuaccggaauuuacuguggcuuaccggaaaaagcggcuuguaucccaaccugucuaaguccuacgcaaauaacaaagaaaaggagguacuuguucucuggggcgugcaucacccuccaaauauagggguccagcgcgcccuguaccacacggaaaacgcuuaugugucaguggucagcagucauuacucucgacguuucacucccgagaucgcaaaaagaccuaagguuagggaucaggaaggacggauuaacuauuacuggacccuucuggagccaggugacacaaucauuuuugaggccaauggcaacuugaucgcuccgcgcuaugccuucgcgcucuccagaggguuuggaagcggcauaauuacuucgaaugcacccauggaugaaugugacgccaagugccagaccccucaaggugcuaucaacucuucccugccauuccagaaugugcaccccguaacaauuggggaguguccuaaauacgugaagucagccaaauuaaggauggucaccggacugcggaacaucccaaguauccagagccgcggccucuuuggcgcaauugcuggguucauagaaggagguuggacgggcaugguggaugggugguauggauaccaucaccagaaugagcaaggcuccgguuacgccgcggaccagaagucuacucagaacgccaucaaugggauuacaaacaaaguuaauagcgugaucgaaaagaugaacacccaguuuacugcagucggcaaagaguucaauaagcuagagcgaagaauggaaaaccugaauaagaaaguggaugacggauucuuggauauauggacauauaacgcugagcuacugguacuccuggaaaacgagaggacccuugacuuucacgacucaaauguuaagaaccuguacgaaaaagugaagagucaauugaaaaauaacgccaaggagauuggcaaugggugcuucgaguuuuaucauaaguguaacgaugaaugcauggaguccgucaaaaauggaacguacgacuaucccaaguacagcgaagagucuaaacucaaccgggagaagaucgauggugugaaacuggaaucaaugggcgucuaucagaucuuagcuauuuacaguaccguggccagcucccugguucuacucgugucucugggggcaaucucguucuggaugugcagcaauggaucccuucagugucguauuugcauauga

SEQ ID NO: 130017 - RNA, 1698 nt, Artificial Sequence; identical to SEQ ID NO: 130016
  derived and/or modified sequence opt3 from hemagglutinin__InfluenzaA__AEX34506

SEQ ID NO: 130018 - RNA, 1698 nt, Artificial Sequence; identical to SEQ ID NO: 130016
  derived and/or modified sequence opt3 from hemagglutinin__InfluenzaA__AEX34517

SEQ ID NO: 130019 - RNA, 1698 nt, Artificial Sequence; identical to SEQ ID NO: 130016
  derived and/or modified sequence opt3 from hemagglutinin__InfluenzaA__AEX34528

SEQ ID NO: 130020 - RNA, 1698 nt, Artificial Sequence; identical to SEQ ID NO: 130016
  derived and/or modified sequence opt3 from hemagglutinin__InfluenzaA__AEX34539

SEQ ID NO: 130021 - RNA, 1698 nt, Artificial Sequence; identical to SEQ ID NO: 130016
  derived and/or modified sequence opt3 from hemagglutinin__InfluenzaA__AEX34550

SEQ ID NO: 130022 - RNA, 1698 nt, Artificial Sequence; identical to SEQ ID NO: 130016
  derived and/or modified sequence opt3 from hemagglutinin__InfluenzaA__AEX34561

SEQ ID NO: 130023 - RNA, 1698 nt, Artificial Sequence; identical to SEQ ID NO: 130016
  derived and/or modified sequence opt3 from hemagglutinin__InfluenzaA__AEX34572

SEQ ID NO: 130024 - RNA, 1698 nt, Artificial Sequence; identical to SEQ ID NO: 130016
  derived and/or modified sequence opt3 from hemagglutinin__InfluenzaA__AEX34583

SEQ ID NO: 130025 - RNA, 1698 nt, Artificial Sequence; identical to SEQ ID NO: 130016
  derived and/or modified sequence opt3 from hemagglutinin__InfluenzaA__AEX34594

SEQ ID NO: 130026 - RNA, 1698 nt, Artificial Sequence; identical to SEQ ID NO: 130016
  derived and/or modified sequence opt3 from hemagglutinin__InfluenzaA__AEX34605

SEQ ID NO: 130027 - RNA, 1698 nt, Artificial Sequence; identical to SEQ ID NO: 130016
  derived and/or modified sequence opt3 from hemagglutinin__InfluenzaA__AEX34616

SEQ ID NO: 130028 - RNA, 1698 nt, Artificial Sequence; identical to SEQ ID NO: 130016
  derived and/or modified sequence opt3 from hemagglutinin__InfluenzaA__AEX34627

SEQ ID NO: 130029 - RNA, 1698 nt, Artificial Sequence; identical to SEQ ID NO: 130016
  derived and/or modified sequence opt3 from hemagglutinin__InfluenzaA__AEX34638

SEQ ID NO: 130030 - RNA, 1698 nt, Artificial Sequence
  derived and/or modified sequence opt3 from hemagglutinin__InfluenzaA__AEX34650
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucgggaaccagcgcucccuguaccacacugaaaaugccuaugucucaguggugagcagucauuacucucgacguuucacccccgagauagcuaaaagaccuaaggucagggaucaggaaggacggaucaacuauuacuggacacuucuggagccaggugacacuauuaucuuugaggcaaauggcaacuugauugccccgcgcuucgcuuuugcccucuccagaggguucggaagcggcaucauaaccucgaaugcgcccauggaugaaugugacgcaaagugccagacaccucaaggugccauuaacucuucccugccauuucagaauguucaccccgugaccaucggggaguguccuaaauauguaaggucagcuaaguuacggauggugacgggacugcgcaacauuccaaguauccagagccgaggccucuucggcgccaucgcaggguuuauugaaggagguuggacuggcauggucgaugggugguacggauaucaucaccagaaugagcaaggcuccgguuacgcugccgaccagaaaucuacacagaacgcgauaaaugggaucaccaacaaggugaauagcguuauugaaaagaugaacacucaguucacagccgugggcaaagaguucaauaaacuugagagaaggauggaaaaccugaacaagaaggucgaugacggauuuuuggauaucuggaccuacaaugcagagcuacuggugcuccuggaaaacgagcggacgcuugacuuccacgacucaaauguuaaaaaccuguaugaaaagguaaaaagucaauugaagaauaacgcuaaagagauaggcaaugggugcuuugaguucuaccauaaguguaacgaugaaugcauggaguccgugaagaauggaaccuaugacuaccccaaauauagcgaagagucuaagcucaaccgugagaaaauugauggugucaagcuggaaucaaugggcguguaccagaucuuagccaucuauaguacagucgcuagcucccuggugcuacucguuucucugggggccauuucguuuuggaugugcagcaauggaucccuucagugucgcaucugcauuuga

SEQ ID NO: 130031 - RNA, 1698 nt, Artificial Sequence
  derived and/or modified sequence opt3 from hemagglutinin__InfluenzaA__AEX34661
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaagggauuguaucccaaccugagcaaaucuuacgcaaauaacaaggaaaaagagguucuaguacucuggggcgugcaucacccuccaaauaucggggaucagcgcgcccuguaccacacugaaaacgcuuaugucuccguggugucaagccauuacagucgacguuucacccccgagauagcaaagagaccuaaggucagggaccaggaaggacggaucaacuauuacuggacacuucuggagccaggugauacuauuaucuuugaggccaauggcaacuugauugcuccgcgcuucgccuuugcgcucucuagaggguucggauccggcaucauaaccagcaaugcacccauggacgaaugugaugccaaaugccagacaccucaaggugcuauuaacucgucucugccauuucagaauguucaccccgugaccaucggggaguguccuaaguauguaagguccgccaaauuacggauggcaacgggacugcgcaacauuccaucaauccagagucgaggccucuucggcgcuaucgccggguuuauugaaggagguuggacuggcaugguggacgggugguacggauaucaucaccagaaugagcaaggcagcgguuacgcggccgaucagaaguccacacagaacgcaauaaaugggaucaccaaaaaggucaacucugugauugaaaagaugaauacucaguucacagcuguuggcaaggaguucagcaaacuugagagaaggauggaaaaccugaauaaaaagguggacgauggauuuuuggacaucuggaccuacaacgccgagcuacugguccuccuggaaaaugagcggacgcuugacuuccacgauucaaacgugaaaaaccuguaugaaaagguaaaaagucaauugaagaauaacgcuaaggagauaggcaaugggugcuuugaguucuaccauaaauguaacgacgaaugcauggaguccguuaagaauggaaccuaugauuaccccaaauauagcgaagagucuaagcucaaccgugagaaaauugacggugugaagcuggaaucaaugggcgucuaccagaucuuagccaucuauaguacaguggcaagcucccugguccuacucgugucucugggggccauuucguuuuggaugugcagcaauggaucccuucagugucgcaucugcauuuga

SEQ ID NO: 130032 - RNA, 1698 nt, Artificial Sequence
  derived and/or modified sequence opt3 from hemagglutinin__InfluenzaA__AEX34672
augaaggugaaacugcucguccuucugugcaccuucacagccacuuacgcugacacgaucuguauuggcuaucacgcaaacaauagcaccgauacaguugacacuguguuggauaagaacguaaccgugacacauuccgucaauuuacuggaggacucucacaacgggaaacuaugccuccugaagggaauagcgccccuucagcuggguaauuguucaguggccggcuggaucuuggggaacccugaaugcgagcuccugauuaguagagaaagcugguccuacaucguugagaaaccaaauccggaaaacggaaccuguuaucccggccauuuugcugauuacgaggagcugagggaacaacucucuucggugagcucauucgagcgguuugaaauuuucccuaaggagaguuccuggccaaaucacacuacaaccggugucucugccagcugcucccaugacggggagucaaguuuuuauaagaacuuacuguggcuuacgggaaagaauggcuuguaccccaaccugagcaagucuuaugcaaauaacaaagaaaaggaggugcuaguacucuggggcguucaccacccuccaaauaucggggugcagcgcgcccuguaccauacugaaaacgcuuacgucuccguggugucaagccacuauagucgaaaauucacccccgagauagcaaagcguccuaaggucagagaucaggaaggaaggaucaacuacuauuggacacuucuggagccaggugacacuauuaucuuugaggccaauggcaacuugauugcuccgcgguacgccuucgcgcucucucgcggguuuggauccggcaucauaaauagcaacgcacccauggaugaaugugacgccaaaugccagaccccucaaggugcuauuaauucgucucugccauuccagaacguucaucccgugacaaucggggaguguccuaaguauguaagauccgccaaauuaaggauggugaccggacugcggaauauuccaucaauccagagucgcggccucuuuggcgcaaucgcuggguucauugaaggagguuggacgggcauggucgaugggugguacggauaucaccaccagaacgagcaaggcagcgguuacgccgcggaccagaaguccacucagaaugccauaaacgggaucacaaauaaagugaacucuguuauugaaaagaugaauacccaguuuacugcagugggcaaagaguucaacaaacuugagcgaagaauggaaaaucugaacaagaaagucgaugacggauucaucgacauauggacauacaacgcugaguugcuagugcugcucgaaaaugagaggacccuggauuuucaugacagcaacguaaagaaucuuuaugaaaaaguuaagucacaacugaaaaacaaugccaaggagauuggcaacgggugcuucgaguuuuaccacaaguguaaugaugaaugcauggagagugugaaaaacggaacguaugacuaccccaaguauuccgaagagagcaaauugaaucgggagaagaucgauggugucaaacucgaaucuaugggcguguaccagauccuggcuauuuauucaaccgucgccaguagcuuagugcugcuaguuucccucggggcaaucucuuucuggaugugcucgaacggaagccugcagugucguauuugcauauga

SEQ ID NO: 130033 - RNA, 1698 nt, Artificial Sequence
  derived and/or modified sequence opt3 from hemagglutinin__InfluenzaA__AEX34683
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcagcuucgaacgguuugagauuuucccuaaggagaguuccuggccauaucacacuacaaccggugucucugccagcugcucccauaauggggaaucaaguuuuuacaagaacuuacuguggcuuacgggaaagaauggcuuguaucccaaccugagcaagucuuacgcaaauaacaaagagaaggaagugcuaguacucuggggcguucaccacccuccaaauaucggggaucagcgcgcccuguaccauacugagaacgcuuauguguccgucgugucaagccacuacagucgaaaauucacccccgaaauagcaaagcguccuaaggugagagaccaggagggaaggaucaacuauuacuggacacuucuggagccaggugauacuauuaucuuugaagccaauggcaacuugauugcuccgcgguaugccuucgcgcucucucgcggguuuggauccggcaucauaaauagcaacgcacccauggacgagugugaugccaaaugccagaccccucaaggugcuauuaauucgucucugccauuccagaacguccaucccguuacaaucggggaauguccuaaguacgugagauccgccaaauuaaggaugguaaccggacugcggaauauuccaucaauccagagucgcggccucuuuggcgcaaucgcuggguucauugagggagguuggacgggcaugguggacgggugguauggauaccaccaccagaacgaacaaggcuuugguuacgccgcggaucagaagucaacucagaaugccauaaacgggaucacaaauaaagucaacuccgugauugagaagaugaauacccaguucacugcaguuggcaaagaguucaacaaacuugaacgaagaauggagaaucugaacaagaaaguggacgauggauuuaucgacauauggacauauaacgcugaauugcuaguccugcucgagaaugaaaggacccuggacuuccaugauucuaacgugaagaaucuuuacgagaaaguaaagagccaacugaaaaacaaugccaaggagauuggcaacgggugcuuugaguucuaucacaaguguaaugacgaaugcauggaaucaguuaaaaacggaacguacgauuaucccaaguacagugaggaguccaaauugaaucgggaaaagaucgacggugugaaacucgagagcaugggcgucuaucagauccuggcuauuuacucuaccguggccucaaguuuaguccugcuagugagccucggggcaaucuccuuuuggaugugcucuaacggaucgcugcagugucguauuugcauauga

SEQ ID NO: 130034 - RNA, 1698 nt, Artificial Sequence
  derived and/or modified sequence opt3 from hemagglutinin__InfluenzaA__AEX34757
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacgggggaucaaguuuuuauaagaauuuacuguggcuuacgcgcaaaaacggcuuguaccccaaucugagcaagucuuaugcaaacaauaaagaaaaggaggugcuaguacucuggggcguucaccacccuccaaacaucggggaucagcgagcccuguaccauacugaaaacgcuuacguguccgucgugucaagccacuauagucguaaauucacccccgagauagcaaagagaccuaaggugagggaccaggaaggacggaucaauuacuauuggacacuucuggagccaggugauacuauuaucuuugaggccaacggcaauuugauugcuccgcgcuacgccuucgcgcucucuagaggguuuggauccggcaucauaaacagcaaugcacccauggacgaaugugaugccaaaugccagaccccucaaggugcuauuaacucgucucugccauuccagaauguccaucccguuacaaucggggaguguccuaaguaugugagguccgccaaauuacggaugguaaccggacugcgcaacauuccaucaauccagagucgaggccucuuuggcgcaaucgcuggguucauugaaggagguuggacgggcaugguggacgggugguacggauaucaccaccagaaugagcaaggcagcgguuacgccgcggaucagaaguccacucagaacgccauaaaugggaucacaaacaaagucaauucugugauugaaaagaugaacacccaguuuacugcaguuggcaaagaguucaauaaacuugagagaaggauggaaaaccugaacaagaagguggacgauggauucaucgacauauggacauacaaugcugaguugcuaguccugcucgaaaacgagcggacccuggacuuucaugauagcaaugugaagaaccuuuaugaaaaaguaaagucacaacugaaaaauaacgccaaggagauuggcaaugggugcuucgaguuuuaccacaaguguaacgacgaaugcauggagaguguuaaaaauggaacguaugauuaccccaaguauuccgaagagagcaaauugaaccgugagaagaucgacggugugaaacucgaaucuaugggcgucuaccagauccuggcuauuuauucaaccguggccaguagcuuaguccugcuagugucccucggggcaaucucuuucuggaugugcucgaauggaagccugcagugucgcauuugcauauga

SEQ ID NO: 130035 - RNA, 1698 nt, Artificial Sequence
  derived and/or modified sequence opt3 from hemagglutinin__InfluenzaA__AEX34768
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggauaguuccuggccaaaucacacuacaaccggugucucugccagcugcucccauaacggggagucaaguuuuuauaagaauuuacuguggcuuacgggaaagaacggcuuguaccccaaucugagcaagucuuaugcaaacaauaaagaaaaggaggugcuaguacucuggggcguucaccacccuccaaacaucggggaccagcgcgcccuguaccauacugaaaacgcuuacguguccgucgugucaagccacuauagucgaaaauucacccccgagauagcaaagcguccuaaggugagagaucagggagguaggaucaauuacuauuggacacuucuggaaccaggcgacacuauuaucuuugaggccaacgggaauuugauugcuccgcgguacgccuucgcgcucucucgcggauuuggcuccgguaucauaaacagcaaugcacccauggaugagugugacgccaaaugccagaccccucaaggggcuauuaacucgucucugccauuccagaauguccaucccguuacaaucggagaauguccuaaguaugugagauccgccaaauuaaggaugguaaccggccugcggaacauuccaucaauccagagucgcggccucuuuggggcaaucgcuggauucauugaggguggcuggacggggaugguggauggaugguacggcuaucaccaccagaaugaacaagguagcggguacgccgcggaccagaaguccacucagaacgccauaaauggcaucacaaacaaagucaauucugugauugagaagaugaacacccaguuuacugcaguuggaaaagaguucaauaaacuugaacgaagaauggagaaccugaacaagaaaguggaugacggcuucaucgacauauggacauacaaugcugaauugcuaguccugcucgagaacgaaaggacccuggauuuucaugacagcaaugugaagaaccuuuaugagaaaguaaagucacaacugaaaaauaacgccaaggaaauugggaauggaugcuucgaguuuuaccacaaguguaacgaugagugcauggaaaguguuaaaaaugguacguaugacuaccccaaguauuccgaggaaagcaaauugaaccgggagaagaucgauggcgugaaacucgagucuaugggggucuaccagauccuggcuauuuauucaaccguggccaguagcuuaguccugcuagugucccucggagcaaucucuuucuggaugugcucgaauggcagccugcagugucguauuugcauauga

SEQ ID NO: 130036 - RNA, 1698 nt, Artificial Sequence
  derived and/or modified sequence opt3 from hemagglutinin__InfluenzaA__AEX34779
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaacggucauuuuaucgcaacuuacuguggcuuaccggaaagaauggcuuguaccccaaccugaguaagagcuaugcaaauaacaaagagaaggaagugcuaguucucuggggcgugcaccacccuccaaacaucgggaaucagaaagcccuguaccauacggagaacgcuuacgucucugugguguccucacacuauagccgaaaguucacucccgaaauagcaaagcguccuaaagucagagaccaggagggaaggaucaauuacuauuggacccuucuggagccaggugauacaauuaucuuugaagccaacggcaauuugauugcuccgcgguacgccuucgcgcucagucgcggguuuggaucuggcaucauaaacuccaaugcacccauggacaagugugaugccaaaugccagacuccucaaggugcuauuaacagcucgcugccauuccagaauguucaucccgugaccaucggggaguguccuaaguauguaagaucugccaaauuaaggauggugacaggacugcggaacauuccauccauccagucacgcggccucuuuggcgcaaucgcuggguucauugaaggagguuggaccggcauggucgacgggugguacggauaucaccaccagaaugagcaaggcagugguuacgccgcggaucagaaaagcacgcagaacgccauaaaugggaucacuaacaaaguaaauuccguuauugaaaagaugaacacacaguuuaccgcagugggcaaggaguucaacaaacuugagcgaagaauggaaaaucugaacaagaaagucgacgauggauucaucgacauauggacuuacaaugcugaguugcuagugcugcucgaaaacgagaggacacuggauuuucaugacucuaauguaaagaaccuuuaugaaaaaguuaagagccaacugaagaauaacgccaaagagauuggcaaugggugcuucgaguuuuaccacaaguguaacgacgaaugcauggagucagugaaaaauggaaccuaugauuaccccaaguauagugaagaguccaaauugaaccgggagaagaucgacggugucaagcucgaaagcaugggcguguaccagauccuggcuauuuauucuacggucgccucaaguuuagugcugcuaguuagccucggggcaaucuccuucuggaugugcucuaauggaucgcugcagugucguauuugcauauga

SEQ ID NO: 130037 - RNA, 1698 nt, Artificial Sequence; identical to SEQ ID NO: 126113
  derived and/or modified sequence opt3 from hemagglutinin__InfluenzaA__AEX34790

SEQ ID NO: 130038 - RNA, 1698 nt, Artificial Sequence
  derived and/or modified sequence opt3 from hemagglutinin__InfluenzaA__AEX34801
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggagcuuguuaucccggccauuuugccgacuacgaggaacugagagagcaacucuccucugugucgucauucaagagguuugaaauuuucccuaaagagagcaguuggccaaaccacaccgucacugguguguccgcaucuugcagccauaauggggaguccucauuuuauaagaacuuacuguggcuuacaggaaagaauggcuuguaccccaaccugaguaagagcuaugccaauaacaaagaaaaggagguucuaguacucuggggcgugcaccacccuccaaacaucggggaucagaugacccuguaccauaaggaaaaugcuuacgucucugugguguccucacacuauagccggaaauucacgcccgagauagcaaagcgcccuaaaguccgagaccaggaaggacguaucaacuacuauuggacucuucuggagccaggugauaccauuaucuuugaggccaguggcaauuugauugcuccgagauacgccuucgcgcucucuaggggguuuggauccggcaucauaaacagcgacgcacccauggaugaaugugacgccaagugccagacaccucaaggugcuauuaauucgucucugccauuccagaacguucaucccgugacuaucggggaguguccuaaauauguacgguccgccaaguuacgcauggugaccggacugagaaauauuccaucaauccagaguaggggccucuuuggcgcaaucgcuggguucauugaaggagguuggacaggcauggucgaugggugguacggauaucaccaccagaacgagcaaggcagcgguuacgccgcggaccagaaauccacccagaaugccauaaacgggaucacgaauaaggugaacucuguuauugaaaagaugaauacucaguuuacagcagugggcaaagaguucaacaaacuugagcggcgcauggaaaaucugaacaaaaaggucgaugacggauucaucgacguguggaccuacaacgcugaguugcuaguacugcucgaaaaugagcgaacucuggauuuucaugacagcaacguuaaaaaucuuuaugaaaaggugaagaaccaacugaaaaauaacgccaaggagauaggcaaugggugcuucgaguuuuaccacaaauguaacgaugaaugcauggagucagucaagaauggaacauaugacuaccccaaauauagugaagaguccaaguugagcagagagaagauugauggugugaaacucgaaucuaugggcgucuaccagauccuggcuaucuauucaaccguggccaguagcuuaguucugcuagugucccucggggcaauuucuuucuggaugugcucgaacggaagccugcaguguaggaucugcauuuga

SEQ ID NO: 130039 - RNA, 1698 nt, Artificial Sequence
  derived and/or modified sequence opt3 from hemagglutinin__InfluenzaA__AEX34812
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguucaucccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaccaccagaacgagcaaggcagcgguuacgccgcggaccagaaguccacgcagaaugccauagaugggaucacuaacaaaguaaauucuguuauugaaaagaugaacacacaguuuaccgcagugggcaaggaguucaauaaacuugagcgccgaauggaaaaccugaacaagaaagucgacgauggauucaucgacauauggacuuacaaugcugaguugcuagugcugcucgaaaacgagagaacacuggacuuucaugauagcaauguaaagaaccuuuaugaaaaaguuaagucacaacugaagaauaacgccaaagagauuggcaaugggugcuucgaguuuuaccacaaguguaacgacgaaugcauggagagugugaaaaauggaaccuaugauuaccccaaguauuccgaagagagcaaauugaacagggagaagaucgacggugucaagcucgaaucuaugggcguguaccagauccuggcuauuuauucaacggucgccaguagcuuagugcugcuaguuucccucggggcaaucucuuucuggaugugcucgaauggaagccugcagugucggauuugcauauga

SEQ ID NO: 130040 - RNA, 1698 nt, Artificial Sequence
  derived and/or modified sequence opt3 from hemagglutinin__InfluenzaA__AEX34834
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugaacucaaaagagaguuggagcuacauuguugaaaagccaaauccggagaacggaaccuguuaucccggccauuuugcugacuacgaggaacugagagagcaacucuccucugugucgucauucaagagguuugaaaucuucccuaaagagagcaguuggccaaaucacacugucacagguguguccgccucuugcagccauaacggggaguccucauuuuauaagaauuuacuguggcuuaccggaaagaacggcuuguaccccaaucugaguaagagcuaugcaaacaacaaagaaaaggagguucuaguacucuggggcgugcaccacccuccaaauauuggggaucagaugacgcuguaccauaaggaaaacgccuacgucucugugguguccucacacuauagccggaaauucacucccgagaucaccaagcgcccuaaaguccgagaccaggaaggacguauaaauuacuauuggacacuucuggagccaggugauacuaucauuuuugaggcuaguggcaacuugaucgcaccgagauacgccuucgcucucucuaggggguuuggauccggcauuaucaauagcaacgcccccauggacgaaugugaugcgaagugccagaccccucaaggugcaauaaauucgucucugccauuccagaacguucaucccgugacaauuggggaguguccuaaauauguacgguccgccaaguuacgcauggugaccggacugagaaauaucccaucaauucagaguaggggccucuuuggcgcuaucgccggguucaucgaaggagguuggacgggcauggucgacgggugguacggauaucaccaccagaacgagcaaggcagcgguuacgcagcugaucagaaauccacucagaaugccauuaacgggauaacaaauaaggugaacucuguuaucgaaaagaugaauacccaguuuacugcggugggcaaagaguucaacaaacuugagcggcgcauggaaaaccugaauaaaaaggucgacgauggauucauugacguguggacauacaacgccgaguugcuaguacugcucgaaaaugagcgaacccuggacuuucaugauagcaacguuaaaaaucuuuaugaaaaggugaagaaccaacugaaaaauaacgcaaaggagaucggcaaugggugcuucgaguuuuaccacaaauguaacgacgaaugcauggagucagucaagaauggaacguaugauuaccccaaauauagugaagaguccaaguugagcagagagaagauagacggugugaaacucgaaucuaugggcgucuaccagauucuggcuaucuauucaaccguggccaguagcuuaguucugcuagugucccucggggcuaucucuuucuggaugugcucgaacggaagccugcaguguaggauuugcaucuga

SEQ ID NO: 130041 - RNA, 1698 nt, Artificial Sequence
  derived and/or modified sequence opt3 from hemagglutinin__InfluenzaA__AEX34845
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugguuccaaaagagaguuggagcuacauuguggaaaagccgaaccccgagaauggaaccuguuauccuggccauuuugcugauuacgaggaacugagagagcaacucuccucugucucgucauucgaaagguuugagaucuucccaaaggagagcaguuggcccaaccacacugugacagguguauccgccucuugcagccauaauggggaauccucauuuuaucggaacuuacuguggcuuaccggaaagaauggcuuguacccuaaccugaguaagagcuaugcaaauaacaaagagaaggaaguucuagugcucuggggcguccaccacccacccaacauuggggaccagaaagcccuguaccauacggagaaugcuuacgugucuguggucuccucacacuauagccgcaaguucacuccugaaaucgcaaagcgaccaaaaguucgugaucaggagggaagaauaaacuacuauuggacccuucuggagccgggugacacaaucauuuuugaagccaauggcaacuugaucgcucccagguacgccuucgcgcucagucggggguuuggaucuggcauuaucaauuccaacgcaccuauggauaagugugacgccaaaugccagacuccacaaggugcuauaaauagcucgcugcccuuccagaacgugcauccuguaaccauuggggaguguccaaaguaugugcgcucugccaaauuaagaauggucacaggacugaggaauauccccuccauucagucacggggccucuuuggcgcaaucgcuggguucaucgaaggagguuggaccggcaugguggaugggugguacggauaucaccaccagaacgagcaaggcagugguuacgccgcggaccagaaaagcacgcagaaugccauuaacgggauaacuaauaaaguuaacuccgugaucgaaaagaugaauacacaguuuaccgcagucggcaaggaguucaacaaacuugagcgccgaauggaaaaccugaauaagaaaguggaugacggauucauugauaucuggacuuacaacgcugaguugcuaguacugcucgaaaaugagagaacacuggacuuucaugacucuaacguuaagaaucuuuaugaaaaagucaagagccaacugaagaacaaugccaaagagauaggcaacgggugcuucgaguuuuaccacaaguguaaugaugaaugcauggagucagugaaaaacggaaccuaugacuacccgaaguauagugaagaguccaaauugaauagggagaagauugaaggugugaagcucgagagcaugggcgucuaccagauccuggcuaucuauucuacgguggccucaaguuuaguucugcuagugagccucggggcaauuuccuucuggaugugcucuaacggaucgcugcagugucggaucugcauuuga

SEQ ID NO: 130042 - RNA, 1698 nt, Artificial Sequence; identical to SEQ ID NO: 126113
  derived and/or modified sequence opt3 from hemagglutinin__InfluenzaA__AEX34856

SEQ ID NO: 130043 - RNA, 1698 nt, Artificial Sequence
  derived and/or modified sequence opt3 from hemagglutinin__InfluenzaA__AEX34867
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugguuaguaaagagagcugguccuacauuguggaaaagccaaacccggagaauggaaccuguuaucccggccauuuugcugauuacgaggaacugagagagcaacucaucucugucucgucauucgaaagguuugagauuuucccuaaggagagcaguuggccaaaccacacugugacagguguauccgccucuugcagccauaauggggaauccucauuuuaucggaacuuacuguggcuuaccggaaagaauggcuuguaccccaaccugaguaagagcuaugcaaauaacaaagagaaggaaguucuagugcucuggggcguccaccacccuccaaacaucggggaccagaaagcccuguaccauacggagaaugcuuacgugucuguggucuccucacacuauagccgcaaguucacucccgaaauagcaaagcgaccuaaaguucgugaucaggagggaagaaucaacuacuauuggacccuucuggagccaggugacacaauuaucuuugaagccaauggcaacuugauugcuccgagguacgccuucgcgcucagucggggguuuggaucuggcaucauaaauuccaacgcacccauggauaagugugacgccaaaugccagacuccucgcggugcuauuaauagcucgcugccauuccaaaacgugcaucccguaaccaucggggaguguccuaaguaugugagaucugccaaauuaaggauggucacaggacugcggaauauuccauccauccagucacgcggccucuuuggcgcaaucgcuggguucauugaaggagguuggaccggcaugguggaugggugguacggauaucaccaccagaacgagcagggcagugguuacgccgcggaccaaaagagcacgcagaaugccauaaacgggaucacuaauaaaguuaacuccgugauugaaaagaugaauacacaguuuaccgcagucggcaaggaguucaacaaacuugagcgaagaauggaaaaccugaauaagaaaguggaugacggauucaucgauauauggacuuacaacgcugaguugcuaguacugcucgaaaaugagaggacacuggacuuucaugacucuaacguuaagaaucuuuaugaaaaagugaaaagccagcugaagaacaaugccaaagagauuggcaacgggugcuucgaguuuuaccacaaguguaaugaugaaugcauggagucagucaaaaacggaaccuaugacuaccccaaguauagugaagaguccaaauugaaucgggagaagaucgaaggugugaagcucgagagcaugggcgucuaccaaauccuggcuauuuauucuacgguggccucaaguuuaguucugcuagugagccucggggcaaucuccuucuggaugugcucuaacggaucgcugcagugucguauuugcauauga

SEQ ID NO: 130044 - RNA, 1698 nt, Artificial Sequence; identical to SEQ ID NO: 126113
  derived and/or modified sequence opt3 from hemagglutinin__InfluenzaA__AEX34878

SEQ ID NO: 130045 - RNA, 1698 nt, Artificial Sequence
  derived and/or modified sequence opt3 from hemagglutinin__InfluenzaA__AEX34889
augaaggugaaccugcucguccuucugugcaccuucacagccacuuacgcugacacgaucuguauuggcuaucacgcaaauaacagcaccgauacaguugacacuguguuggagaaaaauguaaccgugacacauuccgucaacuuacuggaaaauucucacaacgggaagcuaugccuccugaaaggaauagcgccccuucagcuggguaauuguucaguggccggcuggaucuuggggaacccugagugcgaacuccugauuaguaaggagagcugguccuacaucguugaaaaaccaaauccggagaacggaaccuguuaucccggccauuuugcugauuacgaggaacugagagagcaacucucuucggugagcucauucgaaagguuugagauuuucccuaaggagaguuccuggccaaaucacacugucacaggugugucugccagcugcucccauaacggggaaucaaguuuuuaucggaauuuacuguggcuuaccggaaagaacggcuuguaccccaaucugagcaaaucuuaugcaaacaacaaggagaaagaagugcuaguucucuggggcgugcaccacccuccaaauaucggggaccagaaggcccuguaccauacggagaacgcuuacgucuccguggugucaagccacuauagucgcaaauucacucccgaaauagcaaagcgaccuaagguccgugaucaggagggaagaaucaauuacuauuggacccuucuggagccaggugacacaauuaucuuugaagccaacggcaauuugauugcuccgagguacgccuucgcgcucucucggggguuuggauccggcaucauaaacagcaaugcacccauggauaaaugugacgccaagugccagacuccucaaggugcuauuaacucgucucugccauuccagaauguucaucccgugaccaucggggaguguccuaaauauguacgcuccgccaaguuaagaauggugacaggacugaggaacauuccaucaauccagagucggggccucuuuggcgcaaucgcuggguucauugaaggagguuggaccggcauggucgaugggugguacggauaucaccaccagaaugagcaaggcagcgguuacgccgcggaccagaaauccacgcagaacgccauaaaugggaucacuaacaagguaaauucuguuauugaaaagaugaacacacaguuuaccgcagugggcaaggaguucaacaaacuugagcgccgaauggaaaaucugaacaaaaaggucgaugacggauucaucgauauauggacuuacaaugcugaguugcuagugcugcucgaaaacgagagaacacuggacuuucaugacagcaauguuaaaaaccuuuaugaaaagguaaaaucacaacugaagaauaacgccaaggagauuggcaaugggugcuucgaguuuuaccacaaauguaacgaugaaugcauggagagugugaagaauggaaccuaugacuaccccaaauauuccgaagagagcaaguugaacagggagaaaaucgauggugucaagcucgaaucuaugggcguguaccagauccuggcuauuuauucaacggucgccaguagcuuagugcugcuaguuucccucggggcaaucucuuucuggaugugcucgaauggaagccugcagugucggauuugcauauga

SEQ ID NO: 130046 - RNA, 1698 nt, Artificial Sequence
  derived and/or modified sequence opt3 from hemagglutinin__InfluenzaA__AEX34900
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucgaaagguuugagauuuucccuaaggagagcaguuggccaaaccacacugucacagguguguccgccucuugcagccauaauggggaauccucauuuuauaaaaacuuacuguggcuuaccggaaagaauggcuuguaccccaaccugaguaaaagcuaugcaaauaacaaggagaaagaaguucuaguacucuggggcgugcaccacccuccaaacaucggggaucagaugacgcuguaccauaaggagaaugccuacgucucugugguguccucacacuauagccggaaguucacucccgaaauagcuaaacgcccuaagguccgagaccaggagggacguaucaacuacuauuggacccuucuggagccaggugauacaauuaucuuugaagcaaguggcaauuugauugccccgagauacgcuuucgcccucucuaggggguuuggauccggcaucauaaacagcaaugcgcccauggacgagugugaugcaaaaugccagacuccucaaggugccauuaacucgucucugccauuccagaauguucaucccgugaccaucggggaauguccuaaguauguacgguccgcuaaauuacgcauggugacaggacugagaaacauuccaucaauccagaguaggggccucuuuggcgccaucgcaggguucauugagggagguuggaccggcauggucgacgggugguacggauaucaccaccagaaugaacaaggcagcgguuacgcugccgaucagaaguccacgcagaacgcgauaaauggggugacuaacaaaguuaauucugugaucgagaagaugaacacacaguuuaccgccgucggcaaggaguucaauaaacuugaacggcgcauggagaaccugaacaagaaaguggacgauggauucauugacguauggacuuacaaugcagaauugcuaguucugcucgagaacgaacgaacacuggacuuucaugauagcaaugugaagaaccuuuaugagaaagucaagaaucaacugaagaacaaugcuaaagagaucggcaacgggugcuucgaauuuuaccacaaguguaaugacgagugcauggaaucagugaaaaacggaaccuaugauuaccccaaguauagugaggaguccaaauugagcagagaaaagauagacggugucgagcucgaaucuaugggcguguaccagauucuggccaucuauucaacgguugcuaguagcuuagugcugcuaguaucccucggggccaucucuuucuggaugugcucgaauggaagccugcaguguaggauuugcaucuga

SEQ ID NO: 130047 - RNA, 1698 nt, Artificial Sequence
  derived and/or modified sequence opt3 from hemagglutinin__InfluenzaA__AEX34911
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuagucaagagagcugguccuacaucguugaaaaaccaaacccggagaauggaaccuguuaucccggccauuuugcugauuacgaggaacugagagagcagcucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaaaucuuaugcaaauaacaaggagaaagaaguucuaguacucuggggcgugcaccacccuccaaacaucggggaccagaaggcccuguaccauacggagaaugcuuacgucuccguggugucaagccacuauagucgcaaauucacucccgaaauagcaaagcgaccuaagguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaaaugugacgccaagugccaaacuccucagggugcuauuaauucgucucugccauuccagaacguucaucccgugaccaucggggaguguccuaaauauguacgcuccgccaaguuaagaauggugacaggacugaggaauauuccaucaauccagagucggggccucuuuggcgcaaucgcuggguucauugaaggagguuggaccggcauggucgaugggugguacggauaucaccaccaaaacgagcagggcagcgguuacgccgcggaccagaaauccacgcagaaugccauaaacgggaucacuaauaaggugaacucuguuauugaaaagaugaauacacaauuuaccgcagugggcaaggaguucaacaaacuugagcgccgaauggaaaaccugaauaaaaaggucgaugacggauucaucgauauauggacuuacaacgcugaguugcuagugcugcucgaaaaugagagaacacuggacuuucaugacagcaacguuaaaaaucuuuaugaaaagguaaaaucacagcugaagaacaaugccaaggagauuggcaacgggugcuucgaguuuuaccacaaauguaaugaugaaugcauggagagugugaagaacggaaccuaugacuaccccaaauauuccgaagagagcaaguugaauagggagaaaaucgauggugucaagcucggcucuauggggguguaccagauccuggcuauuuauucaacggucgccaguagcuuagugcugcuaguuucccucggagcaaucucuuucuggaugugcucgaacggcagccugcaaugucggauuugcauauga

SEQ ID NO: 130048 - RNA, 1698 nt, Artificial Sequence
  derived and/or modified sequence opt3 from hemagglutinin__InfluenzaA__AEX34922
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgccgauucacucccgaaauagcaaagcguccuaaggucagagaucaggagggaaggaucaacuacuauuggacccuucuggagccaggugacacaauuaucuuugaagccaauggcaacuugauugcuccgcgguacgccuucgcgcucucucgcggguuuggauccggcaucauaaauagcaacgcacccauggauaaaugugacgccaagugccagacuccucaaggugcuauuaauucgucucugccauuccagaacguucaucccgugaccaucggggaguguccuaaauauguaagauccgccaaguuaaggauggugacaggacugcggaauauuccaucaauccagagucgcggccucuuuggcgcaaucgcuggguucauugaaggagguuggaccggcauggucgaugggugguacggauaucaccaccagaacgagcaaggcagcgguuacgccgcggaccagaaauccacgcagaaugccauaaacgggaucacuaauaaggugaacucuguuauugaaaagaugaauacacaguuuaccgcagugggcaaggaguucaacaaacuugagcgaagaauggaaaaccuggauaaaaaggucgacgauggauucaucgacauauggacuuacaaugcugaguugcuagugcugcucgaaaacgagaggacacuggacuuucaugauagcaauguuaaaaaccuuuaugaaaagguaaaaucacaacugaagaauaacgccaaggagauuggcaaugggugcuucgaguuuuaccacaaauguaacgacgaaugcauggagagugugaagaauggaaccuaugauuaccccaaauauuccgaagagagcaaguugaaccgggagaaaaucgacggugucaagcucgaaucuaugggcguguaccagauccuggcuauuuauucaacggucgccaguagcuuagugcugcuaguuucccucggggcaaucucuuucuggaugugcucgaauggaagccugcagugucguauuugcauauga

SEQ ID NO: 130049 - RNA, 1698 nt, Artificial Sequence; identical to SEQ ID NO: 124504
  derived and/or modified sequence opt3 from hemagglutinin__InfluenzaA__AEX34933

SEQ ID NO: 130050 - RNA, 1698 nt, Artificial Sequence; identical to SEQ ID NO: 124504
  derived and/or modified sequence opt3 from hemagglutinin__InfluenzaA__AEX34944

SEQ ID NO: 130051 - RNA, 1698 nt, Artificial Sequence
  derived and/or modified sequence opt3 from hemagglutinin__InfluenzaA__AEX34955
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaaaacucucacaaugggaaacuaugccuccugaagggaauagcgccccuucagcuggguaacuguucagucgcuggcuggaucuuggggaauccugagugcgaacuccugauuaguaaagagagcugguccuacaucguggaaaagccaaacccggagaauggaaccuguuaucccggccauuuugccgauuacgaggaacugagagagcaacucucuucgguuagcucauucgaaagguuugagauuuucccuaaggagaguuccuggccaaaccacacugugacaggugucucugcaagcugcucccauaauggggaaucaaguuuuuaucggaacuuacuguggcuuaccggcaaaaauggauuguaccccaaccugagcaagucuuaugccaauaacaaagagaaggaagugcuaguacucuggggcguucaccacccuccaaacaucggggaccagaaagcucuguaccauacggagaaugcauacguguccgucgugucaagccacuauagucgcaaguucacucccgaaauagccaagcgaccuaaagugcgugaucaggagggaagaaucaacuacuauuggacccuucuggagccaggugacacaauuaucuuugaagcuaauggcaacuugauugccccgagguacgcguucgcacucucucggggguuuggauccggcaucauaaauagcaacgcccccauggauaagugugacgcuaaaugccagacuccucaaggugccauuaauucgucucugccauuccagaacguccaucccguuaccaucggggaguguccuaaguaugugcgcuccgcaaaauuaagaaugguaacaggacugaggaauauuccaucaauccagagucggggccucuuuggcgcuaucgccggguucauugaaggagguuggaccggcaugguggaugggugguacggauaucaccaccagaacgagcaaggcagcgguuacgcggccgaccagaaguccacgcagaaugcaauaaacgggaucacuaauaaagucaacucugugauugaaaagaugaauacacaguuuaccgcuguuggcaaggaguucaacaaacuugagcgccgaauggaaaaccugaauaagaaaguggaugacggauucaucgauauauggacuuacaacgccgaguugcuaguccugcucgaaaaugagagaacacuggacuuucaugacagcaacgugaagaaucuuuaugaaaaaguaaagucacaacugaagaacaaugcuaaagagauuggcaacgggugcuucgaguuuuaccacaaguguaaugaugaaugcauggagaguguuaaaaacggaaccuaugacuaccccaaguauuccgaagagagcaaauugaauagggagaagaucgauggugugaagcucgaaucuaugggcgucuaccagauccuggccauuuauucaacgguggcaaguagcuuaguccugcuagugucccucggggccaucucuuucuggaugugcucgaacggaagccugcagugucggauuugcauauga

SEQ ID NO: 130052 - RNA, 1698 nt, Artificial Sequence
  derived and/or modified sequence opt3 from hemagglutinin__InfluenzaA__AEX34966
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuauguuugaagccaauggcaacuugaucgcuccgagguacgccuucgcgcucucucggggguuuggauccggcauuaucaauagcaacgcacccauggauaagugugacgccaaaugccagacuccucaaggugcuauaaauucgucucugccauuccagaacguucaucccgugaccauuggggaguguccuaaguauguacgcuccgccaaauuaagaauggugacaggacugaggaauaucccaucaauucagagucggggccucuuuggcgcaaucgcuggguucaucgaaggagguuggaccggcauggucgaugggugguacggauaucaccaccagaacgagcaaggcagcgguuacgccgcggaccagaaguccacgcagaaugccauuaacgggauaacuaauaaagugaacucuguuaucgaaaagaugaauacacaguuuaccgcagugggcaaggaguucaacaaacuugagcgccgaauggaaaaccugaauaagaaagucgaugacggauucauugauaucuggacuuacaacgcugaguugcuagugcugcucgaaaaugagagaacacuggacuuucaugacagcaacguaaagaaucuuuaugaaaaaguuaagucacaacugaagaacaaugccaaagagauaggcaacgggugcuucgaguuuuaccacaaguguaaugaugaaugcauggagagugugaaaaacggaaccuaugacuaccccaaguauuccgaagagagcaaauugaauagggagaagauugauggugucaagcucgaaucuaugggcguguaccagauccuggcuaucuauucaacggucgccaguagcuuagugcugcuaguuucccucggggcaauuucuuucuggaugugcucgaacggaagccugcagugucggaucugcauuuga

SEQ ID NO: 130053 - RNA, 1698 nt, Artificial Sequence; identical to SEQ ID NO: 130052
  derived and/or modified sequence opt3 from hemagglutinin__InfluenzaA__AEX34977

SEQ ID NO: 130054 - RNA, 1698 nt, Artificial Sequence; identical to SEQ ID NO: 130052
  derived and/or modified sequence opt3 from hemagglutinin__InfluenzaA__AEX34988

SEQ ID NO: 130055 - RNA, 1698 nt, Artificial Sequence; identical to SEQ ID NO: 126113
  derived and/or modified sequence opt3 from hemagglutinin__InfluenzaA__AEX34999

SEQ ID NO: 130056 - RNA, 1698 nt, Artificial Sequence; identical to SEQ ID NO: 130052
  derived and/or modified sequence opt3 from hemagglutinin__InfluenzaA__AEX35010

SEQ ID NO: 130057 - RNA, 1698 nt, Artificial Sequence; identical to SEQ ID NO: 130052
  derived and/or modified sequence opt3 from hemagglutinin__InfluenzaA__AEX35032

SEQ ID NO: 130058 - RNA, 1698 nt, Artificial Sequence; identical to SEQ ID NO: 130052
  derived and/or modified sequence opt3 from hemagglutinin__InfluenzaA__AEX35043

SEQ ID NO: 130059 - RNA, 1698 nt, Artificial Sequence
  derived and/or modified sequence opt3 from hemagglutinin__InfluenzaA__AEX35054
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaagugcuaguucucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugaucaggagggaagaaucaacuacuauuggacccuucuggagccaggugacacaauuauguuugaagccaauggcaacuugaucgcuccgagguacgccuucgcgcucaaucggggguuuggaucuggcauuaucaacuccaaugcacccauggauaagugugacgccaaaugccagacuccucaaggugcuauaaacagcucgcugccauuccagaauguucaucccgugaccauuggggaguguccuaaguauguacgcucugccaaauuaagaauggugacaggacugaggaacaucccauccauucagucacggggccucuuuggcgcaaucgcuggguucaucgaaggagguuggaccggcauggucgaugggugguacggauaucaccaccagaaugagcaaggcagugguuacgccgcggaccagaaaagcacgcagaacgccauuaaugggauaacuaacaaaguaaauuccguuaucgaaaagaugaacacacaguuuaccgcagugggcaaggaguucaacaaacuugagcgccgaauggaaaaucugaacaagaaagucgaugacggauucauugauaucuggacuuacaaugcugaguugcuagugcugcucgaaaacgagagaacacuggacuuucaugacucuaauguaaagaaccuuuaugaaaaaguuaagagccaacugaagaauaacgccaaagagauaggcaaugggugcuucgaguuuuaccacaaguguaacgaugaaugcauggagucagugaaaaauggaaccuaugacuaccccaaguauagugaagaguccaaauugaacagggagaagauugauggugucaagcucgaaagcaugggcguguaccagauccuggcuaucuauucuacggucgccucaaguuuagugcugcuaguuagccucggggcaauuuccuucuggaugugcucuaauggaucgcugcagugucggaucugcauuuga

SEQ ID NO: 130060 - RNA, 1698 nt, Artificial Sequence; identical to SEQ ID NO: 130052
  derived and/or modified sequence opt3 from hemagglutinin__InfluenzaA__AEX35065

SEQ ID NO: 130061 - RNA, 1698 nt, Artificial Sequence; identical to SEQ ID NO: 124504
  derived and/or modified sequence opt3 from hemagglutinin__InfluenzaA__AEX35076

SEQ ID NO: 130062 - RNA, 1698 nt, Artificial Sequence
  derived and/or modified sequence opt3 from hemagglutinin__InfluenzaA__AEX35087
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucaagagguuugaaauuuucccuaaagagagcaguuggccaaaccacacugucacagguguguccgccucuugcagccauaauggggaguccucauuuuauaagaacuuacuguggcuuaccggaaagaauggcuuguaccccaaccugaguaagagcuaugcaaauaacaaagaaaaggaggugcuaguucucuggggcgugcaccacccuccaaacaucggggaucagaugacgcuguaccauaaggaaaaugccuacgucucugugguguccucacacuauagccggaaauucacucccgagauagcuaagcgcccuaaaguccgagaccaggaaggacguaucaacuacuauuggacccuucuggagccaggugauacaauuaucuuugaggcaaguggcaauuugauugccccgagauacgcuuucgcccucucuaggggguuuggauccggcaucauaaacagcaaugcgcccauggacgaaugugaugcaaagugccagacuccucaaggugccauuaacucgucucugccauuccagaauguucaucccgugaccaucggggaguguccuaaauauguacgguccgcuaaguuacgcauggugacaggacugagaaacauuccaucaauccagaguaggggccucuuuggcgccaucgcaggguucauugaaggagguuggaccggcauggucgacgggugguacggauaucaccaccagaaugagcaaggcagcgguuacgcugccgaucagaaauccacgcagaacgcgauaaaugggaucacuaacaagguaaauucuguuauugaaaagaugaacacacaguuuaccgccgugggcaaagaguucaauaaacuugagcggcgcauggaaaaccugaacaaaaaggucgacgauggauucaucgacguguggacuuacaaugcagaguugcuaguacugcucgaaaacgagcgaacacuggacuuucaugauagcaauguuaaaaaccuuuaugaaaaggugaagaaucaacugaaaaacaaugcuaaggagauaggcaacgggugcuucgaguuuuaccacaaauguaaugacgaaugcauggagucagucaagaacggaaccuaugauuaccccaaauauagugaagaguccaaguugagcagagagaagauugacggugugaaacucgaaucuaugggcgucuaccagauccuggccaucuauucaacgguggcuaguagcuuaguucugcuagugucccucggggccauuucuuucuggaugugcucgaauggaagccugcaguguaggaucugcauuuga

SEQ ID NO: 130063 - RNA, 1698 nt, Artificial Sequence
  derived and/or modified sequence opt3 from hemagglutinin__InfluenzaA__AEX35098
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccgugaugucaagccacuauagucgcaaguucacucccgaaauagcaaagcgaccuaaagugcgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccagacuccucaaggugcuauuaauucgucucugccauuccagaacguccaucccguuaccaucggggaguguccuaaguaugugcgcuccgccaaauuaagaaugguaacaggacugaggaauauuccaucaauccagagucggggccucuuuggcgcaaucgcuggguucauugaaggagguuggaccggcaugguggaugggugguacggauaucaccaccagaacgagcaaggcagcgguuacgccgcggaccagaaguccacgcagaaugccauaaacgggaucacuaauaaagucaacucugugauugaaaagaugaauacacaguuuaccgcaguuggcaaggaguucaacaaacuugagcgccgaauggaaaaccugaauaagaaaguggaugacggauucaucgauauauggacuuacaacgcugaguugcuaguccugcucgaaaaugagagaacacuggacuuucaugacagcaacgugaagaaucuuuaugaaaaaguaaagucacaacugaagaacaaugccaaagagauuggcaacgggugcuucgaguuuuaccacaaguguaaugaugaaugcauggagaguguuaaaaacggaaccuaugacuaccccaaguauuccgaagagagcaaauugaauagggagaagaucgauggugugaagcucgaaucuaugggcgucuaccagauccuggcuauuuauucaacgguggccaguagcuuaguccugcuagugucccucggggcaaucucuuucuggaugugcucgaacggaagccugcagugucggauuugcauauga

SEQ ID NO: 130064 - RNA, 1698 nt, Artificial Sequence
  derived and/or modified sequence opt3 from hemagglutinin__InfluenzaA__AEX35109
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccagccuccaaacaucggggaccagaaagcccuguaccacacggagaaugcuuacgucuccguggugucaagccauuauagucgcaaguucacucccgaaauagcaaagcgaccuaaaguccgugaucaggagggaagaaucaacuacuauuggacccuucuggagccaggugacacaauuaucuuugaagccaauggcaacuugauugcuccgagguacgccuucgcgcucucucggggguuuggauccggcaucauaaauagcaacgcacccauggauaagugugacgccaaaugccaaacuccucagggugcuauuaauucgucucugccauuccagaacguucaccccgugaccaucggggaguguccuaaguauguacgcuccgccaaauuaagaauggugacaggacugaggaauauuccaucaauccagagucggggccucuuuggcgcaaucgcuggguucauugaaggagguuggaccggcauggucgaugggugguacggauaucaucaccaaaacgagcagggcagcgguuacgccgcggaccagaaguccacgcagaaugccauaaacgggaucacuaauaaagugaacucuguuauugaaaagaugaauacacaauuuaccgcagugggcaaggaguucaacaaacuugagcgccgaauggaaaaccugaauaagaaagucgaugacggauucaucgauauauggacuuacaacgcugaguugcuagugcugcucgaaaaugagagaacacuggacuuucacgacagcaacguaaagaaucuuuaugaaaaaguuaagucacagcugaagaacaaugccaaagagauuggcaacgggugcuucgaguuuuaccauaaguguaaugaugaaugcauggagagugugaaaaacggaaccuaugacuaccccaaguauuccgaagagagcaaauugaauagggagaagaucgauggugucaagcucgaaucuaugggcguguaccagauccuggcuauuuauucaacggucgccaguagcuuagugcugcuaguuucccucggggcaaucucuuucuggaugugcucgaacggaagccugcaaugucggauuugcauauga

SEQ ID NO: 130065 - RNA, 1698 nt, Artificial Sequence
  derived and/or modified sequence opt3 from hemagglutinin__InfluenzaA__AEX35120
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucggggaccagaaagcccuguaccauacggagaaugcuuacgucuccguggugucaagccacuauagucgcaaguucacucccgaaauagcaaagcgaccuaaaguccgugauagagagggaaggaucaacuacuauuggacccuucuggagccaggugacacaauuaucuuugaagccaauggcaacuugauugcuccgcgguacgccuucgcgcucucucgcggguuuggauccggcaucauaaauagcaacgcacccauggauaagugugacgccaaaugccagacuccucagggugcuauuaauucgucucugccauuccaaaacguucaucccgugaccaucggggaguguccuaaguauguaagauccgccaaauuaaggauggugacaggacugcggaauauuccaucaauccagagucgcggccucuuuggcgcaaucgcuggguucauugaaggagguuggaccggcauggucgaugggugguacggauaucaccaccagaacgagcagggcagcgguuacgccgcggaccaaaaguccacgcagaaugccauaaacgggaucacuaauaaagugaacucuguuauugaaaagaugaauacacaguuuaccgcagugggcaaggaguucaacaaacuugagcgaagaauggaaaaccugaauaagaaagucgaugacggauucaucgauauauggacuuacaacgcugaguugcuagugcugcucgaaaaugagaggacacuggacuuucaugacagcaacguaaagaaucuuuaugaaaaaguuaagucacagcugaagaacaaugccaaagagauuggcaacgggugcuucgaguuuuaccacaaguguaaugaugaaugcauggagagugugaaaaacggaaccuaugacuaccccaaguauuccgaagagagcaaauugaaucgggagaagaucgauggugucaagcucgaaucuaugggcguguaccaaauccuggcuauuuauucaacggucgccaguagcuuagugcugcuaguuucccucggggcaaucucuuucuggaugugcucgaacggaagccugcagugucguauuugcauauga

SEQ ID NO: 130066 - RNA, 1698 nt, Artificial Sequence; identical to SEQ ID NO: 129809
  derived and/or modified sequence opt3 from hemagglutinin__InfluenzaA__AEX35131

SEQ ID NO: 130067 - RNA, 1698 nt, Artificial Sequence; identical to SEQ ID NO: 129809
  derived and/or modified sequence opt3 from hemagglutinin__InfluenzaA__AEX35142

SEQ ID NO: 130068 - RNA, 1698 nt, Artificial Sequence
  derived and/or modified sequence opt3 from hemagglutinin__InfluenzaA__AEX35153
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaaagccaaacccggagaauggaaccuguuaucccggccauuuugcugacuacgaggaacugagagagcaacucuccucugugucgucauucgaaagguuugagauuuucccuaaggagagcaguuggccaaaccacacugucacagguguguccgccucuugcagccauaauggggaauccucauuuuauaaaaacuuacuguggcuuaccggaaagaauggcuuguaccccaaccugaguaaaagcuaugcaaauaacaaggagaaagaagugcuaguucucuggggcgugcaccacccuccaaacaucgggaaucagaugacgcuguaccauaaggagaacgccuacgucucugugguguccucacacuauagccggaaguucacucccgaaauagcuaaacgcccuaagguccgagaucaggagggacguaucaauuacuauuggacccuucuggagccaggugacacaauuaucuuugaagcaaguggcaacuugauugccccgagauacgcuuucgcccucucuaggggguuuggauccggcaucauaaauagcaacgcgcccauggaugagugugacgcaaaaugccagacuccucaaggugccauuaauucgaaccugccauuccagaauguucaucccgugaccaucggggaauguccuaaguauguacggucugcuaaauuacgcauggugacaggacugagaaacauuccauccauccagucaaggggccucuuuggcgccaucgcaggguucauugagggagguuggaccggcauggucgaugggugguacggauaucaccaccagaaugaacaaggcagugguuacgcugccgaccaaaagagcacgcagaacgcgauaaaugggaucacuaacaaaguaaauuccguuauugagaagaugaacacacaguuuaccgccgugggcaaggaguucaacaaacuugaacggcgcauggagaaucugaacaagaaagucgaugacggauucaucgauguguggacuuacaaugcagaauugcuaguacugcucgagaacgaacgaacacuggacuuucaugacucuaauguuaagagccuuuaugagaaagugaagaaccagcugaagaauaacgcuaaagagauaggcaaugggugcuucgaauuuuaccacaaguguaacgaugagugcauggaaucagucaaaaauggaaccuaugacuaccccaaguauagugaggaguccaaauugagcagagaaaagauugauggugugaagcucgagucuaugggcgucuaccagauccuggccaucuauucaacgguggcuaguagcuuaguucugcuagugucccucggggccauuucuuucuggaugugcucgaacggaagccugcaguguaggaucugcauuuga

SEQ ID NO: 130069 - RNA, 1698 nt, Artificial Sequence
  derived and/or modified sequence opt3 from hemagglutinin__InfluenzaA__AEX35164
augaaggugaaacugcucguccuucugugcgccuucaccgcuacauacgcagacacuaucuguauuggcuaucacgccaacaauagcacggauaccguugacacaguguuggagaagaacguaacugugacccauuccgucaauuuacuggaaaacucucacaaugggaaacuaugccuccugaagggaauagcgccccuucagcuggguaacuguucaguggcuggcuggaucuuggggaauccugagugcgaacuccugauuaguaaagagagcugguccuacaucguugaaaagccaaacccggagaauggaacauguuaucccggccauuuugccgauuacgaggaacugagagagcaacucucuucggugagcucauucgaaagguuugagauuuucccuaaggagaguuccuggccaaaccacaccgucacuggugugucugcaagcugcucccauaauggggaaucaaguuuuuaucggaacuuacuguggcuuacaggcaaaaauggauuguaccccaaccugagcaagucuuaugccaauaacaaagagaaggaaguucuaguacucuggggcgugcaccacccuccaaacaucgggguccagaaagcucuguaccauaccgagaaugcauacguguccguggucucaagccacuauagucgcaaguucacgcccgaaauagccaagcgaccuaaaguucgugaccaggagggaagaaucaacuacuauuggacucuucuggagccaggugauaccauuaucuuugaagcuaauggcaacuugauugccccgagguacgcguucgcacucucucggggguuuggauccggcaucauaaauagcaacgcccccauggacaagugugaugcuaaaugccagacaccucaaggugccauuaauucgucucugccauuccagaacgugcaucccguaacuaucggggaguguccuaaguaugugcgcuccgcaaaauuaagaauggucaccggacugaggaauauuccaucaauccagagucggggccucuuuggcgcuaucgccggguucauugaaggagguuggacaggcaugguggacgggugguacggauaucaccaccagaacgagcaaggcagcgguuacgcggccgaucagaaguccacccagaaugcaauaaacgggaucacgaauaaaguuaacucugugauugaaaagaugaauacucaguuuacagcugucggcaaggaguucaacaaacuugagcgccgaauggaaaaccugaauaagaaaguggacgauggauucaucgacauauggaccuacaacgccgaguugcuaguacugcucgaaaaugagagaacucuggauuuucaugacagcaacguuaagaaucuuuaugaaaaagugaagucacaacugaagaacaaugcuaaagagauuggcaacgggugcuucgaguuuuaccacaaguguaaugacgaaugcauggagagugucaaaaacggaacauaugauuaccccaaguauuccgaagagagcaaauugaauagggagaagaucgacggugugaagcucgaaucuaugggcgucuaccagauccuggccauuuauucaaccguggcaaguagcuuaguucugcuagugucccucggggccaucucuuucuggaugugcucgaacggaagccugcagugucggauuugcauauga

SEQ ID NO: 130070 - RNA, 1698 nt, Artificial Sequence
  derived and/or modified sequence opt3 from hemagglutinin__InfluenzaA__AEX35175
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucgauuuacuggaagacucucacaaugggaaacuaugccuccugaagggaauagcgccccuucagcuggguaacuguucaguggccggcuggaucuuggggaauccugagugcgaacuccugauuaguaaagagagcugguccuacaucguugaaaccccaaacccggagaauggaacuuguuaucccggcuacuuugcugauuaugaggaacugagagagcaacucucuucggugagcucauucgaaagguuugagauuuucccuaaggagaguuccuggccaaaccauacagucaccggugugacggccucuugcagccacaaugggaaguccucauuuuaccggaacuuacuguggcuuacuggcaaaaauggauuguaucccaaccugaguaagagcuacgcaaauaacaaagaaaaggagguucuaguacucuggggcgugcaucacccuccaaauaucggggaccagcgcgcccuguaccacaccgaaaacgcuuaugucucugugguguccucacauuacagccgacguuucacacccgagauagcaaaaagaccuaaggucagggaucaggaaggacggaucaacuauuacuggacucuucuggagccaggugacaccauuaucuuugaggccaauggcaacuugauugcuccgcgcuucgccuuugcgcucaauagaggguucggaaguggcaucauaacaucuaacgcacccauggaugguugugacgccaagugccagaccccucaaggggcuauuaauuccagccugccauuucagaacguucaccccgugacgaucggagaauguccuaaauauguaaggucggccaaguuacggauggcaacuggccugcgcaauauuccaucuauccagucccgaggccucuucggggcuaucgccggauuuauugaggguggcuggacagggaugguggauggaugguacggcuaucaucaccagaacgaacaagguucaggguacgcggccgaccagaaaaguacccagaaugcaauaaacggcaucacuaauaaggucaacagcgugauugagaaaaugaauacacaguucaccgcuguuggaaaggaguucuccaaacuugaaagaaggauggagaaccugaauaagaagguggaugacggcuuuuuggacaucuggacguacaacgccgaacuacugguccuccuggagaacgaacggacccuugauuuccacgacucuaaugugaaaaaccuguaugagaagguaaaaagccaauugaagaauaacgcuaaagaaauagggaauggaugcuuugaguucuaccauaaguguaacgaugagugcauggaaucaguuaagaaugguacauaugacuaccccaaauauagugaggaauccaagcucaaccgugagaaaauugauggcgugaagcuggagagcaugggggucuaccagaucuuagccaucuauucuacuguggcaucaagucugguccuacucgugagccugggagccauuuccuuuuggaugugcucuaauggcucgcuucagugucgcaucugcauuuga

SEQ ID NO: 130071 - RNA, 1698 nt, Artificial Sequence
  derived and/or modified sequence opt3 from hemagglutinin__InfluenzaA__AEX35186
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucgggaaccagcgcgcccuguaccauacugagaaugcuuacguguccgucgugucaagccacuauagucgaaaauucacccccgaaauagcaaagcguccuaaggugagagaucaggagggaaggaucaacuacuauuggacacuucuggagccaggugacacuauuaucuuugaagccaauggcaacuugauugcuccgcgguacgccuucgcgcucucucgcggguuuggauccggcaucauaaauagcaacgcacccauggaugagugugacgccaaaugccagaccccucaaggugcuauuaauucgucucugccauuccagaacguccaucccguuacaaucggggaauguccuaaguaugugagauccgccaaauuaaggaugguaaccggacugcggaauauuccaucaauccagagucgcggccucuuuggcgcaaucgcuggguucauugagggagguuggacgggcaugguggaugggugguacggauaucaccaccagaacgaacaaggcagcgguuacgccgcggaccagaaguccacucagaaugccauaaacgggaucacaaauaaagucaacucugugauugagaagaugaauacccaguuuacugcaguuggcaaagaguucaacaaacuugaacgaagaauggagaaccugaauaagaaaguggaugacggauucaucgauauauggacauacaacgcugaauugcuaguccugcucgagaaugaaaggacccuggacuuucaugacagcaacgugaagaaucuuuaugagaaaguaaagucacaacugaaaaacaaugccaaggagauuggcaacgggugcuucgaauuuuaccacaaguguaaugaugagugcauggaaaguguuaaaaacggaacguaugacuaccccaaguauuccgaggagagcaaauugaaucgggaaaagaucgauggugugaaacucgagucuaugggcgucuaccagauccuggcuauuuauucaaccguggccaguagcuuaguccugcuagugucccucggggcaaucucuuucuggaugugcucgaacggaagccugcagugucguauuugcauauga

SEQ ID NO: 130072 - RNA, 1698 nt, Artificial Sequence; identical to SEQ ID NO: 130071
  derived and/or modified sequence opt3 from hemagglutinin__InfluenzaA__AEX35197

SEQ ID NO: 130073 - RNA, 1698 nt, Artificial Sequence; identical to SEQ ID NO: 124504
  derived and/or modified sequence opt3 from hemagglutinin__InfluenzaA__AEX35208

SEQ ID NO: 130074 - RNA, 1701 nt, Artificial Sequence
  derived and/or modified sequence opt3 from hemagglutinin__InfluenzaA__AEX35219
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccucaggccgugugaccguaagcacaaagagaagucaacagacuguuauuccaaacaucgggucuaggcccugggugcgggaugucuccagccgcauuucgaucuacuggaccauagugaaaccuggagacauucuacucaucaauucuacagguaaccugauugcgccaagaggcuauuucaagaucagguccgggaagucaaguaucaugcggagcgacgcaccgauuggaaaauguaauuccgaaugcauaacccccaacggcucuaucccuaaugauaagccauuucagaacgugaaucgcauuacguacggugccuguccccgauaugucaaacagaacacucuuaagcuggcuacagggaugagaaauguuccugagaaacaaaccaggggaaucuucggcgccauagcaggcuuuauugaaaacgggugggagggaaugguggacgguugguacggcuuccggcaccagaauagcgaggggacuggacaggcugccgauuugaagucaacacaagcggccaucaaccagaucaauggcaaacucaaccgucugauugguaagaccaaugaaaaguuucaucagaucgagaaagaguucagugaaguagaagggcgcauucaggacuuagagaaguauguggaggauacgaaaauagaccugugguccuacaacgcagaacuccuugucgcucuggagaaccaacacaccaucgauuugacagacagcgaaaugaauaagcuauucgagagaacuaaaaagcagcugagggaaaacgccgaggauaugggcaauggaugcuuuaagauuuaucauaaaugugacaacgcuugcaucggcucuauccggaaugggaccuacgaucacgacguguaccgagacgaggcccucaacaaucgcuuccagauuaagggaguugaacugaaaucagguuauaaggauuggauacuuuggaucaguuuugcaaugagcugcuuccuguugugugugguccuccugggcuuuauuaugugggccugccagaaagggaacaucagauguaauauuugcaucuga

SEQ ID NO: 130075 - RNA, 1698 nt, Artificial Sequence; identical to SEQ ID NO: 130016
  derived and/or modified sequence opt3 from hemagglutinin__InfluenzaA__AEX35230

SEQ ID NO: 130076 - RNA, 1701 nt, Artificial Sequence; identical to SEQ ID NO: 123913
  derived and/or modified sequence opt3 from hemagglutinin__InfluenzaA__AEX35241

SEQ ID NO: 130077 - RNA, 1698 nt, Artificial Sequence; identical to SEQ ID NO: 130016
  derived and/or modified sequence opt3 from hemagglutinin__InfluenzaA__AEX35263

SEQ ID NO: 130078 - RNA, 1698 nt, Artificial Sequence; identical to SEQ ID NO: 130016
  derived and/or modified sequence opt3 from hemagglutinin__InfluenzaA__AEX35274

SEQ ID NO: 130079 - RNA, 1701 nt, Artificial Sequence; identical to SEQ ID NO: 123811
  derived and/or modified sequence opt3 from hemagglutinin__InfluenzaA__AEX35285

SEQ ID NO: 130080 - RNA, 1701 nt, Artificial Sequence; identical to SEQ ID NO: 129977
  derived and/or modified sequence opt3 from hemagglutinin__InfluenzaA__AEX35296

SEQ ID NO: 130081 - RNA, 1701 nt, Artificial Sequence
  derived and/or modified sequence opt3 from hemagglutinin__InfluenzaA__AEX35307
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacagguggcaucugcgacagcccacaccagauacuggauggggagaauuguacccuaaucgacgcucuccugggagauccgcagugcgacggcuuucaaaacaaaaagugggaucuuuucguggaaagauccaaagccuauucuaauuguuaccccuaugacgucccugauuacgcaucgcugaggucauugguggccagcagugguacucucgaguuuaacaaugaauccuucaacuggacagggguuacccagaauggaacgucuagcgcuugcaagcggcgcuccaacaagucauuuuucagucgacugaauuggcugacucaucucaaauauaaguacccagcauuaaacgugaccaugcccaauaacgagaaauuugacaagcuguauauuuggggcguccaccauccuggcacagauagcgaccagaucucucuuuacgcccaggcuuccgggcguauuacugugucaaccaaaagaagccaacagacaguaaucccaaacauaggaaguaggccccggguucgcgaugugucuuccagaauuagcaucuacuggaccauugucaagccuggugacaucuugcugaucaauucgacgggcaaccuaauugccccaaggggguauuucaagauacggucuggaaaauccucaaucaugcgcagugacgcgccgauuggcaaguguaauagcgagugcaucacucccaacgguuccauaccuaaugauaaaccauuucagaacgugaaucgaauuacauacggggcaugucccagauaugugaagcagaacacccucaaacuggccacuggaaugaggaaugucccugaaaagcaaacacggggcaucuucggcgcuaucgccggguuuauugagaacggaugggaagguaugguugacggcugguacggguuccgucaccaaaauucugagggaaccggccaggcagcugaucuuaaaagcacgcaggccgcgaucaaccagauuaaugguaagcugaaccgcuugauagggaagaccaaugagaaauuucaccagaucgaaaaggaguucucagaaguggagggcaggauucaggaccucgaaaaauauguagaggauacaaagaucgaccuguggaguuacaacgccgaguuacugguggcacucgaaaaccaacauacuaucgaucuuaccgacuccgagaugaauaaacuguucgaaagaacaaagaagcaguugcgggagaacgcugaagauaugggaaauggcugcuuuaaaauuuaucacaagugugacaacgccugcauagggagcauccgaaauggaacuuacgaucaugacgucuaccgcgacgaggcucuaaacaauagauuccagauuaaagguguggagcugaagucuggcuauaaagauuggauccucuggauuucauuugccaucaguugcuuccugcuuuguguugugcuguugggguuuauaaugugggcaugccagaagggaaacaucagguguaauauuugcaucuga

SEQ ID NO: 130082 - RNA, 1701 nt, Artificial Sequence; identical to SEQ ID NO: 129977
  derived and/or modified sequence opt3 from hemagglutinin__InfluenzaA__AEX35318

SEQ ID NO: 130083 - RNA, 1701 nt, Artificial Sequence
  derived and/or modified sequence opt3 from hemagglutinin__InfluenzaA__AEX35329
augaagaccaucauugcccugagcuacuuccucugccuuguguuugcucagaaacugcccggcaacgacaauuccacagcaacuuuguguuuagggcaccaugccgucccuaacggaacgauaguuaagaccaucacaaaugaucaaauugaggugacuaacgcgaccgaacugguacaaaauucuucaacagguggcaucugcgacaguccacaccagauucuagauggggagaacuguacccucaucgacgcucugcuuggagauccgcagugcgacggcuuccagaauaaaaagugggaucuguuuguggaaagaagcaaagccuauuccaacuguuaccccuaugacgucccugauuacgcaucuuugaggucgcucguggccucaagcgguacucuggaguucaauaacgaaaguuuuaauuggacagggguuacccagaacggaacguccucugcuugcaagcggcgcagcaauaaguccuucuuuucacgacugaacuggcucacucauuuaaaauauaaguacccagcacugaaugugaccaugcccaacaacgagaaauucgacaaacuuuauauauggggcguccaccauccuggcacagauagugaccagaucagcuuguacgcccaggcuucugggcguauuacuguguccaccaagagaucacaacagacaguaaucccaaauauuggaagcaggccccggguucgcgaugugaguucuagaaucuccauauacuggaccauugucaagccuggugacauccugcuaauuaacagcacgggcaaucucaucgccccaaggggguauuuuaagauccggucgggaaaaucuuccauuaugcgcucagacgcgccgauaggcaaguguaacagugagugcaucacucccaaugguagcauuccuaacgauaaaccauuccagaaugugaaccgaaucacauacggggcaugucccagauaugugaagcagaauacccugaaacuugccacuggaaugaggaacgucccugaaaagcaaacacggggcauauuuggcgcuauugccggguucaucgagaauggaugggaagguaugguugacggcugguacggguuucgucaccagaacuccgagggaaccggccaggcagcugaucugaaaucuacgcaagccgcgaucaaucagauuaacgguaaguugaaucgccucaucgggaagaccaacgagaaauuccaccagauugaaaaggaguucagcgaaguggagggcagaauacaggaccuggaaaaauauguagaggauacaaagaucgacuuauggucauacaacgccgagcugcucguggcacuugaaaaucaacauacuauugaucugaccgacagugagaugaacaaauuguuugaaaggacaaagaagcagcuacgggagaaugcugaagauaugggaaacggcugcuucaaaaucuaucacaagugugacaaugccugcaucggguccauucgaaacggaacuuacgaucaugacgucuaccgcgacgaggcucugaauaacagauuucagauaaaagguguggagcucaagagcggcuauaaagauuggauccuguggauuucuuucgccaucucaugcuuucuucuguguguugcauugcucggguucauuaugugggccugccagaagggaaauaucagguguaacauaugcaucuga

SEQ ID NO: 130084 - RNA, 1701 nt, Artificial Sequence
  derived and/or modified sequence opt3 from hemagglutinin__InfluenzaA__AEX35340
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacagguggcauuugcgacaguccacaccagauccuagauggggagaacuguacccucauagacgcucugcuuggagauccgcagugcgacggcuuucagaauaaaaagugggaucuguucguggaaagaagcaaagccuauuccaacuguuaccccuaugacgucccugauuacgcaucuuugaggucgcucguggccucaagcgguacucuggaguuuaauaacgaaaguuucaauuggacagggguuacccagaacggaacguccucugcuugcaagcggcgcagcaauaaguccuuuuucucacgacugaacuggcucacucauuuaaaauauaaguacccagcacugaaugugaccaugcccaacaacgagaaauuugacaaacuuuauaucuggggcguccaccauccuggcacagauagugaccagauuagcuuguacgcccaggcuucugggcguaucacuguguccaccaagagaucacaacagacaguaauuccaaauaucggaagcaggccccggguucgcgaugugaguucuagaauauccauuuacuggaccaucgucaagccuggugacauucugcuaaucaacagcacgggcaaucucaucgccccaaggggguauuucaagauucggucgggaaaaucuuccauaaugcgcucagacgcgccgaucggcaaguguaacagugagugcauuacucccaaugguagcaucccuaacgauaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugacggcugguacggguuccgucaccagaacuccgagggaaccggccaggcagcugaucugaaaucuacgcaagccgcgauuaaucagaucaacgguaaguugaaucgccucauugggaagaccaacgagaaauuucaccagauagaaaaggaguucagcgaaguggagggcagaauccaggaccuggaaaaauauguagaggauacaaagauugacuuauggucauacaacgccgagcugcucguggcacuugaaaaucaacauacuaucgaucugaccgacagugagaugaacaaauuguucgaaaggacaaagaagcagcuacgggagaaugcugaagauaugggaaacggcugcuuuaaaaucuaucacaagugugacaaugccugcauuggguccauacgaaacggaacuuacgaucaugacgucuaccgcgacgaggcucugaauaacagauuccagaucaaagguguggagcucaagagcggcuauaaagauuggauucuguggaucucuuuugccauuucaugcuuccuucuguguguugcauugcucggguuuaucaugugggccugccagaagggaaauauaagguguaacaucugcauuuga

SEQ ID NO: 130085 - RNA, 1701 nt, Artificial Sequence; identical to SEQ ID NO: 129977
  derived and/or modified sequence opt3 from hemagglutinin__InfluenzaA__AEX35351

SEQ ID NO: 130086 - RNA, 1701 nt, Artificial Sequence; identical to SEQ ID NO: 129977
  derived and/or modified sequence opt3 from hemagglutinin__InfluenzaA__AEX35362

SEQ ID NO: 130087 - RNA, 1701 nt, Artificial Sequence; identical to SEQ ID NO: 123811
  derived and/or modified sequence opt3 from hemagglutinin__InfluenzaA__AEX35373

SEQ ID NO: 130088 - RNA, 1701 nt, Artificial Sequence
  derived and/or modified sequence opt3 from hemagglutinin__InfluenzaA__AEX35384
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugagcgugaccaugcccaacaaugagaaauucgacaaacuuuacaucuggggcguccaccauccuggcacagauaacgaccagauuucuuuguaugcccaggcuuccgggcguaucacugugucaaccaagagaagccaacagacaguaauuccaaacaucggaaguaggacccggguucgcgaugugcccucuagaauauccauuuacuggacgaucgucaagccuggugacauucugcuaaucaauagcacuggcaaccucaucgccccaaggggguacuuuaagauucggucgggaaaaucuuccauaaugcgcucagacgcgccgaucggcaaguguaauagugagugcauuacacccaacgguagcaucccuaaugauaaaccauuccagaacgugaaucgaauaaccuauggggcaugucccagauacgugaagcagaacacucugaaacuugccacaggaaugaggaaugucccugaaaagcaaacccggggcauuuuuggcgcuaucgccggguucaucgagaacggaugggaagguaugguugacggcugguauggguuucgucaccaaaauuccgagggaacgggccaggcagcugaucugaaaucuacccaggccgcgauuaaccagaucaaugguaaguugaaccgccucauugggaagacaaaugagaaauuccaccagauagaaaaggaguucagcgaaguggagggcagaauccaggaccuggaaaaauacguagaggauacuaagauugacuuauggucauauaacgccgagcugcucguggcacuugaaaaccaacauaccaucgaucugacagacagugagaugaauaaauuguuugaaaggacuaagaagcagcuacgggagaacgcugaagauaugggaaauggcugcuucaaaaucuaccacaagugugacaacgccugcauuggguccauacgaaauggaaccuaugaucaugacgucuaccgcgacgaggcucugaacaauagauuucagaucaaagguguggagcucaagagcggcuacaaagauuggauucuguggaucucuuucgccauuucaugcuuucuucuguguguugcauugcucggguucaucaugugggccugccagaagggaaacauaagguguaauaucugcauuuga

SEQ ID NO: 130089 - RNA, 1701 nt, Artificial Sequence
  derived and/or modified sequence opt3 from hemagglutinin__InfluenzaA__AEX35395
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaaguggaaucuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcaagcggcgcuccaauaagucauuuuucagucgacugaacuggcucacucauuuaaaauuuaaguauccagcacugaaugugaccaugcccaacaacgagaaauucgauaaacuuuacaucuggggaguccaccauccuggcacagacaaugaucagauuagcuuguaugcccaggcuucuggccguaucacuguguccaccaagagaucacaacagacaguaauuccaaacaucgggagcaggccccggguucgcgacgugccuaguagaauaucuauuuacuggaccaucgucaagccaggagauauucugcuaaucaauuccacggguaaccucaucgccccgaggggcuacuuuaagauucggagcgggaaaucgucuauaaugcgcuccgacgcgcccaucggaaaguguaauucagaaugcauuacuccuaacggcaguaucccaaaugacaaacccuuccagaacgugaaucgaauaacauauggugcauguccuagauacgugaagcagaacacccugaaacuugccacugggaugaggaaugucccagagaagcaaacacggggaauuuuuggcgcuaucgccggcuucaucgaaaacgggugggagggaaugguugaugguugguauggcuuucgucaccagaauagcgaggggaccggacaggcagcugaccugaaauccacgcaagccgcgauuaaccagaucaauggcaaguugaaccgccucauugguaagaccaacgaaaaauuccaccagauagagaaggaguucucugaaguggaagggagaauccaggaucuggagaaauacguagaggacacaaagauugauuuauggagcuauaaugccgaacugcucguggcacuugagaaccaacauacuaucgaccugaccgauucagaaaugaauaaauuguuugagaggacaaagaagcagcuacgggaaaacgcugaggacaugggcaauggaugcuucaaaaucuaccacaagugugauaacgccugcauuggcaguauacgaaaugggacuuaugaccaugaugucuaccgcgacgaggcucugaacaauagauuucagaucaaaggaguggaacucaaguccgguuacaaagacuggauucuguggaucagcuucgccauuucuugcuuucuucuguguguugcauugcucggcuucaucaugugggccugccagaaggggaacauaagguguaauaucugcauuuga

SEQ ID NO: 130090 - RNA, 1701 nt, Artificial Sequence; identical to SEQ ID NO: 123811
  derived and/or modified sequence opt3 from hemagglutinin__InfluenzaA__AEX35406

SEQ ID NO: 130091 - RNA, 1701 nt, Artificial Sequence; identical to SEQ ID NO: 123811
  derived and/or modified sequence opt3 from hemagglutinin__InfluenzaA__AEX35417

SEQ ID NO: 130092 - RNA, 1701 nt, Artificial Sequence
  derived and/or modified sequence opt3 from hemagglutinin__InfluenzaA__AEX35428
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaaaagugggauuuguucguggaaagauccaaagccuauucuaauuguuaccccuaugacgucccugauuacgcaucgcucaggucacugguggccagcagugguacucuggaguuuaacaaugaauccuucaacuggacagggguugcucaaaauggaaccucuagcgcaugcaagcggcgcuccgacaagucauuuuucagucgacucaacugguuacaccagcugaaauauaaguacccagcccuuaaugugacgaugcccaacaaugagaaauuugauaaguuguauauauggggcguccaucacccuggcacugacagcgaucagaucucucuguacgcucaggccuccgggcguauuaccgugucaacaaaaagaagccaacagacuguaaucccaaacauuggaaguaggccccggguucgcgacgugucuuccagaaucagcauauacuggaccauugucaagccuggugacauccuauucauuaacucgacaggcaaucucaucgcgccaaggggguauuuuaagauccggucuggaaaauccucaauuaugcgcagugaugcaccgauagacaaguguaacagcgagugcaucacccccaauggcuccauuccuaacgauaaaccauuccagaaugugaaccgaaucacguacggugccugucccagauaugugaagcagaauacucugaaacuugcuacagggaugaggaacgucccugaaaagcaaacccggggaauauuuggcgccauugcaggcuucaucgagaaugggugggaaggaaugguugacgguugguacggcuuucgucaccagaacucugaggggacuggacaggcugccgaucugaaaagcacacaagcggccaucaaucagauuaacggcaaguugaaucgccucaucgguaagaccaacgagaaauuccaucagauugaaaaggaguucucagaaguggaggggagaauacaggaccuggaaaaauauguagaggauacgaagaucgacuuauggaguuacaaugcagagcugcucguggcucuugaaaaccaacacaccauugaucugacagacuccgagaugaacaaauuguuugaaaggacuaagaagcagcuacgggagaaugccgaagauaugggcaacggaugcuucaaaaucuaucauaagugugacaaugcuugcaucggcagcauucgaaacgggaccuacgaccacgaugucuaccgcgacgaggcccugaauaacagauuucagauaaaaggaguggagcucaagucugguuauaaagauuggauccuguggauuucauucgcaaucaguugcuuucuucuguguguugccuugcucggcuucauuaugugggcuugccagaaggggaauaucagguguaacauaugcaucuga

SEQ ID NO: 130093 - RNA, 1698 nt, Artificial Sequence
  derived and/or modified sequence opt3 from hemagglutinin__InfluenzaA__AEX35439
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgcgcuucgccuuugcgcucucuagaggguucggauccggcaucauaaccagcaacgcacccauggacgaaugugaugccaagugccagacaccucaaggugcuauuaauucgucucugccauuucagaacguucaccccgugaccaucggggaguguccuaaauauguaagguccgccaaguuacggauggugacgggacugcgcaauauuccaucaauccagagucgaggccucuucggcgcaaucgcuggguuuauugaaggagguuggacuggcauggucgacgggugguacggauaucaucaccagaacgagcaaggcagcgguuacgccgcggaucagaaauccacacagaaugccauaaacgggaucaccaauaaggugaacucuguuauugaaaagaugaauacucaguucacagcagugggcaaagaguucaacaaacuugagagaaggauggaaaaucugaacaagaaggucgacgauggauuuuuggacaucuggaccuacaacgcugagcuacuggugcuccuggaaaaugagcggacgcuugacuuccacgauagcaacguuaaaaaucuguaugaaaagguaaaaucacaauugaagaacaaugccaaagagauaggcaacgggugcuuugaguucuaccauaaguguaaugacgaaugcauggagagugugaagaacggaaccuaugauuaccccaaauauuccgaagagagcaagcucaaucgugagaaaauugacggugucaagcuggaaucuaugggcguguaccagaucuuagcuaucuauucaacagucgccaguagccuggugcuacucguuucccugggggcaauuucuuuuuggaugugcucgaacggaagccuucagugucgcaucugcauuuga

SEQ ID NO: 130094 - RNA, 1701 nt, Artificial Sequence
  derived and/or modified sequence opt3 from hemagglutinin__InfluenzaA__AEX35450
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaaaacuucaauuggacagggguuacccagaacggaacguccucugcuugcaagcggcgcagcaauaacuccuuuuucucacgacugaauuggcucacucauuuaaaguuuaaauauccagcacugaacgugaccaugcccaacaaugagaaguucgacaaacuuuacaucuggggcguccaccauccuggcacagauaacgaccagauuuuucuuuaugcccaggcuagugggcguaucacugugagcaccaagagaucucaacagacaguaauuccaaauaucggauccaggccccggguucgcaacauaccuucaagaauuagcaucuacuggaccauugugaaaccaggugauauccugcuaaucaauaguacgggcaaccucauugccccgaggggguacuucaagauacagucuggaaaguccagcaucaugcggucggacgcgcccauuggcaaauguaauucugagugcaucacuccuaacgguuccauaccaaaugacaagcccuuucagaacgucaaucgcauuacauauggggcauguccucgauacgugaaacaaaacacccugaaguuggccacuggaaugagaaaugugccagaaaaacagacaaggggcaucuucggcgcuaucgccggguuuauugagaacggaugggaagguauggucgauggcugguauggguuccggcaccaaaauucagagggaaucggccaggcagcugaccugaagaguacccaggccgcgauuaaccagauaaacgguaaauugaaucgucucaucgggaagacgaacgagaaguuccaccagauugaaaaagaguuuagcgaaguugagggccgcauccaagaucuggaaaaguacguggaggacaccaaaaucgauuuaugguccuauaaugccgagcugcucguagcacuugaaaaccagcauacaauugaccugacugauucugagaugaauaaguuguucgaaagaaccaaaaagcagcuaagggagaacgcugaagacaugggaaauggcugcuuuaagauauaccacaaaugugauaacgccugcaucgggagcauucggaauggaacauaugaccaugauguguaccgagacgaggcucugaacaaucgcuuccagaucaagggugucgagcucaaaucaggcuacaaggacuggauucuguggaucaguuuugccauauccugcuuccuucuguguguggcauugcucggguuuaucaugugggccugccaaaaaggaaacauuagauguaauaucugcauuuga

SEQ ID NO: 130095 - RNA, 1701 nt, Artificial Sequence; identical to SEQ ID NO: 122646
  derived and/or modified sequence opt3 from hemagglutinin__InfluenzaA__AEX35461

SEQ ID NO: 130096 - RNA, 1701 nt, Artificial Sequence
  derived and/or modified sequence opt3 from hemagglutinin__InfluenzaA__AEX35472
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacgauuuucaaaacaaaaagugggaccuguucguggaaagauccaaagccuauucuaauuguuaccccuaugaugucccugacuacgcaucguugaggucacucguggccagcaguggcacucuggaguuuaacaaugaauccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgauaaacuuuacaucuggggaguccaccauccuggcacagacaaugaucagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagacauccugcuaaucaacucuacggguaaucucauugccccgaggggcuacuucaagauacgguccggaaagagcucgaucaugcgcucugacgcgcccauugggaaauguaacuccgagugcaucacuccuaauggcucaauaccaaacgauaagcccuuucagaaugucaaccgaauuacauauggugcauguccuagauacgugaaacagaauacccugaagcuggccacugggaugaggaacgugccagaaaaacaaacacggggaaucuucggcgcuaucgccggcuuuauugagaaugggugggaaggaauggucgacgguugguauggcuuccgucaccagaacagugaggggaucggacaggcagcugaucuuaagagcacccaagccgcgauuaaucagauaaacggcaaauugaaccgccucaucgguaagacgaaugagaaguuccaccagauugaaaaagaguuuuccgaaguugaggggagaauccaggaccuggaaaaguacguggaggauaccaaaaucgacuuauggucuuauaacgccgagcugcucguagcacuugaaaaucaacauacaauugaucugacugacagcgagaugaacaaguuguucgaaaggaccaaaaagcagcuacgggagaaugcugaagauaugggcaacggaugcuuuaagauauaccacaaaugugacaaugccugcaucggcucaauucgaaacgggacauaugaucaugacguguaccgcgacgaggcucugaauaacagauuccagaucaagggagucgagcucaaaagugguuacaaggauuggauucuguggaucuccuuugccauaagcugcuuccuucugugugugguuuugcucggcuuuaucaugugggcaugccagaaagggaauauuagguguaacaucugcauuuga

SEQ ID NO: 130097 - RNA, 1701 nt, Artificial Sequence; identical to SEQ ID NO: 122646
  derived and/or modified sequence opt3 from hemagglutinin__InfluenzaA__AEX35483

SEQ ID NO: 130098 - RNA, 1701 nt, Artificial Sequence
  derived and/or modified sequence opt3 from hemagglutinin__InfluenzaA__AEX35494
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggccugcaaaacaaaaagugggauuuguuuguggaaagauccaaagccuauucuaauuguuaccccuaugacgucccugauuacgcaucgcucaggucacugguggccagcagugguacucuggaguucaacaaugaauccuuuaacuggacagggguuacccagaauggaacgucuagcgcuugcaagcggcgcuccaacaauucauucuuuagucgacucaacugguuaacucaucugaaguucaaauauccagcacuuaaugugaccaugcccaacaacgagaaguuugacaaauuguacaucuggggcguccaccauccuggcacagauaaugaccagauuuuccuguaugcccaggcuagcgggcguaucacugugucuaccaagagaucccaacagacaguaauuccaaacaucggaucaaggccccggguucgcaauauaccuagcagaauuaguaucuacuggaccauugugaaaccaggugauauccuacucaucaacucuacgggcaaucugauugccccgaggggguacuuuaagauacgguccggaaagagcucgaucaugcgcucugacgcgcccauuggcaaauguaacuccgagugcaucacuccuaaugguucaauaccaaacgacaagcccuuccagaaugucaaccgaauuacauauggggcauguccuagauacgugaaacagaauacccuuaagcuggccacuggaaugaggaacgugccagaaaaacaaacacggggcaucuuuggcgcuaucgccggguucauugagaauggaugggaagguaugauggauggcugguauggguuucgucaccagaacagugagggaaucggccaggcagcugaccucaagagcacccaagccgcgauuaaucagauaaacgguaaauugaaccgccugaucgggaagacgaaugagaaguuccaccagauugaaaaagaguucuccgaagucgagggcagaauccaggauuuagaaaaguacguugaggacaccaaaaucgaucuguggucuuauaacgccgagcuccuuguggcacuggaaaaucaacauacaauugacuugacugauagcgagaugaacaagcuauuugaaaggaccaaaaagcagcugcgggagaaugcugaagacaugggaaacggcugcuucaagauauaccacaaaugugauaaugccugcaucgggucaauucgaaacggaacauaugaccaugauguauaccgcgacgaggcucucaauaacagauuucagaucaaggguguggagcugaaaaguggcuacaaggacuggauucuuuggaucuccuucgccauaagcugcuuucuguugugugucgcacuccugggguucaucaugugggccugccagaaaggaaauauuagguguaacaucugcauuuga

SEQ ID NO: 130099 - RNA, 1701 nt, Artificial Sequence
  derived and/or modified sequence opt3 from hemagglutinin__InfluenzaA__AEX35505
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacgauuuucaaaacaaaaagugggaccuguucguggaaagauccaaagccuauucuaauuguuaccccuaugaugucccugacuacgcaucguugaggucacucguggccagcaguggcacucuggaguuuaacaaugaauccuucaacuggacagguguuacccagaaugggacgucuagcgcuugcaagcggcgcuccaacaauucauuuuucagucgacugaacuggcucacucauuuaaaguuuaaauauccagcacugaaugugaccaugcccaacaacgagaaguucgauaaacuuuacaucuggggaguccaccauccuggcacagacaaugaucagaucuuuuuguaugcccaggcuagcggccguauuacugugucuaccaagagaucccaacagacaguaauuccaaacaucgggucaaggccccggguucgcaauauaccuagcagaauuaguaucuacuggaccauugugaaaccaggagacauccugcuaaucaacucuacggguaaucucauugccccgaggggcuacuucaagauacuguccggaaagagcucgaucaugcggucugacgcgcccauugggaaauguaacuccgagugcaucacuccuaauggcucaauaccaaacgauaagcccuuucagaaugucaaccgcauuacauauggugcauguccucgauacgugaaacagaauacccuuaagcuggccacugggaugagaaacgugccagaaaaacaaacaaggggaaucuucggcgcuaucgccggcuuuauugagaaugggugggaaggaauggucgacgguugguauggcuuccggcaccagaacagugaggggaucggacaggcagcugaucucaagagcacccaagccgcgauuaaucagauaaacggcaaauugaaccgucugaucgguaagacgaaugagaaguuccaccagauugaaaaagaguuuuccgaaguugaggggcgcauccaggacuuagaaaaguacguggaggauaccaaaaucgaccuguggucuuauaacgccgagcuccuuguagcacuggaaaaucaacauacaauugauuugacugacagcgagaugaacaagcuauucgaaagaaccaaaaagcagcugagggagaaugcugaagauaugggcaacggaugcuuuaagauauaccacaaaugugacaaugccugcaucggcucaauucggaacgggacauaugaucaugacguguaccgagacgaggcucucaauaaccgcuuccagaucaagggagucgagcugaaaagugguuacaaggauuggauucuuuggaucuccuuugccauaagcugcuuccuguuguguguggcacuccugggcuuuaucaugugggccugccagaaagggaauauuagauguaacaucugcauuuga

SEQ ID NO: 130100 - RNA, 1701 nt, Artificial Sequence
  derived and/or modified sequence opt3 from hemagglutinin__InfluenzaA__AEX35516
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggccugcaaaacaaaaagugggauuuguuuguggaaagauccaaagccuauucuaauuguuaccccuaugacgucccugauuacgcaucgcucaggucacugguggccagcagugguacucuggaguucaacaaugaauccuuuaacuggacagggguuacccagaauggaacgucuagcgcuugcaagcggcgcuccaacaauucauucuuuagucgacucaacugguuaacucaucugaaguucaaauauccagcacuuaaugugaccaugcccaacaacgagaaguuugacaaauuguacaucuggggcguccaccauccuggcacagauaaugaccagauuuuccuguaugcccaggcuagcgggcguaucacugugucuaccaagagaucccaacagacaguaauuccaaacaucggaucaaggccccggguucgcaauauaccuagcagaauuaguaucuacuggaccauugugaaaccaggugauauccuacucaucaacucuacgggcaaucugauugccccgaggggguacuuuaagauacgguccggaaagagcucgaucaugcgcucugacgcgcccauuggcaaauguaacuccgagugcaucacuccuaaugguucaauaccaaacgacaagcccuuccagaaugucaaccgaauuacauauggggcauguccuagauacgugaaacagaauacccuuaagcuggccacuggaaugaggaacgugccagaaaaacaaacacggggcaucuuuggcgcuaucgccggguucauugagaauggaugggaagguauggucgauggcugguauggguuucgucaccagaacagugagggaaucggccaggcagcugaccucaagagcacccaagccgcgauuaaucagauaaacgguaaauugaaccgccugaucgggaagacgaaugagaaguuccaccagauugaaaaagaguucuccgaaguugagggcagaauccaggauuuagaaaaguacguggaggacaccaaaaucgaucuguggucuuauaacgccgagcuccuuguagcacuggaaaaucaacauacaauugacuugacugauagcgagaugaacaagcuauuugaaaggaccaaaaagcagcugcgggagaaugcugaagacaugggaaacggcugcuucaagauauaccacaaaugugauaaugccugcaucgggucaauucgaaacggaacauaugaccaugauguguaccgcgacgaggcucucaauaacagauuucagaucaagggugucgagcugaaaaguggcuacaaggacuggauucuuuggaucuccuucgccauaagcugcuuucuguuguguguggcacuccugggguucaucaugugggccugccagaaaggaaauauuagguguaacaucugcauuuga

SEQ ID NO: 130101 - RNA, 1701 nt, Artificial Sequence
  derived and/or modified sequence opt3 from hemagglutinin__InfluenzaA__AEX35527
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgugucguugaggucacucguugcaagcagugguacucuggaguuuaacaaugaauccuucaacuggacaggggugacccagaauggaacgucuagcgccugcaagcggcgcuccaacaauucauuuuucagucgacugaacuggcucacucauuuaaaguuuaaauauccagcucugaaugucaccaugcccaacaacgagcaguucgacaaacuuuacaucuggggcgugcaccauccuggcacagauaaugaccagauuagcuuguaugcacaagccucugggcguaucacuguauccaccaagagaucacagcagacaguuauuccaaacaucggaagcaggccccgggugcgcgauauaccuaguagaauuucuaucuacuggaccauugucaagccaggugacauccugcuaaucaauuccacgggcaaccucauugcuccgaggggguacuuuaaaauacggagcggaaagucgucuaucaugcgcuccgacgcccccauuggcaaguguaauucagagugcaucacuccuaacgguaguauaccaaaugauaaacccuuccagaacgugaaucgaauuacauauggggcguguccuagauacgugaagcaaaacacccugaaacuugcaacuggaaugaggaaugucccagaaaagcagacacggggcaucuuuggcgccaucgcuggguucauugagaacggaugggaagguaugguugacggcugguauggguuucgucaccagaauagcgagggaaucggccaagccgcagaucugaaauccacccaggcugccauuaaccagauaaaugguaaguugaaccgccucaucgggaaaacgaacgagaaguuccaccagauugaaaaggaguucucugaaguggagggcagaauccaagaccuggaaaaauacguagaggauaccaagaucgacuuauggagcuauaaugcggagcugcucguggcccuugaaaaccagcauacaauugaucugacugacucagagaugaauaaauuguuugaaaggaccaagaaacagcuacgggagaacgcagaagauaugggaaauggcugcuucaagauauaccacaagugugacaacgcuugcaucgggaguauucgaaauggaacauaugaucaugacgucuaccgcgacgaggcccugaacaauagauuucagaucaaagguguggagcucaaguccggcuacaaagauuggauucuguggaucagcuucgcuauaucuugcuuucuucuguguguugccuugcucggguucaucaugugggcaugccaaaagggaaacauuagguguaauaucugcauuuga

SEQ ID NO: 130102 - RNA, 1701 nt, Artificial Sequence
  derived and/or modified sequence opt3 from hemagglutinin__InfluenzaA__AEX35549
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuaacaaugaauccuucaacuggacaggggugacccagaauggaacgucuagcgcuugcaagcggggcuccaacaauucauuuuucagucgccugaacuggcucacucauuuaaaguuuaaauauccagcacugaauguuaccaugcccaacaacgaggaguucgacaaacuuuacauuuggggcgugcaccauccugggacagauaaugaccagaucagcuuguaugcccaggcuucuggaaagauuacugucuccaccaagcgaucacaacagacagugaucccaaacauagguagccgucccagaguaagggauauuccuagucggaucucuauuuacuggaccaucguuaaaccaggcgacauccugcuaauuaauuccacggggaaccucauagccccgcgcggauacuuuaagaucagaagcggcaagucgucuauuaugagguccgacgcgcccaucgauaaauguaauucagaaugcauaacuccuaacgguaguauuccaaaugacaagcccuuccagaacgugaauaaaaucacauauggggcauguccucgguacgucaagcagaacacccugaaacuugccacuggaaugcgcaaugugccagagaagcaaacacgaggcaucuuuggcgcuauugccggguucaucgaaaacggaugggaggguaugguggauggcugguauggguuuagacaccagaauagcgagggaauuggccaggcagcugaccugaaauccacccaagccgcgauagaucagaucaacgguaaguugaauaggcucauugggaagacgaacgaaaaauuccaccagaucgagaaggaguucucugaagucgaaggccggauccaggaccuggagaaauacguugaggauaccaagauugacuuauggagcuauaacgccgaacugcucguggcacuugagaaucaacauacaauagaucugacugacucagaaaugaacaaauuguuugagcguaccaagaagcagcuacgcgaaaaugcugaggauaugggaaacggcugcuucaaaaucuaccacaagugugacaaugccugcauugggaguaucagaaacggaacauaugaccaugauguauacagggacgaggcucugaauaaccgguuucagauuaaagguguggaacucaaguccggcuacaaagauuggauccuguggaucagcuucgccauaucuugcuuucuucugugugucgcauugcucggguucauuaugugggccugccagaagggaaauauccgauguaacauuugcaucuga

SEQ ID NO: 130103 - RNA, 1701 nt, Artificial Sequence
  derived and/or modified sequence opt3 from hemagglutinin__InfluenzaA__AEX35560
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgugucguugaggucacucguugcaagcagugguacucuggaguuuaacaaugaauccuucaacuggacaggggugacccagaauggaacgucuagcgccugcaagcggcgcuccaacaauucauuuuucagucgacugaacuggcucacucauuuaaaguuuaaauauccagcucugaaugucaccaugcccaacaacgagcaguucgacaaacuuuacaucuggggcgugcaccauccuggcacagauaaugaccagauuagcuuguaugcacaagccucugggcguaucacuguauccaccaagagaucacagcagacaguuauuccaaacaucggaagcaggccccgggugcgcgauauaccuaguagaauuucuaucuacuggaccauugucaagccaggugacauccugcuaaucaauuccacgggcaaccucauugcuccgaggggguacuuuaaaauacggagcggaaagucgucuaucaugcgcuccgacgcccccauuggcaaguguaauucagagugcaucacuccuaacgguaguauaccaaaugauaaacccuuccagaacgugaaucgaauuacauauggggcguguccuagauacgugaagcaaaacacccugaaacuugcaacuggaaugaggaaugucccagaaaagcagacacggggcaucuuuggcgccaucgcuggguucauugagaacggaugggaagguaugguugacggcugguauggguuucgucaccagaauagcgugggaaucggccaagccgcagaucugaaauccacccaggcugccauuaaccagauaaaugguaaguugaaccgccucaucgggaaaacgaacgagaaguuccaccagauugagaaggaguucucugaaguagaaggcagaauccaagaccuggagaaauacguggaagauaccaagaucgacuuauggagcuauaaugcggagcugcucgucgcccuugagaaccagcauacaauugaucugacugacucagaaaugaauaaauuguuugagaggaccaagaaacagcuacgggaaaacgcagaggauaugggaaauggcugcuucaagauauaccacaagugugacaacgcuugcaucgggaguauucgaaauggaacauaugaucaugacguguaccgcgacgaagcccugaacaauagauuucagaucaaagguguugagcucaaguccggcuacaaagauuggauucuguggaucagcuucgcuauaucuugcuuucuucuguguguggccuugcucggguucaucaugugggcaugccaaaagggaaacauuagguguaauaucugcauuuga

SEQ ID NO: 130104 - RNA, 1701 nt, Artificial Sequence
  derived and/or modified sequence opt3 from hemagglutinin__InfluenzaA__AEX35571
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccagggccuauucuaauuguuaccccuaugacgucccugauuacgcaucguugcggucacucguggccagcagugguacucuggaguuuaacaaugaauccuucaacuggacagggguuacccagaauggaacgucuagcgcuugcaaacgccgauccaacaauucauuuuucagucgucugaacuggcucacucauuuaaaguuuaaguauccagcacugaaugugaccaugcccaacaacgagaaauucgacaaguuguacaucuggggcguccaccauccuggcacagauaaugaccagauuuuucuuuaugcccaggcuagcgggagaaucacugugucuaccaaaaggucccaacagacaguaauuccaaacaucggaucacggccccgcguuagaaauauaccuagcaggauuaguaucuacuggaccauugugaagccaggugauauccugcuaaucaacucuacgggcaaucucauugccccgcggggguacuucaaaauacgcuccggaaagagcucgaucaugcgaucugacgcgcccauuggcaaguguaacuccgagugcaucacuccuaaugguucaauaccaaacgacaaacccuuucagaaugucaacagaauuacauauggggcauguccuagguacgugaagcagaauacccugaaacuugccacuggaaugcggaacgugccagaaaagcaaacacguggcaucuucggcgcuaucgccggguuuauugagaauggaugggaagguauggucgauggcugguauggguuccgccaccagaacagugagggaaucggccaggcagcugaccugaaaagcacccaagccgcgauuaaucagauaaacgguaaguugaacagacucaucgggaaaacgaaugagaaguuccaccagauugaaaaggaguuuuccgaaguugagggcaggauccaggaucuggaaaaauacguggaggacaccaagaucgauuuauggucuuauaacgccgagcugcucguagcacuugaaaaucaacauacaauugaccugacugauagcgagaugaacaaauuguucgaacggaccaagaaacagcuacgagagaaugcugaagacaugggaaacggcugcuuuaagauauaccacaagugugauaaugccugcaucgggucaauucgcaacggaacauaugaccaugauguguacagagacgaggcucugaauaacagguuccagaucaaaggugucgagcucaagaguggcuacaaagacuggauucuguggaucuccuuugccauaagcugcuuccuucuguguguggcauugcucggguuuaucaugugggccugccagaagggaaauauucgguguaacaucugcauuuga

SEQ ID NO: 130105 - RNA, 1701 nt, Artificial Sequence; identical to SEQ ID NO: 122646
  derived and/or modified sequence opt3 from hemagglutinin__InfluenzaA__AEX35582

SEQ ID NO: 130106 - RNA, 1701 nt, Artificial Sequence
  derived and/or modified sequence opt3 from hemagglutinin__InfluenzaA__AEX35593
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgccccugggcaaauguaacuccgagugcauuacuccuaaugguucaaucccaaacgacaagcccuuucagaaugucaaccgaauaacauauggggcauguccuagauacgugaaacagaauacccuuaagcuggccacuggaaugaggaacgugccagaaaaacaaacacggggcauuuucggcgcuaucgccggguuuaucgagaauggaugggaagguauggucgauggcugguauggguuccgucaccagaacagugagggaauuggccaggcagcugaccucaagagcacccaagccgcgaucaaucagauuaacgguaaauugaaccgccugauagggaagacgaaugagaaguuccaccagaucgaaaaagaguuuuccgaaguugagggcaggauucaggauuuagaaaaguacguggaggacaccaaaaucgaucuguggucuuauaacgccgagcuccuuguagcacuggaaaaucaacauacaaucgacuugacugauagcgagaugaacaagcuauucgaaagaaccaaaaagcagcugcgggagaaugcugaagacaugggaaacggcugcuuuaagauuuaccacaaaugugauaaugccugcauagggucaauccgaaacggaacauaugaccaugauguguaccgcgacgaggcucucaauaacagauuccagauuaagggugucgagcugaaaaguggcuacaaggacuggauccuuuggauuuccuuugccaucagcugcuuccuguuguguguggcacuccugggguuuauaaugugggccugccagaaaggaaauaucagguguaacauuugcaucuga

SEQ ID NO: 130107 - RNA, 1701 nt, Artificial Sequence; identical to SEQ ID NO: 124388
  derived and/or modified sequence opt3 from hemagglutinin__InfluenzaA__AEX35604

SEQ ID NO: 130108 - RNA, 1701 nt, Artificial Sequence
  derived and/or modified sequence opt3 from hemagglutinin__InfluenzaA__AEX35615
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacauugaggauaccaagauagacuuauggucuuauaaugccgaacugcucguggcacuugagaaccaacauacaaucgaucugacugacagcgaaaugaauaaauuguucgagaagaccaaaaagcagcuaagggaaaacgcugaggauaugggcaauggaugcuuuaagauuuaccacaaaugugacaacgccugcaucggcucaauucggaaugggacauaugaucaugacguauaccgagacgaggcucugaacaaucgcuuccagaucaagggaguggaacucaaaagugguuacaaggauuggauacuguggaucuccuuugccauuagcugcuuccuucugugugucgcauugcucggcuuuaucaugugggccugccagaaagggaacauuagauguaauaucugcauauga

SEQ ID NO: 130109 - RNA, 1701 nt, Artificial Sequence; identical to SEQ ID NO: 124450
  derived and/or modified sequence opt3 from hemagglutinin__InfluenzaA__AEX35626

SEQ ID NO: 130110 - RNA, 1701 nt, Artificial Sequence
  derived and/or modified sequence opt3 from hemagglutinin__InfluenzaA__AEX35637
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggggcuccgacaacucauuuuucaguaagcugaauuggcucacucauuuaaaauuuaaguauccagcacugaacgugaccaugcccaauaacgagaaauucgauaaacuuuacaucuggggcguccaccauccugggacagacaacgaucagauuuuuccauaugcccaggcuagcggacgcaucacugugucuaccaagcgaucccaacagacaguaauucccaauaucgguucacguccuagaguuaggaacauaccaagccggauuaguaucuacuggaccauugugaagccgggcgacaucuugcugaucaauucuacggggaaccuaauugcgccccgcggauacuucaagauaagauccggcaaaagcucgaucaugaggucugacgccccuauugguaaguguaauuccgagugcaucacuccaaacgggucaauacccaaugauaaaccuuuucagaacgucaaucggauuacauauggagcauguccacgcuacgugaagcagaacacccucaaacuggccacuggcaugcgaaaugugcccgaaaagcaaacaagaggcaucuucggggcuaucgccggauuuauugagaacgguugggaaggcauggucgacgggugguauggauucaggcaccagaauagugagggcaucggucaggcagcugaucuuaaaagcacccaagccgcgauuaaccagauaaaugggaagcugaaccgguugaucggcaagacgaacgagaaauuccaccagauugaaaaggaguuuuccgaaguugagggacguauccaggaccucgaaaaauacguggaggauaccaagaucgaccuguggucuuauaaugccgaguuacugguagcacucgaaaaccaacauacaauugaucuuacugacagcgagaugaauaaacuguucgaacgcaccaagaagcaguugagagagaacgcugaagauaugggcaaugggugcuuuaaaauauaccacaagugugacaacgccugcaucggaucaauuaggaaugguacauaugaucaugacguguaccgggacgaggcucuaaacaaucgauuccagaucaaaggcgucgagcugaagaguggguacaaagauuggauucucuggaucuccuuugccauaagcugcuuccugcuuuguguggcacuguugggauuuaucaugugggccugccagaagggcaacauucgcuguaauaucugcauuuga

SEQ ID NO: 130111 - RNA, 1701 nt, Artificial Sequence; identical to SEQ ID NO: 124450
  derived and/or modified sequence opt3 from hemagglutinin__InfluenzaA__AEX35648

SEQ ID NO: 130112 - RNA, 1701 nt, Artificial Sequence
  derived and/or modified sequence opt3 from hemagglutinin__InfluenzaA__AEX36102
augaagaccaucauugcccugagcuacauacucugccuuguguucgcucagaaacugcccggcaacaauaacuccacagcaacuuuguguuuagggcaccaugccgucccuaauggaacgaucguuaagaccauuacaaacgaccaaaucgaggugacuaaugcgaccgaacugguacagucuucaaguacaggugagauuugcgauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaguauccagcacugaacgugaccaugcccaacaaugagaaauucgauaaacuuuacauuuggggaguccaccauccuggcacagacaacgaucagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaagccaggagacauccugcuaauuaauucuacggguaaccucauagccccgaggggcuacuucaaaauccgguccggaaagagcucgauuaugcgcucugaugcgcccaucgggaaguguaauuccgaaugcauaacuccuaacggcucaauuccaaaugacaaacccuuucagaacgucaaucgaaucacauauggugcauguccuagauacgugaagcagaacacccugaaacuugccacugggaugaggaaugugccagagaagcaaacacggggaaucuucggcgcuauugccggcuuuaucgaaaacgggugggagggaauggucgacgguugguauggcuuccgucaccagaauagugaggggauuggacaggcagcugaucugaaaagcacccaagccgcgauagaccagaucaacggcaaguugaaccgccucauugguaaaacgaaugaaaaguuccaccagaucgagaaggaauuuuccgagguugaagggagaauccaggaucuggagaaauacguggaggacaccaagauugauuuauggucuuauaacgccgaacugcucguagcacuugagaaucaacauacaauagaccugacugauagcgaaaugaacaaauuguucgagaagaccaaaaagcagcuaagggaaaaugcugaggacaugggcaacggaugcuuuaagaucuaccacaaaugugauaaugccugcauuggcucaauccggaacgggacauaugaccaugauguguaccgagacgaggcucugaauaaccgcuuccagauuaagggagucgaacucaaaagugguuacaaggacuggauccuguggauauccuuugccaucagcugcuuccuucuguguguggcauugcucggcuuuauuaugugggccugccagaaagggaauaucagauguaacauuugcaucuga

SEQ ID NO: 130113 - RNA, 1701 nt, Artificial Sequence; identical to SEQ ID NO: 123931
  derived and/or modified sequence opt3 from hemagglutinin__InfluenzaA__AEX36113

SEQ ID NO: 130114 - RNA, 1701 nt, Artificial Sequence; identical to SEQ ID NO: 124450
  derived and/or modified sequence opt3 from hemagglutinin__InfluenzaA__AEX36124

SEQ ID NO: 130115 - RNA, 1701 nt, Artificial Sequence
  derived and/or modified sequence opt3 from hemagglutinin__InfluenzaA__AEX36146
augaagaccaucauugcccugagcuacauacucugccuugugcuggcucagaaauugcccggcgacgauaacuccacagcaacuuuaugucuggggcaccaugccgucccuaauggaacgaucguuaagaccauuacaaacgaccaaaucgaggugacuaaugcgaccgagcuaguacagucuucaaguacaggugaaauuugcgauagcccacaccagauccucgacggcgaaaacuguacccugauagaugcuuugcugggggacccgcagugcgauggauuccaaaauaaaaagugggacuuguuuguggagagauccaaagccuauucuaacuguuaccccuaugaugucccugacuacgcaucgcucaggucacugguggccagcaguggcacucuggaguucaauaacgaauccuuuaauuggacagguguuacccagaacgggacgucuagcgcuugcauccggcgcuccaauaacucauucuuuagucgacucaauugguuaacucaucugaaguucaaguauccagcacuuaacgugaccaugcccaauaacgagcaguuugauaaauuguacauuuggggaguccaccauccuggcacagacaacgaucagaucuuccuguaugcccaagcuagcggccguauuacugugucuaccaagagaucccagcagacaguaaucccaaauauagggucaaggccccggguucgcaacauuccuagcagaaucaguauuuacuggaccaucgugaaaccaggagacauccuacucauuaauucuacggguaaccugauagccccgaggggcuacuuuaagauccgguccgggaaaagcucgauuaugcgcucugacgcgcccaucggaaaguguaauuccgaaugcauaacuccuaacggcucaauuccaaaugauaagcccuuccagaacgucaaucgaaucacauauggugcauguccuagauacgugaaacaaaacacccuuaagcuggccacugggaugaggaaugugccagagaaacagacacggggaaucuuuggcgcuauugccggcuucaucgaaaacgggugggagggaauggucgacgguugguauggcuuucgucaccagaauagugaggggcgcggacaagcagcugaucuuaagagcacccaggccgcgauugaccagauaaacggcaaacucaauagacugaucgguaagacgaacgaaaaauuccaccagauugagaaggaguucuccgaaguugaagggaggauccaagauuuagagaaguacguggaggacaccaaaaucgaucuguggucuuauaacgccgaacuccuuguagcacuggagaaucagcauacaauugacuugacugauagcgaaaugaacaagcuauuugagaaaaccaagaaacagcugcgggaaaaugcugaggacaugggcaacggaugcuucaagauauaccacaagugugauaaugccugcaucggcucaauucgaaacgggacauaugaccaugacguguaccgcgaugaggcucucaauaacagauuucagaucaaaggagucgaacugaagagugguuacaaagacuggauucuuuggaucuccuucgccauaagcugcuuucuguuguguguggcacuccugggcuucaucaugugggccugccaaaaggggaauauuagguguaacaucugcauuuga

SEQ ID NO: 130116 - RNA, 1701 nt, Artificial Sequence
  derived and/or modified sequence opt3 from hemagglutinin__InfluenzaA__AEX36168
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauugggcugggguuacacagaacggaaccucuagcgcaugcaagcggggcuccgacaauucauuuuucagucgccugaacuggcucacgcauuuaaaguuuaaauauccagcccugaaugugacuaugcccaacaaugaggaguucgauaaacuuuacauuuggggcguccaccauccugggaccgacaacgaucagaucuuuuuguaugcucaggccagcggacgaauuacagugucuacuaagcguucccaacagaccguaaucccaaacauagguucaagacccaggguucggaauauuccuagccgcaucaguauuuacuggacaaucgugaagccaggcgacauccugcuaauuaacucuaccgggaaucucauagcgccgagaggauacuucaaaaucagguccggcaagagcucgauuaugcggucugacgcacccaucgguaaguguaacuccgaaugcauaacgccuaaugggucaauuccaaacgauaaacccuuucagaaugucaaccgcaucacuuauggagccuguccucgauacgugaagcagaauacacugaaacuugcuaccggcaugagaaacgugccagagaagcaaacuaggggcaucuucggggccauugcaggauuuaucgaaaaugguugggagggcauggucgacgggugguauggauuccggcaccagaacagugagggcauuggucaggcugccgaucugaaaagcacacaagcggccauagaccagaucaaugggaaguugaacaaacucauuggcaagaccaaugaaaaguuccaccagaucgagaaagaauuuuccgagguugaaggacguauccaggaucuggagaaguacguggaggacacgaaaauugauuuauggucuuauaacgcagaacugcucguagcucuugagaaccaacauaccauagaccugacagauagcgaaaugaauaaguuguucgagaaaacuaagaagcagcuacgcgaaaacgccgaggacaugggcaaugggugcuuuaaaaucuaccacaagugugauaacgcuugcauuggaucaaucagaaaugguaccuaugaccaugacguguacagggaugaggcccugaacaaucgguucaaaauuaagggcgucgaacucaaaaguggguacaaggacuggauccuguggauauccuuugcaaucagcugcuuccuucuguguguggccuugcucggauuuauuaugugggcuugccagaagggcaacaucaaauguaauauuugcaucuga

SEQ ID NO: 130117 - RNA, 1701 nt, Artificial Sequence; identical to SEQ ID NO: 124450
  derived and/or modified sequence opt3 from hemagglutinin__InfluenzaA__AEX36179

SEQ ID NO: 130118 - RNA, 1701 nt, Artificial Sequence; identical to SEQ ID NO: 129999
  derived and/or modified sequence opt3 from hemagglutinin__InfluenzaA__AEX36190

SEQ ID NO: 130119 - RNA, 1701 nt, Artificial Sequence; identical to SEQ ID NO: 129994
  derived and/or modified sequence opt3 from hemagglutinin__InfluenzaA__AEX36201

SEQ ID NO: 130120 - RNA, 1701 nt, Artificial Sequence
  derived and/or modified sequence opt3 from hemagglutinin__InfluenzaA__AEX36212
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuucuuuaugcccaggcuagcggacgaauuacugugucuaccaaaaucucccaacagacaguaauaccaaacauugguucacgucccagaguuaggaauaucccuagccggauuaguaucuacuggaccaucgugaagccaggcgauauuuugcugauaaacucuacggggaaucuaaucgccccgcgcggauacuucaaaauuagauccggcaagagcucgaucaugaggucugacgcgcccauagguaaguguaacuccgaaugcauuacuccuaaugggucaaucccaaacgacaaacccuuucagaaugucaaccggaucacauauggagcauguccucgcuacgugaagcagaauacccucaaacuggccacuggcaugcgaaacgugccagagaagcaaacaagaggcauuuucggggcuaucgccggauuuauugaaaaugguugggagggcauggucgaugggugguauggauucaggcaccagaacagugagggcauaggucaggcagcugaccuuaaaagcacccaagccgcgaucgaucagauuaaugggaagcugaaccgguugaucggcaaaacgaacgaaaaguuccaccagaucgagaaggaauuuuccgagguugaaggacguauucaggaccucgagaaauacguggaggauaccaagauagaccuguggucuuauaaugccgaauuacugguagcacucgagaaccaacauacaaucgaucuuacugacagcgaaaugaauaaacuguucgagaagaccaaaaagcaguugcgcgaaaacgcugaggauaugggcaaugggugcuuuaagauuuaccacaaaugugacaacgccugcaucggaucaauuagaaaugguacauaugaucaugacguguacagggacgaggcucuaaacaaucgguuccagaucaagggcgucgaacugaaaaguggguacaaggauuggauacucuggaucuccuuugccauuagcugcuuccugcuuuguguggcacuguugggauuuaucaugugggccugccagaaaggcaacauucgauguaauaucugcauauga

SEQ ID NO: 130121 - RNA, 1701 nt, Artificial Sequence; identical to SEQ ID NO: 129994
  derived and/or modified sequence opt3 from hemagglutinin__InfluenzaA__AEX36223

SEQ ID NO: 130122 - RNA, 1701 nt, Artificial Sequence
  derived and/or modified sequence opt3 from hemagglutinin__InfluenzaA__AEX36234
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggggcuccgacaacucauuuuucaguaagcugaauuggcucacucauuuaaaauuuaaguauccagcacugaacgugaccaugcccaauaacgagaaauucgauaaguuguacaucuggggcguccaccauccugggacagacaacgaucagauuuuucuuuaugcccaggcuagcggacgcaucacugugucuaccaaacgaucccaacagacaguaauuccaaauaucgguucacgucccagaguuaggaacauaccuagccggauuaguaucuacuggaccauugugaagccaggcgacauccugcuaaucaauucuacggggaaccucauugccccgcgcggauacuucaagauaagauccggcaaaagcucgaucaugaggucugacgcgcccauugguaaguguaauuccgagugcaucacuccuaacgggucaauaccaaaugauaaacccuuucagaacgucaaucggauuacauauggagcauguccucgcuacgugaagcagaacacccugaaacuugccacuggcaugcgaaaugugccagaaaagcaaacaagaggcaucuucggggcuaucgccggauuuauugagaacgguugggaaggcauggucgacgggugguauggauucaggcaccagaauagugagggcaucggucaggcagcugaucugaaaagcacccaagccgcgauuaaccagauaaaugggaaguugaaccggcucaucggcaagacgaacgagaaauuccaccagauugaaaaggaguuuuccgaaguugagggacguauccaggaccuggaaaaauacguggaggauaccaagaucgacuuauggucuuauaaugccgagcugcucguagcacuugaaaaccaacauacaauugaucugacugacagcgagaugaauaaauuguucgaacgcaccaagaagcagcuaagagagaacgcugaagauaugggcaaugggugccugaaaauauaccacaagugugacaacgccugcaucggaucaauuaggaaugguacauaugaucaugacguguaccgggacgaggcucucaacaaucgauuucagaucaaaggcgucgagcugaagaguggguacaaagauuggauucuuuggaucuccuucgccauaagcugcuuucuguuguguguggcacuccugggauucaucaugugggccugccagaagggcaacauucgcuguaauaucugcauuuga

SEQ ID NO: 130123 - RNA, 1701 nt, Artificial Sequence
  derived and/or modified sequence opt3 from hemagglutinin__InfluenzaA__AEX36245
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaaacuuauuccaauuguuaccccuaugacgucccugauuacgccucuuugaggucgcucguggcaucaagcgguacacuggaguuuaacaaugaaaguuucaacuggaccgggguuacgcagaauggaacuuccucugccugcaagcggggcagcaacaauuccuuuuucucacgccugaacuggcucacccauaguaaguuuaaauauccagcuuuaaaugugacaaugcccaacaacgaggaguucgacaagcuguacauuuggggcguccaccauccugggacugauaaugaccagaucuuucuuuaugcacaggccagcggacgaauuaccgugucuacaaaacguucccaacagaccguaaucccaaacauagguucaagacccaggguucggaauauuccuagccgcaucaguauuuacuggacgaucgugaagccaggcgauaucuugcugauuaacucuacugggaaucuaauagcuccgagaggauacuucaaaaucagguccggcaagagcucgauuaugcggucugacgcccccaucgguaaguguaacuccgaaugcauaacaccuaaugggucaauuccaaacgacaaacccuuucagaaugucaaccgcaucaccuauggagcguguccucgauacgugaagcagaauacucucaaacuggcaacaggcaugagaaacgugccagagaagcaaaccaggggcaucuucggggccauugcuggauuuaucgaaaaugguugggagggcauggucgaugggugguauggauuccggcaccagaacagugagggcauuggucaggccgcagaccuuaaaagcacgcaagcugccauagaucagaucaaugggaagcugaaccguuugauuggcaaaaccaacgaaaaguuccaccagaucgagaaggaauuuuccgagguugaaggacgcauccaggaccucgagaaauacguggaggauacaaagauugaccuguggucuuauaaugcggaauuacugguagcccucgagaaccaacauacuauagaucuuaccgacagcgaaaugaauaaacuguucgagaagacuaaaaagcaguugagagaaaacgcagaggauaugggcaaugggugcuuuaagaucuaccacaaaugugacaacgcuugcauuggaucaaucaggaaugguacauaugaucaugacguguaccgggacgaggcccuaaacaaucgauuccagauuaagggcgucgaacugaaaaguggguacaaggauuggauccucuggauauccuuugcuaucagcugcuuccugcuuuguguggcccuguugggauuuauuaugugggcaugccagaaaggcaacauccgcuguaauauuugcaucuga

SEQ ID NO: 130124 - RNA, 1701 nt, Artificial Sequence
  derived and/or modified sequence opt3 from hemagglutinin__InfluenzaA__AEX36256
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggaaguccaacaauucauuuuucagucgccugaacuggcucacccauuuaaaguuuaaauauccagcucugaaugugacaaugcccaacaacgagcaguucgacaaacuuuacauuuggggaguccaccauccuggcacugauaaugaccagaucuuuuuguaugcacaagccagcggccgaauuaccgugucuacaaaacguucccagcagaccguaaucccaaacauagggucaagacccaggguucggaauauuccuagccgcaucaguauuuacuggacgaucgugaagccaggagauauccugcuaauuaacucuacugguaaucucauagcuccgagaggcuacuucaaaaucagguccgggaaaagcucgauuaugcggucugacgcccccaucggaaaguguaacuccgaaugcauaacaccuaauggcucaauuccaaacgacaaacccuuucagaaugucaaccgcaucaccuauggugcguguccucgauacgugaagcaaaauacucugaaacuugcaacagggaugagaaacgugccagagaagcagaccaggggaaucuucggcgccauugcuggcuuuaucgaaaaugggugggagggaauggucgaugguugguauggcuuccggcaccagaacagugaggggcguggacaagccgcagaccugaaaagcacgcaggcugccauugaucagauaaauggcaaguugaaccgccucaucgguaaaaccaacgaaaaguuccaccagauugagaaggaauuuuccgagguugaagggagaauccaagaccuggagaaauacguggaggauacaaagaucgacuuauggucuuauaaugcggaacugcucguagcccuugagaaccagcauacuauugaucugaccgacagcgaaaugaauaaauuguucgagaagacaaagaagcagcuaagggaaaacgcagaggauaugggcaauggaugcuuuaagauauaccacaaaugugacaacgcuugcaucggcucaauucggaaugggacuuaugaucaugacguguaccgagacgaggcccugaacaaucgcuuccagaucaagggagucgaacucaaaagugguuacaaggauuggauucuguggaucuccuuugcuauaagcugcuuccuucuguguguggccuugcucggcuuuaucaugugggcaugccaaaaagggaacauuagauguaauaucugcauuuga

SEQ ID NO: 130125 - RNA, 1701 nt, Artificial Sequence; identical to SEQ ID NO: 129994
  derived and/or modified sequence opt3 from hemagglutinin__InfluenzaA__AEX36267

SEQ ID NO: 130126 - RNA, 1701 nt, Artificial Sequence
  derived and/or modified sequence opt3 from hemagglutinin__InfluenzaA__AEX36289
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuucuuuaugcccaggcuagcggacgaauuacugugucuaccaaaaucucccaacagacaguaauaccaaacauugguucacgucccagaguuaggaauaucccuagccggauuaguaucuacuggaccaucgugaagccaggcgauauuuugcugauaaacucuacggggaaucuaaucgccccgcgcggauacuucaaaauuagauccggcaagagcucgaucaugaggucugacgcgcccauagguaaguguaacuccgaaugcauuacuccuaaugggucaaucccaaacgacaaacccuuucagaaugucaaccggaucacauauggagcauguccucgcuacgugaagcagaauacccucaaacuggccacuggcaugcgaaacgugccagagaagcaaacaagaggcauuuucggggcuaucgccggauuuauugaaaaugguugggagggcauggucgaugggugguauggauacaggcaccagaacagugagggcauaggucaggcagcugaccuuaaaagcacccaagccgcgaucgaucagauuaaugggaagcugaaccgguugaucggcaaaacgaacgaaaaguuccaccagaucgagaaggaguucuccgaaguugaaggacguauucaggaccucgagaaauauguggaggauaccaagauagaccuguggucuuacaaugccgaauuacugguagcacucgagaaccaacauacaaucgaucuuacugacagcgaaaugaauaaacuguuugagaagaccaaaaagcaguugcgcgaaaacgcugaggauaugggcaaugggugcuucaagauuuaucacaaaugugacaacgccugcaucggaucaauuagaaaugguacauacgaucaugacguguacagggacgaggcucuaaacaaucgguuucagaucaagggcgucgaacugaaacucggguauaaggauuggauacuguggaucaguuucgccauuuccugcuuucuucuguguguggcauugcucggauucaucaugugggccugccagaaaggcaacauucgauguaauaucugcauauga

SEQ ID NO: 130127 - RNA, 1701 nt, Artificial Sequence
  derived and/or modified sequence opt3 from hemagglutinin__InfluenzaA__AEX36300
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaguaacgaauccuucaauuggacagggguuacccagaacggaacgucuagcgcuugcaagcggggcuccaauaacucauuuuucaguaagcugaauuggcucacucauagcaaauuuaaguauccagcauuaaacgugaccaugcccaauaacgaggaguucgacaaacuguacauuuggggcguccaccauccugggacagauaacgaccagaucuuucuuuaugcccaggcuucuggacgcauuacuguguccaccaagcgaucacaacagacaguaaucccaaauauagguagccgucccagaguuaggaacauuccuagucggaucucuauuuacuggaccaucgugaaaccaggcgauaucuugcugauuaauuccacggggaaccuaauagccccgcgcggauacuucaagaucagaagcggcaagucgucuauuaugagguccgacgcgcccaucgguaaauguaauucagaaugcauaacuccuaacgggaguauuccaaaugacaagcccuuucagaacgucaaucggaucacauauggagcauguccucgcuacgugaaacagaacacccucaagcuggccacuggcaugcgaaaugugccagagaaacaaacaagaggcaucuucggggcuauugccggauuuaucgaaaacgguugggagggcauggucgaugggugguauggauucaggcaccagaauagcgagggcauuggucaggcagcugaccuuaaguccacccaagccgcgauagaucagaucaacgggaaacugaaucgguugauuggcaagacgaacgaaaaguuccaccagaucgagaaagaauuuucugagguugaaggacguauccaggaccucgagaaguacguggaggauaccaaaauugaccuguggagcuauaacgccgaauuacugguagcacucgagaaucaacauacaauagaucuuacugacucagaaaugaacaagcuguucgagaaaaccaagaagcaguugcgcgaaaaugcugaggauaugggcaacgggugcuuuaaaaucuaccacaagugugacaaugccugcauuggaaguaucagaaacgguacauaugaucaugacguguacagggacgaggcucuaaauaaccgguuccagauuaaaggcgucgaacugaaguccggguacaaagauuggauccucuggaucagcuuugccauaucuugcuuccugcuuuguguggcacuguugggauuuauuaugugggccugccagaagggcaauauccgauguaacauuugcaucuga

SEQ ID NO: 130128 - RNA, 1701 nt, Artificial Sequence
  derived and/or modified sequence opt3 from hemagglutinin__InfluenzaA__AEX36311
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauugggcugggguuacacagaacggaaccucuagcgcaugcaagcggggcuccaauaacucauuuuucagucgccugaauuggcucacgcauuuaaaguuuaaauauccagcccugaacgugacuaugcccaauaacgaggaguucgacaaacuuuacauuuggggcguccaccauccugggaccgauaacgaccagaucuuuuuguaugcucaggccagcggacgaauuacagugucuacuaagcguucccaacagaccguaaucccaaauauagguucaagacccaggguucggaacauuccuagccgcaucaguauuuacuggacaaucgugaagccaggcgauauccugcuaauuaauucuaccgggaaccucauagcgccgagaggauacuucaaaaucagguccggcaagagcucgauuaugcggucugacgcacccaucgguaaguguaauuccgaaugcauaacgccuaacgggucaauuccaaaugacaaacccuuucagaacgucaaucgcaucacuuauggagccuguccucgauacgugaagcagaacacacugaaacuugcuaccggcaugagaaaugugccagagaagcaaacuaggggcaucuucggggccauugcaggauuuaucgaaaacgguugggagggcauggucgaugggugguauggauuccggcaccagaauagugagggcauuggucaggcugccgaccugaaaagcacacaagcggccauagaucagaucaacgggaaguugaaucgucucauuggcaaaaccaacgaaaaguuccaccagaucgagaaggaauuuuccgagguugaaggacgcauccaggaccuggagaaauacguggaggauacgaagauugacuuauggucuuauaacgcagaacugcucguagcucuugagaaucaacauaccauagaucugacagacagcgaaaugaacaaauuguucgagaagacuaaaaagcagcuaagagaaaaugccgaggauaugggcaacgggugcuuuaagaucuaccacaaaugugacaaugcuugcauuggaucaaucaggaacgguaccuaugaucaugacguguaccgggacgaggcccugaauaaccgauuccagauuaagggcgucgaacucaaaaguggguacaaggauuggauccuguggauauccuuugcaaucagcugcuuccuucuguguguggccuugcucggauuuauuaugugggcuugccagaaaggcaauauccgcuguaacauuugcaucuga

SEQ ID NO: 130129 - RNA, 1701 nt, Artificial Sequence
  derived and/or modified sequence opt3 from hemagglutinin__InfluenzaA__AEX36322
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuuccauaugcccaggcuagcggacgaauuacugugucuaccaaaaucucccaacagacaguaauacccaacauugguucacguccuagaguuaggaauaucccaagccggauuaguaucuacuggaccaucgugaagccgggcgauauucuuuugauaaacucuacggggaaucugaucgcgccccgcggauacuucaaaauuagauccggcaagagcucgaucaugaggucugacgccccuauagguaaguguaacuccgaaugcauuacuccaaaugggucaauccccaacgacaaaccuuuucagaaugucaaccggaucacauauggagcauguccacgcuacgugaagcagaauacccuaaaacucgccacuggcaugcgaaacgugcccgagaagcaaacaagaggcauuuucggggcuaucgccggauuuauugaaaaugguugggagggcauggucgaugggugguauggauucaggcaccagaacagugagggcauaggucaggcagcugaccugaaaagcacccaagccgcgaucgaucagauuaaugggaaacuuaaccggcugaucggcaagacgaacgaaaaguuccaccagaucgagaaggaauuuuccgagguugaaggacguauucaggacuuggagaaauacguggaggauaccaagauagaccucuggucuuauaaugccgaacuguuaguagcacuggagaaccaacauacaaucgaucucacugacagcgaaaugaauaaacuuuucgagaagaccaaaaagcagcugcgcgaaaacgcugaggauaugggcaaugggugcuuuaagauuuaccacaaaugugacaacgccugcaucggaucaauuagaaaugguacauaugaucaugacguguacagggacgaggcuuugaacaaucgguuccagaucaagggcgucgaacuaaaaaguggguacaaggauuggauacuguggaucuccuuugccauuagcugcuuccuccuguguaucgcacuucugggauuuauuaugugggccugccagaaaggcaacauccgauguaauauaugcauuuga

SEQ ID NO: 130130 - RNA, 1701 nt, Artificial Sequence
  derived and/or modified sequence opt3 from hemagglutinin__InfluenzaA__AEX36333
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuucuuuaugcccaggcuagcggacgaauuacugugucuaccaaacguucccaacagacaguaaucccaaacauagguucaagacccaggguucggaauauuccuagccgcaucaguauuuacuggaccaucgugaagccaggcgauaucuugcugauuaacucuacggggaaucuaauagccccgagaggauacuucaaaaucagguccggcaagagcucgauuaugcggucugacgcgcccaucgguaaguguaacuccgaaugcauaacuccuaaugggucaauuccaaacgacaaacccuuucagaaugucaaccgcaucacauauggagcauguccucgauacgugaagcagaauacccucaaacuggccacuggcaugagaaacgugccagagaagcaaacaaggggcaucuucggggcuauugccggauuuaucgaaaaugguugggagggcauggucgaugggugguauggauuccggcaccagaacagugagggcauuggucaggcagcugaccuuaaaagcacccaagccgcgauagaucagaucaaugggaagcugaaccguuugauuggcaaaacgaacgaaaaguuccaccagaucgagaaggaauuuuccgagguugaaggacgcauccaggaccucgagaaauacguggaggauaccaagauugaccuguggucuuauaaugccgaauuacugguagcacucgagaaccaacauacaauagaucuuacugacagcgaaaugaauaaacuguucgagaagaccaaaaagcaguugagagaaaacgcugaggauaugggcaaugggugcuuuaagaucuaccacaaaugugacaacgccugcauuggaucaaucaggaaugguacauaugaucaugacgcuuaccgggacgaggcccuaaacaaucgauuccagauuaagggcguggaacugaaaaguggguacaaggauuggauccucuggauauccuuugcaaucagcugcuuccugcuuugugucgcccuguugggauuuauuaugugggcuugccagaaaggcaacauccgcuguaauauuugcaucuga

SEQ ID NO: 130131 - RNA, 1701 nt, Artificial Sequence
  derived and/or modified sequence opt3 from hemagglutinin__InfluenzaA__AEX36344
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaacgccuauucuaauuguuaccccuaugacgucccugauuacgcaucguugaggucacucguggccagcagugguacucuggaguuuaacaaugaauccuucaacugggcugggguuacacagaauggaaccucuagcgcaugcaaacggggcuccaacaauucauuuuucagucgccugaacuggcucacgcauuuaaaguuuaaguauccagcccugaaugugacuaugcccaacaacgaggaguucgacaaacuuuacauuuggggcguccaccauccugggaccgauaaugaccagaucuuuuuguaugcucaggccagcggacgaauuacagugucuacuaagcguucccaacagaccguaaucccaaacauagguucaagacccaggguucggaauauuccuagccgcaucaguauuuacuggacaaucgugaaaccaggcgauauccugcuaauuaacucuaccgggaaucucauagcgccgagaggauacuucaagaucagguccggcaaaagcucgauuaugcggucugacgcacccaucgguaaguguaacuccgaaugcauaacgccuaaugggucaauuccaaacgacaagcccuuucagaaugucaaccgcaucacuuauggagccuguccucgauacgugaaacagaauacacugaagcuggcuaccggcaugagaaacgugccagagaaacaaacuaggggcaucuucggggccauugcaggauuuaucgaaaaugguugggagggcauggucgaugggugguauggauuccggcaccagaacagugagggcauuggucaggcugccgaccuuaagagcacacaagcggccauagaucagaucaaugggaaauugaaccgucucauuggcaagaccaacgaaaaauuccaccagaucgagaaggaauuuuccgagguugaaggacgcauccaggaccuggagaaguacguggaggauacgaaaauugacuuauggucuuauaaugcagaacugcucguagcucuugagaaccaacauaccauagaucugacagacagcgaaaugaauaaguuguucgagaaaacuaagaaacagcuaagagaaaacgccgaggauaugggcaaugggugcuuuaagaucuaccacaagugugacaacgcuugcauugagucaaucaggaauggaaccuaugaucaugacguguaccgggacgaagcccugaacaaucgauuccagauuaaaggugucgagcucaagaguggcuacaaagauuggauccuguggauauccuuugcaaucagcugcuuccuucuguguguggccuugcucggguuuauuaugugggcuugccagaagggaaacauccgcuguaauauuugcaucuga

SEQ ID NO: 130132 - RNA, 1701 nt, Artificial Sequence
  derived and/or modified sequence opt3 from hemagglutinin__InfluenzaA__AEX36366
augaagaccaucauugcccugagcuacauacucugccuuguguucgcucagaaacuguccggcaacgacaauucuacagcaacuuuguguuuagggcaccaugccguccccaacggaacgaucguuaagaccauuacaaaugaucaaaucgaggugacuaacgcgaccgaacugguacagucaaguagcacaggugagauuugcgacuccccucaccagauccuagauggcgaaaauuguacccucauagacgcucugcuuggggauccacagugcgacggauuucaaaacaaaaagugggaucuguucguggagagaucuaaagccuauucgaauuguuacccguaugacguccccgauuacgcaucauugaggagccucguggccaguuccggcacucuggaauuuaacaaugagucuuucaacuggacagguguuacccagaaugggacgagcuccgcuugcauccggcgcucaaacaauagcuuuuucagccgacugaacuggcucacucauuuaaaguuuaaguauccugcacugaaugugaccaugccaaacaacgagaaauucgacaaacuuuacauuuggggaguccaccaucccggcacagauaaugaccagaucuuuuuguaugcccaggcuucuggccguauuacuguguccaccaagagaucacaacagacaguaaucccuaacauagggagcaggccacggguucgcaauauucccaguagaaucucuauuuacuggaccaucgugaagccuggagauauccugcuaauuaacuccacggguaaucucauagccccaaggggcuacuucaaaauccggagcgggaagucgucuauuaugcgcuccgacgcgccgaucggaaaguguaacucagaaugcauaacucccaauggcaguauuccuaacgacaaaccauuucagaaugucaaccgaaucacauauggugcaugucccagauacgugaagcagaauacccugaaacuugccacugggaugaggaacgugccugagaagcaaacacggggaaucuucggcgcuauugccggcuuuaucgaaaaugggugggagggaauggucgaugguugguauggcuuccgucaccagaacagcgaggggauuggacaggcagcugaccugaaauccacccaagccgcgauagaucagaucaauggcaaguugaaccgccucauugguaaaacgaacgaaaaguuccaccagaucgagaaggaauuuucugagguugaagggagaauccaggaccuggagaaauacguggaggauaccaagauugacuuauggagcuauaaugccgaacugcucguagcacuugagaaccaacauacaauagaucugacugacucagaaaugaauaaauuguucgagaagaccaaaaagcagcuaagggaaaacgcugaggauaugggcaauggaugcuuuaagaucuaccacaaaugugacaacgccugcauuggcaguauccggaaugggacauaugaucaugacguguaccgagacgaggcucugaacaaucgcuuccagauuaagggagucgaacucaaauccgguuacaaggauuggauccuguggauaaguuuugccaucucuugcuuccuucuguguguggcauugcucggcuuuauuaugugggccugccagaaagggaacaucagauguaauauuugcaucuga

SEQ ID NO: 130133 - RNA, 1701 nt, Artificial Sequence; identical to SEQ ID NO: 123944
  derived and/or modified sequence opt3 from hemagglutinin__InfluenzaA__AEX36377

SEQ ID NO: 130134 - RNA, 1701 nt, Artificial Sequence
  derived and/or modified sequence opt3 from hemagglutinin__InfluenzaA__AEX36388
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaaugauggaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgaggucgaagggagaauccaggaccuggagaaauacguugaggauaccaagauugacuuauggucuuauaaugccgaacugcucguggcacuugagaaccaacauacaauagaucugacugacagcgaaaugaauaaauuguucgagaagaccaaaaagcagcuaagggaaaacgcugaggauaugggcaauggaugcuuuaagaucuaccacaaaugugacaacgccugcauuggcucaauccggaaugggacauaugaucaugacguauaccgagacgaggcucugaacaaucgcuuccagauuaagggaguggaacucaaaagugguuacaaggauuggauccuguggauauccuuugccaucagcugcuuccuucugugugucgcauugcucggcuuuauuaugugggccugccagaaagggaacaucagauguaauauuugcaucuga

SEQ ID NO: 130135 - RNA, 1701 nt, Artificial Sequence
  derived and/or modified sequence opt3 from hemagglutinin__InfluenzaA__AEX36399
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaacugaggugaccaacgcgacagaacugguacagucuucaaguaccggugagaucugcgacagcccacaccagauucuagauggcgaaaauuguacucucaucgacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacacuggaauuuaacaaugaguccuucaacuggaccgguguuacgcagaaugggacuucuagcgcuugcauacggcgcuccaacaauucauuuuucagucgacugaacuggcucacccauuuaaaguuuaaguauccagcacugaaugugacaaugcccaacaacgagaaauucgacaaguuguacaucuggggaguccaccauccuggcacugauaaugaccagauuuuucuuuaugcccaggcuagcggccguaucaccgugucuacaaaaagaucccaacagaccguaauuccaaacaucgggucaaggccccggguucgcaauauaccuagcagaauuaguaucuacuggacgauugugaagccaggagauauccugcuaaucaacucuacugguaaucucauugccccgaggggcuacuucaaaauacgguccgggaaaagcucgaucaugcgcucugacgcgcccauuggaaaguguaacuccgaaugcaucacaccuaauggcucaauaccaaacgacaaacccuuucagaaugucaaccgaauuaccuauggugcauguccuagauacgugaagcagaauacucugaaacuugccacagggaugaggaacgugccagagaagcaaacccggggaaucuucggcgcuaucgccggcuuuauugaaaaugggugggagggaauggucgaugguugguauggcuuccgucaccagaacagugaggggaucggacaggcagcugaccugaaaagcacgcaagccgcgauugaucagauaaauggcaaguugaaccgccucaucgguaaaaccaacgaaaaguuccaccagauugagaaggaauuuuccgagguugaagggagaauccaggaccuggagaaauacguggaggauacaaagaucgacuuauggucuuauaaugccgaacugcucguagcacuugagaaccaacauacuauugaucugaccgacagcgaaaugaauaaauuguucgagaagacaaagaagcagcuaagggaaaacgcugaggauaugggcaauggaugcuuuaagauauaccacaaaugugacaacgccugcaucggcucaauucggaaugggacuuaugaucaugacguguaccgagacgaggcucugaacaaucgcuuccagaucaagggagucgaacucaaaagugguuacaaggauuggauucuguggaucuccuuugccauaagcugcuuccuucuguguguggcauugcucggcuuuaucaugugggccugccagaaagggaacauuagauguaauaucugcauuuga

SEQ ID NO: 130136 - RNA, 1701 nt, Artificial Sequence
  derived and/or modified sequence opt3 from hemagglutinin__InfluenzaA__AEX36410
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaaguuuaaguauccagcacugaacgugaccaugcccaacaaugagaaauucgacaaacuuuacauuuggggaguccaccauccuggcacagauaacgaccagaucuuuuuguaugcccaggcuaguggccguauuacugugagcaccaagagaucucaacagacaguaaucccaaauauaggguccaggccccggguucgcaacauuccuucaagaaucagcauuuacuggaccaucgugaagccaggagauauccugcuaauuaauaguacggguaaccucauagccccgaggggcuacuucaaaauccggucugggaaguccagcauuaugcgcucggacgcgcccaucggaaaguguaauucugaaugcauaacuccuaacggcuccauuccaaaugacaaacccuuucagaacgucaaucgaaucacauauggugcauguccuagauacgugaagcagaacacccugaaacuugccacugggaugaggaaugugccagagaagcaaacacggggaaucuucggcgcuauugccggcuuuaucgaaaacgggugggagggaauggucgaugguugguauggcuuccgucaccaaaauucagaggggauuggacaggcagcugaccugaaaaguacccaggccgcgauagaucagaucaacggcaaguugaaccgccucauugguaaaacgaaugaaaaguuccaccagaucgagaaggaauuuagcgagguugaagggagaauccaggaccuggagaaauacguggaggauaccaagauugacuuaugguccuauaacgccgaacugcucguagcacuugagaaucaacauacaauagaucugacugacucugaaaugaacaaauuguucgagaagaccaaaaagcagcuaagggaaaaugcugaggauaugggcaacggaugcuuuaagaucuaccacaaaugugacaaugccugcauuggcagcauccggaacgggacauaugaucaugacguguaccgagacgaggcucugaauaaccgcuuccagauuaagggagucgaacucaaaucagguuacaaggauuggauccuguggauaaguuuugccaucuccugcuuccuucuguguguggcauugcucggcuuuauuaugugggccugccagaaagggaauaucagauguaacauuugcaucuga

SEQ ID NO: 130137 - RNA, 1701 nt, Artificial Sequence; identical to SEQ ID NO: 124450
  derived and/or modified sequence opt3 from hemagglutinin__InfluenzaA__AEX36421

SEQ ID NO: 130138 - RNA, 1701 nt, Artificial Sequence
  derived and/or modified sequence opt3 from hemagglutinin__InfluenzaA__AEX36432
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccaggugcuagauggcgaaaauuguacccucaucgacgcucugcuuggggauccgcagugcgacggauuucaaaacaaaaagugggaucuguucgucgagagauccaaagccuauucuaauuguuaccccuaugacgugccugauuacgcaucguugaggucacucguugccagcaguggcacucuggaauuuaacaaugaguccuucaacuggacaggugugacccagaaugggacgucuagcgcuugcauacggcgcuccaacaauucauuuuucagucgacugaacuggcucacucauuuaaaguuuaaguauccagcacugaaugucaccaugcccaacaacgagcaguucgacaaacuuuacaucuggggagugcaccauccuggcacagauaaugaccagaucuuuuuguaugcccaagcuagcggccguauuacuguaucuaccaagagaucccagcagacaguuauuccaaacaucgggucaaggccccgggugcgcaauauaccuagcagaauuaguaucuacuggaccauugucaaaccaggagauauccugcuaaucaacucuacggguaaucucauugccccgaggggcuacuucaagauacgguccgggaaaagcucgaucaugcgcucugacgcgcccauuggaaaguguaacuccgaaugcaucacuccuaauggcucaauaccaaacgacaagcccuuucagaaugugaaccgaauuacauauggugcauguccuagauacgugaaacaaaauacccugaagcuggccacugggaugaggaacgucccagagaaacagacacggggaaucuucggcgcuaucgccggcuuuauugaaaaugggugggagggaaugguugaugguugguauggcuuccgucaccagaacagugaggggcgcggacaagcagcugaccuuaagagcacccaggccgcgaucgaucagauuaauggcaaauugaacagacucauagguaagacgaacgaaaaauuccaccagaucgagaaggaauuuuccgagguggaagggaggauucaagaccuggagaaguacguagaggauaccaaaaucgacuuauggucuuauaaugccgaacugcucguggcacuugagaaccagcauacaaucgaucugacugacagcgaaaugaauaaguuguucgagaaaaccaagaaacagcuacgggaaaacgcugaggauaugggcaauggaugcuuuaagauuuaccacaagugugacaacgccugcauaggcucaauccgaaaugggacauaugaucaugacgucuaccgcgacgaggcucugaacaauagauuccagauuaaaggaguggaacucaagagugguuacaaagauuggauccuguggauuuccuuugccaucagcugcuuccuucuguguguugcauugcucggcuuuauaaugugggccugccaaaaggggaacaucagguguaauauuugcaucuga

SEQ ID NO: 130139 - RNA, 1701 nt, Artificial Sequence
  derived and/or modified sequence opt3 from hemagglutinin__InfluenzaA__AEX36443
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaguauccagcacugaacgugaccaugcccaacaaugaggaguucgauaaacuuuacauuuggggaguccaccauccuggcacagacaacgaucagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaaaccaggagacauccugcuaauuaauucuacggguaaccucauagccccgaggggcuacuucaagauccgguccgggaaaagcucgauuaugcgcucugaugcgcccaucggaaaguguaauuccgaaugcauaacuccuaacggcucaauuccaaaugacaagcccuuucagaacgucaaucgaaucacauauggugcauguccuagauacgugaaacagaacacccugaagcuggccacugggaugaggaaugugccagaaaaacaaacacggggaaucuucggcgcuauugccggcuuuaucgagaacgggugggagggaauggucgacgguugguauggcuuccgucaccagaauagugaagggauuggacaggcagcugaucuuaagagcacccaagccgcgauagaccagaucaacggcaaauugaaccgccucauugguaagacgaaugagaaauuccaccagaucgaaaaggaguuuuccgaaguugaggggagaauccaggaucuggagaaguacguggaagacaccaaaauugauuuauggucuuauaacgccgagcugcucguagcacuugaaaaucaacauacaauagaccugacugauagcgagaugaacaaguuguucgagaaaaccaagaaacagcuaagggaaaaugcugaggacaugggcaacggaugcuuuaagaucuaccacaagugugauaaugccugcauuggcucaauccggaacgggacauaugaccaugauguguaccgagacgaagcucugaauaaccgcuuccagauuaaaggagucgagcucaagagugguuacaaagacuggauccuguggauauccuuugccaucagcugcuuccuucuguguguggcauugcucggcuuuauuaugugggccugccagaaggggaauaucagauguaacauuugcaucuga

SEQ ID NO: 130140 - RNA, 1701 nt, Artificial Sequence
  derived and/or modified sequence opt3 from hemagglutinin__InfluenzaA__AEX36454
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaguauccagcacugaacgugaccaugcccaacaaugaggaguucgauaaacuuuacauuuggggaguccaccauccuggcacagacaacgaucagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaaaccaggagacauccugcuaauuaauucuacggguaaccucauagccccgaggggcuacuucaagauccgguccgggaaaagcucgauuaugcgcucugaugcgcccaucggaaaguguaauuccgaaugcauaacuccuaacggcucaauuccaaaugacaagcccuuucagaacgucaaucgaaucacauauggugcauguccuagauacgugaaacagaacacccugaagcuggccacugggaugaggaaugugccagaaaaacaaacacggggaaucuucggcgcuauugccggcuuuaucgagaacgggugggagggaauggucgacgguugguauggcuuccgucaccagaauagugaagggauuggacaggcagcugaucuuaagagcacccaagccgcgauagaccagaucaacggcaaauugaaccgccucauugguaagacgaaugagaaauuccaccagaucgaaaaggaguuuuccgaaguugaggggagaauccaggaucuggagaaguacguggaagacaccaaaauugauuuauggucuuauaacgccgagcugcucguagcacuugaaaaucaacauacaauagaccugacugauagcgagaugaacaaguuguucgagaaaaccaagaaacagcuaagggaaaaugcugaggacaugggcaacggaugcuuuaagaucuaccacaagugugauaaugccugcauuggcucaauccggaacgggacauaugaccaugauguguaccgagacgaagcucugaauaaccgcuuccagauuaaaggagucgagcucaagagugguuacaaagacuggauccuguggauauccuuugccaucagcugcuuccuucugugugugguuuugcucggcuuuauuaugugggcaugccagaaggggaauaucagauguaacauuugcaucuga

SEQ ID NO: 130141 - RNA, 1701 nt, Artificial Sequence; identical to SEQ ID NO: 123745
  derived and/or modified sequence opt3 from hemagglutinin__InfluenzaA__AEX36465

SEQ ID NO: 130142 - RNA, 1701 nt, Artificial Sequence
  derived and/or modified sequence opt3 from hemagglutinin__InfluenzaA__AEX36476
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauuggacagggguuacccagaacggaacgucuagcgcuugcaagcggggcuccaauaacucauuuuucagucgccugaauuggcucacucauagcaaguuuaaauauccagcauuaaacgugaccaugcccaauaacgaggaguucgacaagcuguacauuuggggcguccaccauccugggacagauaacgaccagaucuuuccauaugcccaggcuucuggacgaauuacuguguccaccaaacguucacaacagacaguaauccccaauauagguagcagaccuaggauucggaacaucccaagucgcauuucuaucuacuggaccaucguuaagccgggcgauauucuuuugauaaauuccacggggaaccugaucgcccccagaggauacuucaaaauuaggagcggcaagucgucuaucaugcgguccgacgcgccuauagguaagugugacucagaaugcauuacuccaaaugggaguauccccaacgauaaaccuuuucagaaugugaaccgcaucacauauggagcauguccacgauacgucaagcagaauacccuaaaacucgccacuggcaugagaaacgugcccgagaagcaaacaaggggcauuuucggggcuaucgccggauuuauugaaaaugguugggagggcaugguggacgggugguauggauuccggcaccagaacagcgagggcauaggucaggcagcugaucugaaauccacccaagccgcgaucgaccagauuaaugggaaacuuaaccgucugaucggcaagacgaaugaaaaguuccaccagaucgagaaggaauuuucugaggucgaaggacgcauucaggauuuggagaaauacguugaggacaccaagauagaucucuggagcuauaacgccgaacuguuaguggcacuggagaaccaacauacaaucgaccucacugauucagaaaugaauaaacuuuucgagaagaccaaaaagcagcugagagaaaacgcugaggacaugggcaaugggugcuuuaagauuuaccacaaaugugauaacgccugcaucggaaguauuaggaaugguacauaugaccaugacguauaccgggaugaggcuuugaacaaucgauuccagaucaagggcguggaacuaaaauccggguacaaggacuggauacuguggaucagcuuugccauuucuugcuuccuccugugugucgcacuucugggauuuaucaugugggccugccagaaaggcaacauucgcuguaauaucugcauauga

SEQ ID NO: 130143 - RNA, 1701 nt, Artificial Sequence
  derived and/or modified sequence opt3 from hemagglutinin__InfluenzaA__AEX36487
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacagguggcaucugcgacagcccacaccagauacuagauggggagaacuguacccucaucgacgcucugcuuggagauccgcagugcgacggcuuucaaaauaaaaagugggaucuguucguggaaagauccaaagccuauucuaacuguuaccccuaugacgucccugauuacgcaucguugaggucacucguggccagcagugguacucuggaguuuaauaacgaauccuucaauuggacagggguuacccagaacggaacgucuagcgcuugcaagcggggcuccaauaacucauuuuucagucgccugaauuggcucacucauagcaaguuuaaauauccagcauuaaacgugaccaugcccaauaacgaggaguucgacaagcuguacauuuggggcguccuucacccugggacagauaacgaccagaucuuuuuguaugcccaggcuucuggacgaauuacuguguccaccaaacguucacaacagacaguaaucccaaauauagguagcagacccaggguucggaacauuccuagucgcaucucuauuuacuggaccaucgugaagccaggcgauauccugcuaauuaauuccacggggaaccucauagccccgagaggauacuucaaaaucaggagcggcaagucgucuauuaugcgguccgacgcgcccaucgguaaguguaauucagaaugcauaacuccuaacgggaguauuccaaaugacaaacccuuucagaacgucaaucgcaucacauauggagcauguccucgauacgugaagcagaacacccugaaacuugccacuggcaugagaaaugugccagagaagcaaacaaggggcaucuucggggcuauugccggauuuaucgaaaacgguugggagggcauggucgaugggugguauggauuccggcaucagaauagcgagggcauuggucaggcagcugaccugaaauccacccaagccgcgauagaucagaucaacgggaaguugaaucgucucauuggcaaaacgaacgaaaaguuccaccagaucgagaaggaauuuucugagguugaaggacgcauccaggaccuggagaaauacguggaggauaccaagauugacuuauggagcuauaacgccgaacugcucguagcacuugagaaucaacacacaauagaucugacugacucagaaaugaacaaauuguucgagaagaccaaaaagcagcuaagagaaaaugcugaggauaugggcaacgggugcuuuaagaucuaccauaaaugugacaaugccugcauuggaaguaucaggaacgguacauaugaucacgacguguaccgggacgaggcucugaauaaccgauuccagauuaagggcgucgaacucaaauccggguacaaggauuggauccuguggaucagcuuugccauaucuugcuuccuucuguguguggcauugcucggauuuauuaugugggccugccagaaaggcaauauccgcuguaacauuugcaucuga

SEQ ID NO: 130144 - RNA, 1701 nt, Artificial Sequence; identical to SEQ ID NO: 129994
  derived and/or modified sequence opt3 from hemagglutinin__InfluenzaA__AEX36498

SEQ ID NO: 130145 - RNA, 1701 nt, Artificial Sequence
  derived and/or modified sequence opt3 from hemagglutinin__InfluenzaA__AEX36509
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccaccauccugggacagauaaugaccagaucuuuccauaugcccaggcuagcggacgaauuacugugucuaccaaacguucccaacagacaguaauccccaacauagguucaagaccuaggguucggaauauuccaagccgcaucaguauuuacuggaccaucgugaagccgggcgauauccuuuugauuaacucuacggggaaucugauagcccccagaggauacuucaaaaucagguccggcaagagcucgauuaugcggucugacgcgccuaucgguaaguguaacuccgaaugcauaacuccaaaugggucaauucccaacgacaaaccuuuucagaaugucaaccgcaucacauauggagcauguccacgauacgugaagcagaauacccuaaaacucgccacuggcaugagaaacgugcccgagaagcaaacaaggggcaucuucggggcuauugccggauuuaucgaaaaugguugggagggcauggucgaugggugguauggauuccggcaccagaacagugagggcauuggucaggcagcugaccugaaaagcacccaagccgcgauagaucagaucaaugggaaacuuaaccgucugauuggcaagacgaacgaaaaguuccaccagaucgagaaggaauuuuccgagguugaaggacgcauccaggacuuggagaaauacguggaggauaccaagauugaccucuggucuuauaaugccgaacuguuaguagcacuggagaaccaacauacaauagaucucacugacagcgaaaugaauaaacuuuucgagaagaccaaaaagcagcugagagaaaacgcugaggauaugggcaaugggugcuuuaagaucuaccacaaaugugacaacgccugcauuggaucaaucaggaaugguacauaugaucaugacguguaccgggacgaggcuuugaacaaucgauuccagauuaagggcgucgaacuaaaaaguggguacaaggauuggauccuguggauauccuuugccaucagcugcuuccuccuguguguggcacuucugggauuuauuaugugggccugccagaaaggcaacauccgcuguaauauuugcaucuga

SEQ ID NO: 130146 - RNA, 1701 nt, Artificial Sequence
  derived and/or modified sequence opt3 from hemagglutinin__InfluenzaA__AEX36520
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaucggcucaauucgaaaugggacauaugaucauaacguguaccgcgacgaggcucugaauaacagauuccagaucaaaggagucgaacucaagagugguuacaaagacuggauucuguggaucuccuuugccauaagcugcuuccuucuguguguggcauugcucggcuuuaucaugugggccugccaaaaggggaauauuagguguaacaucugcauuuga

SEQ ID NO: 130147 - RNA, 1701 nt, Artificial Sequence
  derived and/or modified sequence opt3 from hemagglutinin__InfluenzaA__AEX36531
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggauaaguacguggaggacaccaaaaucgauuuauggucuuauaaugccgagcugcucguagcacuugaaaaccagcauacaauugaccugacugauagcgagaugaauaaguuguucgagaaaaccaagaaacagcuacgggaaaacgcugaagacaugggcaauggaugcuuuaagauauaccacaagugugauaacgccugcaucggcucaauucgaaaugggacauaugaccaugacguguaccgcgaugaggcucugaacaauagauuccagaucaaaggagucgagcucaagagugguuacaaagacuggauucuguggaucuccuuugccauaagcugcuuccuucuguguguggcauugcucggcuuuaucaugugggccugccaaaaggggaacauuagguguaauaucugcauuuga

SEQ ID NO: 130148 - RNA, 1701 nt, Artificial Sequence
  derived and/or modified sequence opt3 from hemagglutinin__InfluenzaA__AEX36542
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaaguuuaaguauccagcacugaacgugaccaugcccaacaaugagcaguucgacaaacuuuacauuuggggaguccaccauccuggcacagauaacgaccagaucuuuuuguaugcccaagcuaguggccguauuacugugagcaccaagagaucucagcagacaguaaucccaaauauaggguccaggccccggguucgcaacauuccuucaagaaucagcauuuacuggaccaucgugaaaccaggagauauccugcuaauuaauaguacggguaaccucauagccccgaggggcuacuucaagauccggucugggaaauccagcauuaugcgcucggacgcgcccaucggaaaguguaauucugaaugcauaacuccuaacggcuccauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccaaaauucagaggggcgcggacaggcagcugaccugaagaguacccaggccgcgauugaucagauaaacggcaaauugaacagacucaucgguaagacgaaugaaaaauuccaccagauugagaaggaauuuagcgagguugaagggaggauccaagaccuggagaaguacguggaggauaccaaaaucgacuuaugguccuauaacgccgaacugcucguagcacuugagaaucagcauacaauugaucugacugacucugaaaugaacaaguuguucgagaaaaccaagaaacagcuacgggaaaaugcugaggauaugggcaacggaugcuuuaagauauaccacaagugugacaaugccugcaucggcagcauucgaaacgggacauaugaucaugacguguaccgcgacgaggcucugaauaacagauuccagaucaaaggagucgaacucaagucagguuacaaagauuggauucuguggaucaguuuugccauauccugcuuccuucuguguguggcauugcucggcuuuaucaugugggccugccaaaaggggaauauuagguguaacaucugcauuuga

SEQ ID NO: 130149 - RNA, 1701 nt, Artificial Sequence; identical to SEQ ID NO: 130148
  derived and/or modified sequence opt3 from hemagglutinin__InfluenzaA__AEX36553

SEQ ID NO: 130150 - RNA, 1701 nt, Artificial Sequence; identical to SEQ ID NO: 130148
  derived and/or modified sequence opt3 from hemagglutinin__InfluenzaA__AEX36564

SEQ ID NO: 130151 - RNA, 1701 nt, Artificial Sequence
  derived and/or modified sequence opt3 from hemagglutinin__InfluenzaA__AEX36575
augaagaccaucauugcccugagcuacauacucugccuuguguucgcucagaaacugcccggcaacggaaauuccacagcaacuuuguguuuagggcaccaugccgucccuaacgguacgaucguuaagaccauuacaaaugaccaaaucgaggugacuaacgcgaccgaacugguacagucuucaaguacaggcgagauuugcgauagcccacaccagauccuagacggggaaaauuguacccucauagaugcucugcuuggagacccgcagugcgauggcuuucaaaacaaaaagugggaccuguucguggagagauccaaagccuauucuaauuguuaccccuaugaugucccugacuacgcaucguugaggucacucguggccagcagugguacucuggaauuuaacaaugaguccuucaacuggacagggguuacccagaauggaacgucuagcgcuugcauccggcgcuccaacaauucauuuuucagucgacugaacuggcucacucauuuaaaguuuaaguauccagcacugaaugugaccaugcccaacaacgagcaguucgauaaacuuuacauuuggggcguccaccauccuggcacagacaaugaucagaucuuuuuguaugcccaagcuagcgggcguauuacugugucuaccaagagaucccagcagacaguaaucccaaacauaggaucaaggccccggguucgcaauauuccuagcagaaucaguauuuacuggaccaucgugaaaccaggugacauccugcuaauuaacucuacgggcaaucucauagccccgaggggguacuucaagauccgguccggaaaaagcucgauuaugcgcucugaugcgcccaucggcaaguguaacuccgaaugcauaacuccuaaugguucaauuccaaacgacaagcccuuucagaaugucaaccgaaucacauauggggcauguccuagauacgugaaacaaaauacccugaagcuggccacuggaaugaggaacgugccagagaaacagacacggggcaucuucggcgcuauugccggguuuaucgaaaauggaugggaggguauggucgacggcugguauggguuccgucaccagaacagugagggacgcggccaagcagcugaucuuaagagcacccaggccgcgauugaccagauaaaugguaaauugaacagacucaucgggaagacgaacgaaaaauuccaccagauugagaaggaauuuuccgagguugaaggcaggauccaagaucuggagaaguacguggaggacaccaaaaucgauauuuggucuuauaaugccgaauuacugguagcacucgagaaccagcauacaauagaccuuacugauagcgaaaugaauaagcuguucgagaaaaccaagaaacaguugcgggaaaacgcugaggacaugggaaauggcugcuuuaagaucuaccacaagugugauaacgccugcauugggucaauccgaaauggaacauaugaccaugauguguaccgcgacgaggcucuaaacaauagauuccagauuaaaggugucgaacugaagaguggcuacaaagacuggauccucuggauauccuuugccaucagcugcuuccugcuuuguguggcacuguugggguuuauuaugugggccugccaaaagggaaacaucagguguaauauuugcaucuga

SEQ ID NO: 130152 - RNA, 1701 nt, Artificial Sequence
  derived and/or modified sequence opt3 from hemagglutinin__InfluenzaA__AEX36586
augaagaccaucauugcccugagcuacauacucugccuuguguucgcucagaaacugcccggcaacgacaauaacacagcaacuuuguguuuagggcaccaugccgucccuaauggaacgaucguuaagaccauuacaaacgaucaaaucgaggugacuaaugcgaccgaacugguacaguccucuucaacaggugagauuugcgacaguccacaccagauccuagauggcgaaaacuguacccucauagacgcucugcuuggggauccgcagugcgacggauuucaaaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaaguuuaaguauccagcacugaacgugaccaugcccaacaaugagcaguucgacaaacuuuacauuuggggaguccaccauccuggcacagauaacgaccagaucuuuuuguaugcccaagcuaguggccguauuacugugagcaccaagagaucucagcagacaguaaucccaaauauaggguccaggccccggguucgcaacauuccuucaagaaucagcauuuacuggaccaucgugaaaccaggagauauccugcuaauuaauaguacggguaaccucauagccccgaggggcuacuucaagauccggucugggaaauccagcauuaugcgcucggacgcgcccaucggaaaguguaauucugaaugcauaacuccuaacggcuccauuccaaaugacaagcccuuucagaacgucaaucgaaucacauauggugcauguccuagauacgugaaacaaaacacccugaaacuugccacugggaugaggaaugugccagagaagcagacacggggaaucuucggcgcuauugccggcuuuaucgaaaacgggugggagggaauggucgaugguugguauggcuuccgucaccaaaauucagaggggcgcggacaggcagcugaccugaagaguacccaggccgcgauugaucagauaaacggcaaauugaacagacucaucgguaagacgaaugaaaaauuccaccagauugagaaggaauuuagcgagguugaagggaggauccaagaccuggagaaguacguggaggauaccaaaaucgacuuaugguccuauaacgccgaacugcucguagcacuugagaaucagcauacaauugaucugacugacucugaaaugaacaaguuguucgagaaaaccaagaaacagcuacgggaaaaugcugaggauaugggcaacggaugcuuuaagauauaccacaagugugacaaugccugcaucggcagcauucgaaacgggacauaugaucaugacguguaccgcgacgaggcucugaauaacagauuccagaucaaaggagucgaacucaagucagguuacaaagauuggauucuguggaucaguuuugccauauccugcuuccuucuguguguggcauugcucggcuuuaucaugugggccugccaaaaggggaauauuagguguaacaucugcauuuga

SEQ ID NO: 130153 - RNA, 1701 nt, Artificial Sequence
  derived and/or modified sequence opt3 from hemagglutinin__InfluenzaA__AEX36597
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacagucuucaaguaccggugagauuugcgacagcccacaccagauccuagauggcgaaaauuguacacucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacccuggaauuuaacaaugaguccuucaacuggacugguguuacacagaaugggaccucuagcgcuugcauccggcgcuccaacaauucauuuuucagucgacugaacuggcucacgcauuuaaaguuuaaguauccagcacugaaugugacuaugcccaacaacgagcaguucgacaaacuuuacauuuggggaguccaccauccuggcaccgauaaugaccagaucuuuuuguaugcccaagcuagcggccguauuacagugucuacuaagagaucccagcagaccguaaucccaaacauagggucaaggccccggguucgcaauauuccuagcagaaucaguauuuacuggacaaucgugaaaccaggagauauccugcuaauuaacucuaccgguaaucucauagccccgaggggcuacuucaagauccgguccgggaaaagcucgauuaugcgcucugacgcgcccaucggaaaguguaacuccgaaugcauaacgccuaauggcucaauuccaaacgacaagcccuuucagaaugucaaccgaaucacuuauggugcauguccuagauacgugaaacaaaauacacugaagcuggccaccgggaugaggaacgugccagagaaacagacucggggaaucuucggcgcuauugccggcuuuaucgaaaaugggugggagggaauggucgaugguugguauggcuuccgucaccagaacagugaggggcgcggacaagcagcugaccuuaagagcacacaggccgcgauugaucagauaaauggcaaauugaacagacucaucgguaagaccaacgaaaaauuccaccagauugagaaggaauuuuccgagguugaagggaggauccaagaccuggagaaguacguggaggauacgaaaguagacuuauggucuuauaaugccgaacugcucguggcacuugagaaccagcauaccaucgaucugacagacagcgaaaugaauaaguuguucgagaaaacuaagaaacagcuacgggaaaacgcugaggauaugggcaauggaugcuuuaagauuuaccacaagugugacaacgccugcauaggcucaauccgaaaugggaccuaugaucaugacgucuaccgcgacgaggcucugaacaauagauuccagauuaaaggaguggaacucaagagugguuacaaagauuggauccuguggauuuccuuugccaucagcugcuuccuucuguguguugcauugcucggcuuuauaaugugggccugccaaaaggggaacaucagguguaauauuugcaucuga

SEQ ID NO: 130154 - RNA, 1701 nt, Artificial Sequence
  derived and/or modified sequence opt3 from hemagglutinin__InfluenzaA__AEX36608
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaaaacuucaauuggacagggguuacccagaacggaacguccucugcuugcaagcggcgcagcaauaacuccuuuuucucacgacugaauuggcucacucauuuaaaguuuaaauauccagcacugaacgugaccaugcccaacaaugagaaguucgacaaacuuuacaucuggggcguccaccauccuggcacagauaacgaccagauuuuucuuuaugcccaggcuagugggcguaucacugugagcaccaagagaucucaacagacaguaauuccaaauaucggauccaggccccggguucgcaacauaccuucaagaauuagcaucuacuggaccauugugaaaccaggugauauccugcuaaucaauaguacgggcaaccucauugccccgaggggguacuucaagauacggucuggaaaguccagcaucaugcgcucggacgcgcccauuggcaaauguaauucugagugcaucacuccuaacgguuccauaccaaaugacaagcccuuucagaacgucaaucgaauuacauauggggcauguccuagauacgugaaacagaacacccugaaguuggccacuggaaugaggaaugugccagaaaaacaaacacggggcaucuucggcgcuaucgccggguuuauugagaacggaugggaagguauggucgauggcugguauggguuccgucaccaaaauucagagggaaucggccaggcagcugaccugaagaguacccaggccgcgauuaaccagauaaacgguaaauugaaucgccucaucgggaagacgaacgagaaguuccaccagauugaaaaagaguuuagcgaaguugagggcagaauccaggaucuggaaaaguacguggaggacaccaaaaucgauuuaugguccuauaaugccgagcugcucguagcacuugaaaaccaacauacaauugaccugacugauucugagaugaauaaguuguucgaaaggaccaaaaagcagcuacgggagaacgcugaagacaugggaaauggcugcuuuaagauauaccacaaaugugauaacgccugcaucgggagcauucgaaauggaacauaugaccaugauguguaccgcgacgaggcucugaacaagagauuccagaucaaaggugucgagcucaagucaggcuacaaagacuggauucuguggaucaguuuugccauauccugcuuccuucuguguguggcauugcucggguuuaucaugugggccugccagaagggaaauauuagguguaacaucugcauuuga

SEQ ID NO: 130155 - RNA, 1701 nt, Artificial Sequence; identical to SEQ ID NO: 129977
  derived and/or modified sequence opt3 from hemagglutinin__InfluenzaA__AEX36619

SEQ ID NO: 130156 - RNA, 1701 nt, Artificial Sequence
  derived and/or modified sequence opt3 from hemagglutinin__InfluenzaA__AEX63617
auggaggccaagcuguucgugcucuuuugcgcuuucaccgcacuuaaagccgacacaaucugugucggcuaccacgcgaacaauagcacugauacgguugacaccauucuggaaaagaacgugacaguaacucauuccgugaauuuguuagagaacucucacaaugggaaacugugcucacuaaacggaaagauaccccuccagcuggguaauuguaacgucgcuggcuggauccuugggaauccuaaaugcgaucuguugcucaccgccaacaguuggagcuauauuaucgaaacauccaauucuaagaacggagcauguuacccaggcgaguuugccgacuaugaagaacugaaggagcaacugucgaccgugaguagcuucgaaagauuugagauuuucccgaaagcuacuucauggcccaaucaugauacaaccagggguacgacuguugcaugcucccacucuggggccaacagcuuuuaccggaaucucuuauggaucgugaagaaaggaaacuccuauccuaagcugucaaaaaguuacaccaacaauaagggcaaggaaguccuugugauauggggcguacaucacccacccacagacagcguucagcagacuuuguaucagaacaaucacaccuacgugucugucggguccucaaaauacuauaagcgcuucacaccugagaucguggcucgaccaaaagugcgugagcaagccggaagaaugaacuacuauuggacccugcuagaucagggugacacgauuacuuuugaagcgacaggcaaucucaucgcacccuggcaugccuucgcucugaagaaagggagcaguucuggaauuaugagguccgaugcccagguccacaacuguaccacuaagugccagacaccucauggcgcacuuaaagguaaucugccauuucaaaacguucacccggugaccaucggggagugucccaaguacguaaagagcacgcaguugcggauggcuaccggacuccgcaauauaccuucgauucagucuagaggccuguucggcgccaucgcgggguuuauugaaggagguuggacaggcaugguggacgggugguauggauaccaccauaggaacgagcagggcuccgguuaugccgcagaucaaaaaucaacucagaucgcuaucgacgggauuaguaauaaggucaacagcgugauagagaaaaugaauauccaguucaccuccguuggcaaggaguucaacucuuuagagaaacggauggaaaaucugaacaagaagguggaugacggauuucucgacgucuggacauacaacgccgagcuucugauuuugcuagaaaaugagcgcacucuggauuuccacgaccucaacgugaaaaaucuguacgaaaagguaaaaagccaacuucgaaacaaugcuaaggagaucggcaacgggugcuuugaguucuaucauaaaugugauaaugaaugcauggagucaguuaagaacggaaccuacaauuaucugaaguacagugaagaguccaaauugaacagagaagagauagacggugugaagcucgagagcaugggcauucaccagauccuggccaucuauucuacagucgcaucaaguuuagugcugcuagucagccucggggccauuuccuuuuggaugugcucuaauggaucgcugcaguguagggugugcaucuga

SEQ ID NO: 130157 - RNA, 1698 nt, Artificial Sequence; identical to SEQ ID NO: 125294
  derived and/or modified sequence opt3 from hemagglutinin__InfluenzaA__AEX92873

SEQ ID NO: 130158 - RNA, 1701 nt, Artificial Sequence; identical to SEQ ID NO: 125849
  derived and/or modified sequence opt3 from hemagglutinin__InfluenzaA__AEY69088

SEQ ID NO: 130159 - RNA, 1701 nt, Artificial Sequence; identical to SEQ ID NO: 125446
  derived and/or modified sequence opt3 from hemagglutinin__InfluenzaA__AEY69098

SEQ ID NO: 130160 - RNA, 1701 nt, Artificial Sequence; identical to SEQ ID NO: 125427
  derived and/or modified sequence opt3 from hemagglutinin__InfluenzaA__AEY69120

SEQ ID NO: 130161 - RNA, 1701 nt, Artificial Sequence; identical to SEQ ID NO: 125629
  derived and/or modified sequence opt3 from hemagglutinin__InfluenzaA__AEY69131

SEQ ID NO: 130162 - RNA, 1701 nt, Artificial Sequence; identical to SEQ ID NO: 129004
  derived and/or modified sequence opt3 from hemagglutinin__InfluenzaA__AEY69153

SEQ ID NO: 130163 - RNA, 1701 nt, Artificial Sequence; identical to SEQ ID NO: 125629
  derived and/or modified sequence opt3 from hemagglutinin__InfluenzaA__AEY69164

SEQ ID NO: 130164 - RNA, 1701 nt, Artificial Sequence; identical to SEQ ID NO: 125629
  derived and/or modified sequence opt3 from hemagglutinin__InfluenzaA__AEY69175

SEQ ID NO: 130165 - RNA, 1701 nt, Artificial Sequence; identical to SEQ ID NO: 125629
  derived and/or modified sequence opt3 from hemagglutinin__InfluenzaA__AEY69186

SEQ ID NO: 130166 - RNA, 1701 nt, Artificial Sequence; identical to SEQ ID NO: 125629
  derived and/or modified sequence opt3 from hemagglutinin__InfluenzaA__AEY69197

SEQ ID NO: 130167 - RNA, 1701 nt, Artificial Sequence; identical to SEQ ID NO: 125629
  derived and/or modified sequence opt3 from hemagglutinin__InfluenzaA__AEY69208

SEQ ID NO: 130168 - RNA, 1701 nt, Artificial Sequence; identical to SEQ ID NO: 125629
  derived and/or modified sequence opt3 from hemagglutinin__InfluenzaA__AEY69219

SEQ ID NO: 130169 - RNA, 1701 nt, Artificial Sequence; identical to SEQ ID NO: 125427
  derived and/or modified sequence opt3 from hemagglutinin__InfluenzaA__AEY69258

SEQ ID NO: 130170 - RNA, 1701 nt, Artificial Sequence; identical to SEQ ID NO: 125629
  derived and/or modified sequence opt3 from hemagglutinin__InfluenzaA__AEY69269

SEQ ID NO: 130171 - RNA, 1701 nt, Artificial Sequence; identical to SEQ ID NO: 125427
  derived and/or modified sequence opt3 from hemagglutinin__InfluenzaA__AEY69291

SEQ ID NO: 130172 - RNA, 1701 nt, Artificial Sequence; identical to SEQ ID NO: 125427
  derived and/or modified sequence opt3 from hemagglutinin__InfluenzaA__AEY69302

SEQ ID NO: 130173 - RNA, 1701 nt, Artificial Sequence; identical to SEQ ID NO: 125427
  derived and/or modified sequence opt3 from hemagglutinin__InfluenzaA__AEY69313

SEQ ID NO: 130174 - RNA, 1701 nt, Artificial Sequence; identical to SEQ ID NO: 125427
  derived and/or modified sequence opt3 from hemagglutinin__InfluenzaA__AEY69785

SEQ ID NO: 130175 - RNA, 1701 nt, Artificial Sequence
  derived and/or modified sequence opt3 from hemagglutinin__InfluenzaA__AEY69807
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggacugcaaaacaagaaaugggauuuguuuguggaaagauccaaggccuauucuaauuguuaccccuaugacgucccugauuacgcaucgcucaggucacugguggccagcaguggcacucuggaguucaacaaugaauccuuuaacuggacagguguuacccagaaugggacgucuagcgcuugcauccggcgcuccaagaacucauucuuuagucgacucaauugguuaacucaucugaacuucaaauauccagcacuuaaugugaccaugcccaacaacgagcaguuugacaaguuguacauuuggggaguccaccauccuggcacagauaaagaccagaucuuccuguaugcccaagcuagcggccguauuacugugucuaccaagagaucccagcagacagccaucccaaauauagggucaaggccccggguacgcaacauuccuagcagaaucaguauuuacuggaccaucguuaaaccaggagauauccuacucauuaauucuacggguaaccugauagcgccgaggggcuacuuuaaacuucgguccggaaagagcucgaucaugcgcucugacgcacccauugggaaauguaauuccgagugcaucacuccuaacggcucaauaccaaaugacaagcccuuccagaacgugaaucgaauuacauauggugccuguccuagauacgucaaacaaaacacccugaaguuggcuacugggaugaggaaugugccagaaaaacagacacggggaaucuuuggcgccaucgcaggcuucauugagaacgggugggaaggaaugguggaugguugguauggcuuucgucaccagaauagugaggggcgcggacaagcugccgaccucaagagcacccaggcggccaucgaucagauuaacggcaaacugaauagauuaauagguaagacgaacgagaaguuccaccagaucgaaaaagaguucuccgaagucgaggggaggauucaagaccuggaaaaguacguugaggauaccaaaaucgaccucuggucuuauaacgcagagcuucugguggcuuuggaaaaucagcauacaaucgaucuaacugacagcgagaugaacaagcuguuugaaaagaccaagaagcagcuccgggagaaugccgaagauaugggcaacggaugcuucaaaauuuaccacaagugugacaaugcuugcauaggcucaauccgaaacgggacauaugaucaugacguauaccgcgacgaggcccugaauaacagauuucagauuaaaggaguggagcuuaagagugguuacaaagauuggauccuguggauuuccuucgcaaucagcugcuuuuugcucugugucgcccuguuaggcuucauaaugugggcuugccaaaaggggaauaucagguguaacauuugcaucuga

SEQ ID NO: 130176 - RNA, 1701 nt, Artificial Sequence; identical to SEQ ID NO: 125629
  derived and/or modified sequence opt3 from hemagglutinin__InfluenzaA__AEY69818

SEQ ID NO: 130177 - RNA, 1701 nt, Artificial Sequence; identical to SEQ ID NO: 125629
  derived and/or modified sequence opt3 from hemagglutinin__InfluenzaA__AEY69829

SEQ ID NO: 130178 - RNA, 1701 nt, Artificial Sequence; identical to SEQ ID NO: 125629
  derived and/or modified sequence opt3 from hemagglutinin__InfluenzaA__AEY69840

SEQ ID NO: 130179 - RNA, 1701 nt, Artificial Sequence; identical to SEQ ID NO: 125629
  derived and/or modified sequence opt3 from hemagglutinin__InfluenzaA__AEY69851

SEQ ID NO: 130180 - RNA, 1701 nt, Artificial Sequence; identical to SEQ ID NO: 125629
  derived and/or modified sequence opt3 from hemagglutinin__InfluenzaA__AEY69873

SEQ ID NO: 130181 - RNA, 1701 nt, Artificial Sequence; identical to SEQ ID NO: 125629
  derived and/or modified sequence opt3 from hemagglutinin__InfluenzaA__AEY69884

SEQ ID NO: 130182 - RNA, 1701 nt, Artificial Sequence; identical to SEQ ID NO: 125629
  derived and/or modified sequence opt3 from hemagglutinin__InfluenzaA__AEY69895

SEQ ID NO: 130183 - RNA, 1701 nt, Artificial Sequence; identical to SEQ ID NO: 129004
  derived and/or modified sequence opt3 from hemagglutinin__InfluenzaA__AEY69906

SEQ ID NO: 130184 - RNA, 1701 nt, Artificial Sequence; identical to SEQ ID NO: 125629
  derived and/or modified sequence opt3 from hemagglutinin__InfluenzaA__AEY69917

SEQ ID NO: 130185 - RNA, 1701 nt, Artificial Sequence
  derived and/or modified sequence opt3 from hemagglutinin__InfluenzaA__AEY69939
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcaaaaauuguacccuaaucgacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauucggcgcuccaagaacucauuuuucagucgacugaauuggcugacucaucucaacuuuaaauauccagcauuaaaugugaccaugcccaacaacgagcaguucgacaagcuguacaucuggggaguccaccauccuggcacagauaaagaccagauuuuucuuuaugcccaagcuagcggccguaucacugugucuaccaagagaucccagcagacagccauaccaaauauugggucaaggccccggguacgcaacaucccuagcagaauuaguaucuacuggaccaucguuaaaccaggagauauuuugcugauaaauucuacggguaaccuaaucgcgccgaggggcuacuucaagauucgguccggaaagagcucgaucaugcgcucugacgcacccauagggaaauguaauuccggcugcauuacuccuaacgguucaaucccaaaugacaagcccuuucagaacgugaaucgaaucacauauggggucuguccuagauacgugaaacaaaacacccucaagcuggccacuggaaugaggaaugugccagagaaacagacacggggcauuuucggcgcuaucgccggguuuauugaaaacggaugggaggguauggucgauggcugguauggguuccgucaccagaauagugaaggacgcggccaagcagcugaccuuaagagcacccaggccgcgauagaucagaucaacgguaaacugaauagauugauugggaagacgaacgagaaguuccaccagaucgagaaagaauuuuccgagguugaaggcaggauccaagaccucgagaaguacguggaagauaccaaaauugaccuguggucuuauaacgccgaguuacugguagcacucgagaaucagcauacaauagaucuuacugacagcgaaaugaacaagcuguucgagaaaaccaagaagcaguugcgggaaaaugcugaggauaugggaaacggcugcuuuaaaaucuaccacaagugugacaaugccugcauugggucaauccgaaacggaacauaugaucaugacguguaccgcgacgaagcucuaaauaacagauuccagauuaaaggugucgagcugaagaguggcuacaaagauugguuucucuggaucuccuucgccauaagcugcuuucugcuuuguguggcacuguugggguucaucaugugggccugccaaaagggaaauauuagguguaacaucugcauuuga

SEQ ID NO: 130186 - RNA, 1701 nt, Artificial Sequence; identical to SEQ ID NO: 130185
  derived and/or modified sequence opt3 from hemagglutinin__InfluenzaA__AEY69950

SEQ ID NO: 130187 - RNA, 1701 nt, Artificial Sequence; identical to SEQ ID NO: 130185
  derived and/or modified sequence opt3 from hemagglutinin__InfluenzaA__AEY69961

SEQ ID NO: 130188 - RNA, 1701 nt, Artificial Sequence
  derived and/or modified sequence opt3 from hemagglutinin__InfluenzaA__AEY69994
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcaaaaauuguacccuaaucgacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauucggcgcuccaagaacucauuuuucagucgacugaauuggcugacucaucucaacuuuaaauauccagcauuaaaugugaccaugcccaacaacgagcaguucgacaagcuguacaucuggggaguccaccauccuggcacagauaaagaccagauuuuucuuuaugcccaagcuagcggccguaucacugugucuaccaagagaucccagcagacagccauaccaaauauugggucaaggccccggguacgcaacaucccuagcagaauuaguaucuacuggaccaucguuaaaccaggagauauuuugcugauaaauucuacggguaaccuaaucgcgccgaggggcuacuucaagauucgguccggaaagagcucgaucaugcgcucugacgcacccauagggaaauguaauuccggcugcauuacuccuaacgguucaaucccaaaugacaagcccuuucagaacgugaaucgaaucacauauggggccuguccuagauacgucaaacaaaacacccucaagcuggcuacuggaaugaggaaugugccagagaaacagacacggggcauuuucggcgccaucgcaggguuuauugaaaacggaugggaggguaugguggauggcugguauggguuccgucaccagaauagugaaggacgcggccaagcugccgaccuuaagagcacccaggcggccauagaucagaucaacgguaaacugaauagauugauugggaagacgaacgagaaguuccaccagaucgagaaagaauuuuccgaggucgaaggcaggauccaagaccucgagaaguacguugaagauaccaaaauugaccuguggucuuauaacgcagaguuacugguggcucucgagaaucagcauacaauagaucuuacugacagcgaaaugaacaagcuguucgagaaaaccaagaagcaguugcgggaaaaugccgaggauaugggaaacggcugcuuuaaaaucuaccacaagugugacaaugcuugcauugggucaauccgaaacggaacauaugaucaugacguauaccgcgacgaagcccuaaauaacagauuccagauuaaagguguggagcugaagaguggcuacaaagauugguuucucuggaucuccuucgcaauaagcugcuuucugcuuugugucgcccuguugggguucaucaugugggcuugccaaaagggaaauauuagguguaacaucugcauuuga

SEQ ID NO: 130189 - RNA, 1701 nt, Artificial Sequence; identical to SEQ ID NO: 130188
  derived and/or modified sequence opt3 from hemagglutinin__InfluenzaA__AEY70005

SEQ ID NO: 130190 - RNA, 1701 nt, Artificial Sequence; identical to SEQ ID NO: 125629
  derived and/or modified sequence opt3 from hemagglutinin__InfluenzaA__AEY70016

SEQ ID NO: 130191 - RNA, 1701 nt, Artificial Sequence
  derived and/or modified sequence opt3 from hemagglutinin__InfluenzaA__AEY70256
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauggcaauuguuaccccuaugacgucccugauuacgcaucuuugaggucgcucguggccucaagcgguacucuggaguuuaacaaugaaaguuucaacuggacagggguuacccagaauggaacguccucugcuugcauccggcgcagcaagaacuccuuuuucucacgacugaauuggcucacucauuuaaacuuuaaauauccagcacugaaugugaccaugcccaacaacgagcaguucgacaaacuuuacauuuggggcguccaccauccuggcacagauaaagaccagaucuuuuuguaugcccaagcuagugggcguauuacugugagcaccaagagaucucagcagacagccaucccaaauauaggauccaggccccggguacgcaacauuccuucaagaaucagcauuuacuggaccaucguuaaaccaggugauaugcugcuaaucaauaguacgggcaaccucauugcgccgaggggguacuucaagauacggucuggaaaguccagcaucaugcgcucggacgcacccauuggcaaauguaauucugagugcaucacuccuaacgguuccauaccaaaugacaagcccuuucagaacgugaaucgaauuacauauggggccuguccuagauacgucaaacaaaacacccugaaacuugcuacuggaaugaggaaugugccagaaaagcagacacggggcaucuucggcgccaucgcaggguuuauugagaacggaugggaagguaugguggauggcugguauggguuccgucaccaaaauucagagggacgcggccaggcugccgaccugaagaguacccaggcggccaucgaucagauuaacgguaaauugaauagacucauagggaagacgaacgagaaguuccaccagaucgaaaaagaguuuagcgaagucgagggcaggauucaagaccuggaaaaguacguugaggauaccaaaaucgacuuaugguccuauaacgcagagcugcucguggcucuugaaaaucagcauacaaucgaucugacugacucugagaugaacaaguuguucgaaaagaccaagaagcagcuacgggagaaugccgaagauaugggaaacggcugcuuuaaaauuuaccacaagugugacaaugcuugcauagggagcauccgaaacggaacauaugaucaugacguauaccgcgacgaggcccugaauaacagauuccagauuaaagguguggagcucaagucaggcuacaaagauuggauccuguggauuaguuuugcaaucuccugcuuccuucugugugucgccuugcucggguuuauaaugugggcuugccaaaagggaaauaucagguguaacauuugcaucuga

SEQ ID NO: 130192 - RNA, 1701 nt, Artificial Sequence; identical to SEQ ID NO: 125629
  derived and/or modified sequence opt3 from hemagglutinin__InfluenzaA__AEY70267

SEQ ID NO: 130193 - RNA, 1701 nt, Artificial Sequence; identical to SEQ ID NO: 125629
  derived and/or modified sequence opt3 from hemagglutinin__InfluenzaA__AEY70278

SEQ ID NO: 130194 - RNA, 1701 nt, Artificial Sequence; identical to SEQ ID NO: 125427
  derived and/or modified sequence opt3 from hemagglutinin__InfluenzaA__AEY70289

SEQ ID NO: 130195 - RNA, 1701 nt, Artificial Sequence; identical to SEQ ID NO: 125629
  derived and/or modified sequence opt3 from hemagglutinin__InfluenzaA__AEY70300

SEQ ID NO: 130196 - RNA, 1701 nt, Artificial Sequence; identical to SEQ ID NO: 125629
  derived and/or modified sequence opt3 from hemagglutinin__InfluenzaA__AEY70311

SEQ ID NO: 130197 - RNA, 1701 nt, Artificial Sequence; identical to SEQ ID NO: 125629
  derived and/or modified sequence opt3 from hemagglutinin__InfluenzaA__AEY70333

SEQ ID NO: 130198 - RNA, 1701 nt, Artificial Sequence; identical to SEQ ID NO: 130188
  derived and/or modified sequence opt3 from hemagglutinin__InfluenzaA__AEY70344

SEQ ID NO: 130199 - RNA, 1701 nt, Artificial Sequence; identical to SEQ ID NO: 127240
  derived and/or modified sequence opt3 from hemagglutinin__InfluenzaA__AEY70355

SEQ ID NO: 130200 - RNA, 1701 nt, Artificial Sequence; identical to SEQ ID NO: 125427
  derived and/or modified sequence opt3 from hemagglutinin__InfluenzaA__AEY70365

SEQ ID NO: 130201 - RNA, 1701 nt, Artificial Sequence; identical to SEQ ID NO: 125629
  derived and/or modified sequence opt3 from hemagglutinin__InfluenzaA__AEY70376

SEQ ID NO: 130202 - RNA, 1701 nt, Artificial Sequence
  derived and/or modified sequence opt3 from hemagglutinin__InfluenzaA__AFB18656
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugcgauccgaccaaaagugcgugaucaggaggguagaaugaauuacuauuggacccugguggaacccggcgacaagauuacauucgaggcaaccgggaaccuagucguuccuagguacgccuuugcuauggaacgggaugccggaaguggcaucauaauuucugacacgccagugcaugacugcaacacuacaugucaaaccccgaaaggugcaaucaauacuucccuccccuuccagaacauucacccuaucacaaucgggaagugcccaaaguauguaaaaagcaccaagcugcgccuugcuacgggacugagaaaugugcccucgauucagucuaggggcuuguuuggcgccauagcgggguucaucgagggagguuggaccggcauggucgaugggugguacggauaucaucaccagaacgaacaaggcuccgguuacgccgcagaccucaaaucaacacagaaugcuauugauaagaucacuaacaaagugaauaguguuauagagaagaugaacacccaguuuacagccguggggaaggaguucaaucaccuggaaaaacggauugagaacuuaaauaagaaagucgacgauggcuuccuggacaucuggacuuacaacgcugaacuccuugugcuguuggagaaugaacgcacccuagauuaucaugacagcaacguaaagaaucuguacgagaaaguucgaaaccagcucaagaacaaugccaaggagaucggaaacggcuguuuugaguucuaucacaaaugcgauaauacauguauggaguccgugaagaacgggaccuacgacuauccuaaauacucugaagaggcaaagcugaauagagaagagauugauggagucaaacuugagagcacuaggaucuaucaaauucuggccauauacucaacggcugcgaguuccuuggugcucgucgugagccugggugcaaucucuuuuuggaugugcucaaacggcaguuuacagugccggauuuguaucuga

SEQ ID NO: 130203 - RNA, 1701 nt, Artificial Sequence; identical to SEQ ID NO: 129066
  derived and/or modified sequence opt3 from hemagglutinin__InfluenzaA__AFB40597

SEQ ID NO: 130204 - RNA, 1701 nt, Artificial Sequence; identical to SEQ ID NO: 129066
  derived and/or modified sequence opt3 from hemagglutinin__InfluenzaA__AFB40598

SEQ ID NO: 130205 - RNA, 1701 nt, Artificial Sequence
  derived and/or modified sequence opt3 from hemagglutinin__InfluenzaA__AFB40599
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgaucugaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggaccagucgcuauucuaagaaauuuaagccugagauugcaauccgaccaaaagugcgugaucaggagggaagaaugaauuacuauuggacucuaguggaacccggugacaagauuacauucgaggccacuggcaaccucgucguuccuagguacgcuuuugccauggaacggaacgcaggguccggaaucauaauuagcgauaccccagugcaugacugcaauacaaccugucaaacgccgaaaggcgcuaucaacacuucgcugcccuuccagaauauucacccuaucacaaucgguaagugcccaaaguauguaaaaucuaccaagcugcgccuugccacuggguugagaaacgugcccuccauucagucaaggggacucuuuggcgcgauagccggcuucaucgaagggggauggacagguauggucgacggcugguacggguaucaucaccagaaugaacaaggaaguggcuacgcagcugaucugaaaagcacccagaacgccauugacaagaucacgaauaaagugaacuccguuauagagaagaugaauacccaguuuacagcuguggguaaggaguucaaccacuuagaaaaacggauugagaaucugaacaagaaagucgaugacggguuccucgauaucuggacuuacaaugccgaacuucugguguugcuagagaacgaacgcacccuggacuaucaugauucuaauguaaagaaccucuacgagaaaguucgaagccagcugaagaacaaugcaaaggagaucggcaacggauguuuugaguucuaucacaaaugcgacaauacauguauggaaucagugaagaacggcacuuacgauuauccuaaauacagugaagaggccaaacuuaauagagaagagauugacggggucaagcuggaguccaccaggaucuaucaaauuuuggcuauauacagcacaguggcgucuucacucguccuggugguuaguuuaggagcaaucagcuuuuggaugugcuccaacgguucucugcagugccggauuuguaucuga

SEQ ID NO: 130206 - RNA, 1701 nt, Artificial Sequence; identical to SEQ ID NO: 125849
  derived and/or modified sequence opt3 from hemagglutinin__InfluenzaA__AFB40600

SEQ ID NO: 130207 - RNA, 1701 nt, Artificial Sequence
  derived and/or modified sequence opt3 from hemagglutinin__InfluenzaA__AFB40601
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccggaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcguggacaggaagguagaaugaauuacuauuggacccugguggagcccggcgauaaaauuacauucgaagccacugggaaccuagucguuccuagguacgcuuuugccauggagcggaacgcaggaagcggcaucauaauuucggacaccccagugcaugauugcaauacaaccugucaaacgccgaagggugcuaucaacacuucucuccccuuccagaauauucacccuaucacaaucgggaaaugcccaaaguauguaaaguccaccaaacugcgccuugccacuggacugagaaacgugcccucaauucagaguaggggcuuguuuggcgcgauagccggguucaucgaaggagguuggacaggcauggucgacgggugguacggauaucaucaccagaaugagcaaggcagcgguuacgcagcugaccucaaguccacccagaacgccauugaugagaucacgaauaaagugaacucuguuauagaaaagaugaauacccaguuuacagcuguggggaaagaguucaaccaccuggaaaagcggauugagaauuuaaacaagaaagucgacgauggcuuccuggacaucuggacuuacaaugccgaacuccuugugcuguuggagaacgagcgcacccuagauuaucaugacagcaauguaaagaaccuguacgaaaaaguucgaucacagcucaagaacaaugcaaaagagaucggaaacggcuguuuugaguucuaucacaagugcgauaauacauguauggagagugugaagaacgggacuuacgacuauccuaaauacuccgaagaggccaagcugaauagagaggaaauugauggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 130208 - RNA, 1701 nt, Artificial Sequence; identical to SEQ ID NO: 124685
  derived and/or modified sequence opt3 from hemagglutinin__InfluenzaA__AFB40602

SEQ ID NO: 130209 - RNA, 1701 nt, Artificial Sequence; identical to SEQ ID NO: 125849
  derived and/or modified sequence opt3 from hemagglutinin__InfluenzaA__AFB40603

SEQ ID NO: 130210 - RNA, 1701 nt, Artificial Sequence
  derived and/or modified sequence opt3 from hemagglutinin__InfluenzaA__AFB40604
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaagaaggaaacagcuacccaaaguuaucuaaauccuauauaaaugacaagggcaaggagguacugguucuuuggggcauccaccaucccccuacgacugcugaucaacagucauuguaccagaacgccgacaccuacguguucgucgggacaagccgcuauaguaaaaaguuuaaaccagagauugcgauccgacccaaggugcgugaucaggaaggaagaaugaauuacuauuggacucugguggagccuggugacaaaauuaccuucgaagcaacaggcaaccuagucguuccaagguacgccuuugcuauggagcggaacgccgggucuggaaucauaauuuccgauaccccggugcacgacugcaauacgacuugucaaacacccaagggcgcaaucaacaccagccucccuuuccagaauauucacccaaucacuaucgguaaaugccccaaguauguaaagucgacaaaacugcgccuugcuaccgggcugagaaacgugccuucuauucaguccaggggauuguuuggcgccauagcgggcuucaucgaagggggauggacggguauggucgacggcugguacggguaucaucaccagaaugagcaaggaucaggcuacgccgcagaucucaagaguacccagaacgcuauugacaaaaucacaaauaaggugaacagcguuauagagaaaaugaauacucaguuuaccgccguggauaaggaguucaaccaccuggagaagcggauugguaauuuaaacaaaaaggucgacgauggguuccuggacaucuggacauacaaugcugaacuccuugugcuguuggagaacgaacgcacucuagauuaucaugacuccaauguaaagaaccuguacgagaagguucgaaaccagcucaaaaauaacgccaaggagaucggcaauggauguuuugaguucuaucacaagugcgauaacaccuguauggaaucugugaaaaauggcacauacgacuauccaaaguacagcgaagaggcaaaacugaacagagaagagauugauggggucaaacuugagucaaccaggaucuaucaaauucuggccauauacaguacuguggcuuccagcuugguccucgugguuucucugggagcgaucucauuuuggaugugcaguaaugguagcuuacagugccggauuuguaucuga

SEQ ID NO: 130211 - RNA, 1701 nt, Artificial Sequence; identical to SEQ ID NO: 124685
  derived and/or modified sequence opt3 from hemagglutinin__InfluenzaA__AFB70138

SEQ ID NO: 130212 - RNA, 1701 nt, Artificial Sequence
  derived and/or modified sequence opt3 from hemagglutinin__InfluenzaA__AFB70145
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguaucaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacgagauaacgaauaaggucaacucugugauugagaaaaugaauacccaguuuacagcuguugguaaggaguucaaccaccuggaaaagcggaucgaaaauuuaaacaaaaagguggaugacggguuccuggauaucuggacuuacaaugccgagcuccuuguccuguuggaaaacgagcgcacccuagacuaucaugauagcaaugugaaaaaccuguacgagaagguacgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 130213 - RNA, 1701 nt, Artificial Sequence
  derived and/or modified sequence opt3 from hemagglutinin__InfluenzaA__AFB70154
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugagaaacuauguaagcucagagggguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucgggaacggcuguuuugaguucuaucacaagugcgacaauacauguauggaaagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 130214 - RNA, 1701 nt, Artificial Sequence; identical to SEQ ID NO: 124685
  derived and/or modified sequence opt3 from hemagglutinin__InfluenzaA__AFB70156

SEQ ID NO: 130215 - RNA, 1701 nt, Artificial Sequence; identical to SEQ ID NO: 124685
  derived and/or modified sequence opt3 from hemagglutinin__InfluenzaA__AFB70158

SEQ ID NO: 130216 - RNA, 1701 nt, Artificial Sequence; identical to SEQ ID NO: 130212
  derived and/or modified sequence opt3 from hemagglutinin__InfluenzaA__AFB70160

SEQ ID NO: 130217 - RNA, 1701 nt, Artificial Sequence; identical to SEQ ID NO: 125879
  derived and/or modified sequence opt3 from hemagglutinin__InfluenzaA__AFB70162

SEQ ID NO: 130218 - RNA, 1701 nt, Artificial Sequence
  derived and/or modified sequence opt3 from hemagglutinin__InfluenzaA__AFB70167
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaaugcgaccaaaagugcgugaucaggagggaagaaugaauuacuauuggacccugguggaacccggugacaagaucacauucgaggccacuggcaaccuagucguuccuagguacgcuuuugccauggaacggaacgcagggagcggaauuaucauaucggauaccccagugcaugacugcaauacaaccugucaaacgccgaaaggcgcuauuaacacuucucuccccuuccagaauauccacccuauuacaaucgguaagugcccaaaguauguaaaauccaccaagcugcgccuugccacugggcugagaaacgugcccucaauccagaguaggggauuguuuggcgcgauugccggcuucauagaagggggauggacagguauggucgacggcugguacggguaucaucaccagaaugaacaaggaagcggcuacgcagcugaucucaaauccacccagaacgccaucgacgagauuacgaauaaggugaacucuguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagaucgacggggucaaacuugaaagcaccaggauuuaucaaauccuggcuauuuacucuacaguggcgucaaguuugguccucgugguuagccugggagcaauauccuuuuggaugugcucuaacgguucguuacagugccggaucuguauuuga

SEQ ID NO: 130219 - RNA, 1701 nt, Artificial Sequence; identical to SEQ ID NO: 124685
  derived and/or modified sequence opt3 from hemagglutinin__InfluenzaA__AFB70177

SEQ ID NO: 130220 - RNA, 1701 nt, Artificial Sequence; identical to SEQ ID NO: 125254
  derived and/or modified sequence opt3 from hemagglutinin__InfluenzaA__AFB70187

SEQ ID NO: 130221 - RNA, 1701 nt, Artificial Sequence; identical to SEQ ID NO: 125879
  derived and/or modified sequence opt3 from hemagglutinin__InfluenzaA__AFB70197

SEQ ID NO: 130222 - RNA, 1701 nt, Artificial Sequence; identical to SEQ ID NO: 124685
  derived and/or modified sequence opt3 from hemagglutinin__InfluenzaA__AFB70207

SEQ ID NO: 130223 - RNA, 1701 nt, Artificial Sequence; identical to SEQ ID NO: 124685
  derived and/or modified sequence opt3 from hemagglutinin__InfluenzaA__AFB70217

SEQ ID NO: 130224 - RNA, 1701 nt, Artificial Sequence; identical to SEQ ID NO: 124685
  derived and/or modified sequence opt3 from hemagglutinin__InfluenzaA__AFB70227

SEQ ID NO: 130225 - RNA, 1701 nt, Artificial Sequence
  derived and/or modified sequence opt3 from hemagglutinin__InfluenzaA__AFB70247
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaaggaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 130226 - RNA, 1701 nt, Artificial Sequence
  derived and/or modified sequence opt3 from hemagglutinin__InfluenzaA__AFB70257
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuguggacuacgaggagcucagggagcagcugagcagugucuccucuuucgaacgguuugagaucuucccgaagacaagcuccuggcccaaucacgauucaaacaagggugugaccgccgcuuguccucaugcaggggccaaaaguuuuuauaagaaucugauuuggcucguaaagaagggaaacagcuacccaaaauuaucuaaguccuauaucaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 130227 - RNA, 1701 nt, Artificial Sequence; identical to SEQ ID NO: 129092
  derived and/or modified sequence opt3 from hemagglutinin__InfluenzaA__AFB70267

SEQ ID NO: 130228 - RNA, 1701 nt, Artificial Sequence; identical to SEQ ID NO: 125155
  derived and/or modified sequence opt3 from hemagglutinin__InfluenzaA__AFB70277

SEQ ID NO: 130229 - RNA, 1701 nt, Artificial Sequence; identical to SEQ ID NO: 124685
  derived and/or modified sequence opt3 from hemagglutinin__InfluenzaA__AFB70287

SEQ ID NO: 130230 - RNA, 1701 nt, Artificial Sequence; identical to SEQ ID NO: 124685
  derived and/or modified sequence opt3 from hemagglutinin__InfluenzaA__AFB70297

SEQ ID NO: 130231 - RNA, 1701 nt, Artificial Sequence; identical to SEQ ID NO: 124685
  derived and/or modified sequence opt3 from hemagglutinin__InfluenzaA__AFB70307

SEQ ID NO: 130232 - RNA, 1701 nt, Artificial Sequence; identical to SEQ ID NO: 130212
  derived and/or modified sequence opt3 from hemagglutinin__InfluenzaA__AFB70317

SEQ ID NO: 130233 - RNA, 1701 nt, Artificial Sequence
  derived and/or modified sequence opt3 from hemagglutinin__InfluenzaA__AFB70327
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggggaagcggauugagaauuuaaacaaaaaggucgaugacggcuuccuggauaucuggacuuacaaugccgaacuccuugugcuguuggagaacgaacgcacccuagacuaucaugauagcaauguaaagaaccuguacgagaagguucgaucacagcucaaaaacaaugcaaaggagaucggaaacggcuguuuugaguucuaucacaagugcgacaauacauguauggagagugugaaaaacgggacuuacgauuauccuaaguacuccgaagaggccaaacugaauagagaagagauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 130234 - RNA, 1701 nt, Artificial Sequence; identical to SEQ ID NO: 124685
  derived and/or modified sequence opt3 from hemagglutinin__InfluenzaA__AFB70337

SEQ ID NO: 130235 - RNA, 1701 nt, Artificial Sequence; identical to SEQ ID NO: 126655
  derived and/or modified sequence opt3 from hemagglutinin__InfluenzaA__AFB70347

SEQ ID NO: 130236 - RNA, 1701 nt, Artificial Sequence; identical to SEQ ID NO: 124685
  derived and/or modified sequence opt3 from hemagglutinin__InfluenzaA__AFB70367

SEQ ID NO: 130237 - RNA, 1701 nt, Artificial Sequence; identical to SEQ ID NO: 124685
  derived and/or modified sequence opt3 from hemagglutinin__InfluenzaA__AFB70377

SEQ ID NO: 130238 - RNA, 1701 nt, Artificial Sequence; identical to SEQ ID NO: 125254
  derived and/or modified sequence opt3 from hemagglutinin__InfluenzaA__AFB70387

SEQ ID NO: 130239 - RNA, 1701 nt, Artificial Sequence; identical to SEQ ID NO: 124685
  derived and/or modified sequence opt3 from hemagglutinin__InfluenzaA__AFB70397

SEQ ID NO: 130240 - RNA, 1701 nt, Artificial Sequence; identical to SEQ ID NO: 124685
  derived and/or modified sequence opt3 from hemagglutinin__InfluenzaA__AFB70407

SEQ ID NO: 130241 - RNA, 1701 nt, Artificial Sequence
  derived and/or modified sequence opt3 from hemagglutinin__InfluenzaA__AFB77618
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaagaacucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccacgacuaccggggaccaacagucauuguaccagaaugcugauggauacguuuucguggguacaacucgcuauagcaagaaauuuaagccugagaucggcauucgaccaaaagucaaggaccaggaggggcguaugaacuacuauuggacccugguggaacccggagauaaaaucacauucgaggccaccggcaaccuaguggucccuagauacgcguuugcaauggaaaggaaugccgguagugggauaauuaucucugacacgccaguucaugauugcaacacuacaugucaaaccccgaagggagcuauuaauacuucccuccccuuccagaacauccacccuaucacaauuggcaagugcccaaaauauguaaagagcaccaaacugcggcuugccacgggccugcgcaaugugcccucgauacagucuagaggguuguuuggagcaaucgcugguuucauugagggcggguggaccggaaugguggacggcugguacgguuaucaucaccagaacgaacaaggguccggcuacgccgcggaccucaagucaacacagaaugccaucgauaaaauaacuaacaaggucaauagugugauugagaagaugaacacccaguuuacagcaguuggaaaagaguucaaucaccuggaaaagaggaucgagaacuuaaauaaaaagguggacgauggcuuccuggacaucuggacuuacaacgcugaacuccuuguccuguuggagaaugaacggacccuagauuaucaugacagcaacgugaaaaaccuguacgagaagguacgcaaucagcucaagaacaaugccaaagagauugggaacggauguuuugaguucuaucacaagugcgauaauacauguauggaguccguuaaaaacgguaccuacgacuauccuaaguacucugaagaggcuaaacugaaucgagaagagaucgauggcgugaaacuugagagcacuagaauuuaucaaauacuggccaucuacucaacggucgcaaguuccuuggugauggucgugagccucggggccauuucuuuuuggaugugcucaaacggaagucugcagugcaggaucuguaucuga

SEQ ID NO: 130242 - RNA, 1701 nt, Artificial Sequence; identical to SEQ ID NO: 128883
  derived and/or modified sequence opt3 from hemagglutinin__InfluenzaA__AFB77619

SEQ ID NO: 130243 - RNA, 1701 nt, Artificial Sequence; identical to SEQ ID NO: 128883
  derived and/or modified sequence opt3 from hemagglutinin__InfluenzaA__AFB77620

SEQ ID NO: 130244 - RNA, 1701 nt, Artificial Sequence
  derived and/or modified sequence opt3 from hemagglutinin__InfluenzaA__AFB77621
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaggagcucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaccuagucguuccuagguacgccuuugcuauggaacggaaugccggguccggaaucauaauuagcgacaccccagugcaugauugcaacacgacuugucaaacaccgaaaggcgcaaucaauaccucgcuccccuuccagaacauucacccuaucacuaucgguaagugcccaaaguauguaaaaucuacaaagcugcgccuugcuaccgggcugagaaauauucccuccauacagucaaggggauuguuuggcgccaucgcgggcuucauugaagggggauggacggguaugguggacggcugguacggguaucaucaccagaacgaacaaggaaguggcuacgccgcagaccucaaaagcacccagaaugcuaucgauaagauaacaaacaaagucaauuccgugauugagaagaugaacacucaguuuaccgccguugguaaggaguucaaucaccuggaaaaacggaucgagaacuuaaauaagaaaguggacgauggguuccuggacaucuggacauacaacgcugaacuccuuguccuguuggagaaugaacgcacucuagauuaucaugacucuaacgugaagaaccuguacgagaaaguacgaaaucagcucaagaacaaugccaaggagauuggcaacggauguuuugaguucuaucacaaaugcgauaauaccuguauggaaagcguuaagaacggcacauacgacuauccuaaauacucagaagaggcaaagcugaauagagaagagaucgauggggugaaacuugagaguaccaggauuuaucaaauacuggccaucuacuccacugucgcuagcucuuuggugcucgucgugucacugggagcgauuaguuuuuggaugugcagcaacgguuccuuacagugccggaucuguaucuga

SEQ ID NO: 130245 - RNA, 1701 nt, Artificial Sequence
  derived and/or modified sequence opt3 from hemagglutinin__InfluenzaA__AFB77622
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacccuaauaagggugucaccgccgcuuguccacaugcaggggccaaaucauuuuauaagaaccugaucuggcucgugaaaaagggaaauaguuaccccaaauuaagcaagucuuauauaaacgauaagggcaaagaaguacugguucuuuggggcauccaccacccuuccacgacugcugaccaacagucauuguaccagaaugccgaugcguacguguucgucgggaccagccgcuauaguaagaaauuuaagccagagauugcaauccgacccaaagugcgugaccaggagggaagaaugaacuacuauuggacacugguggaaccuggugauaagauuacuuucgaggccaccggcaaccuagucguuccaagguacgcuuuugccauggaacggaaugcagggucuggaaucauaauuuccgacacaccggugcaugauugcaacaccacgugucaaacucccaaaggcgcuaucaauacaagccucccuuuccagaacauucacccaaucaccaucgguaagugccccaaguauguaaaaucgacuaagcugcgccuugccacagggcugagaaaugugccuucuauucaguccaggggauuguuuggcgcgauagccggcuucaucgaagggggauggaccgguauggucgacggcugguacggguaucaucaccagaacgaacaaggaucaggcuacgcagcugaccucaaaaguacgcagaaugccauugauaagaucaccaacaaagugaauagcguuauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacuccaacguaaagaaccuguacgagaaaguucgaaaucagcucaagaacaaugcaaaggagaucggcaacggauguuuugaguucuaucacaaaugcgauaauacuuguauggaaucugugaagaacggcaccuacgacuauccaaaauacagcgaagaggccaagcugaauagagaagagauugauggggucaaacuugagucaacaaggaucuaucaaauucuggcuauauacaguaccguggcguccagcuugguccucgugguuucucugggagcaaucucauuuuggaugugcaguaacgguagcuuacagugccggauuuguaucuga

SEQ ID NO: 130246 - RNA, 1701 nt, Artificial Sequence; identical to SEQ ID NO: 128883
  derived and/or modified sequence opt3 from hemagglutinin__InfluenzaA__AFB77623

SEQ ID NO: 130247 - RNA, 1701 nt, Artificial Sequence; identical to SEQ ID NO: 128883
  derived and/or modified sequence opt3 from hemagglutinin__InfluenzaA__AFB77624

SEQ ID NO: 130248 - RNA, 1701 nt, Artificial Sequence
  derived and/or modified sequence opt3 from hemagglutinin__InfluenzaA__AFB77625
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaggagcucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaccuagucguuccuagguacgccuuugcuauggaacggaaugccggguccggaaucauaauuagcgacaccccagugcaugauugcaacacgacuugucaaacaccgaaaggcgcaaucaauaccucgcuccccuuccagaacauucacccuaucacuaucgguaagugcccaaaguauguaaaaucuacaaagcugcgccuugcuaccgggcugagaaaugugcccuccauucagucaaggggauuguuuggcgccauagcgggcuucaucgaagggggauggacggguauggucgacggcugguacggguaucaucaccagaacgaacaaggaaguggcuacgccgcagaccucaaaagcacccagaaugcuauugauaagaucacaaacaaaguuaauuccgugauagagaagaugaacacucaguuuaccgccguggguaaggaguucaaucaccuggaaaaacggauugagaacuuaaauaagaaagucgacgauggguuccuggacaucuggacauacaacgcugaacuccuugugcuguuggagaaugaacgcacucuagauuaucaugacucuaacguaaagaaccuguacgagaaaguucgaaaucagcucaagaacaaugccaaggagaucggcaacggauguuuugaguucuaucacaaaugcgauaauaccuguauggaaagcgugaagaacggcacauacgacuauccuaaauacucagaagaggcaaagcugaauagagaagagauugauggggucaaacuugagaguaccaggaucuaucaaauucuggccauauacuccacuguggcuagcucuuugguccucgugguuucacugggagcgaucaguuuuuggaugugcagcaacgguuccuuacagugccggauuuguaucuga

SEQ ID NO: 130249 - RNA, 1701 nt, Artificial Sequence
  derived and/or modified sequence opt3 from hemagglutinin__InfluenzaA__AFB77627
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucagcaagacauccucauggccgaaccacgacaguaauaagggugucaccgccgcuuguccccaugcaggggccaaaucuuuuuauaagaaccugaucuggcucgugaaaaagggaaauucuuacccuaaauuauccaagucauauauaaacgauaagggcaaagaaguacugguucuuuggggcauccaccacccaagcacgacugcugaccaacagaguuuguaccagaaugccgaugcguacguguucgucgggaccucucgcuauuccaagaaauuuaagcccgagauugcaauccgaccuaaagugcgugaccaggagggaagaaugaacuacuauuggacacugguggaaccaggugauaagauuacuuucgaggccaccggcaaccuagucguucccagguacgcuuuugccauggaacggaaugcagggagcggaaucauaauuucggacacaccugugcaugauugcaacaccacgugucaaacuccaaaaggcgcuaucaauacaucucucccguuccagaacauucaccccaucaccaucgguaagugcccuaaguauguaaaauccacuaagcugcgccuugccacagggcugagaaaugugccaucaauucagaguaggggauuguuuggcgcgauagccggcuucaucgaagggggauggaccgguauggucgacggcugguacggguaucaucaccagaacgaacaaggaagcggcuacgcagcugaccucaaauccacgcagaaugccauugauaagaucaccaacaaagugaauagcguuauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacagcaacguaaagaaccuguacgagaaaguucgaaaucagcucaagaacaaugcaaaggagaucggcaacggauguuuugaguucuaucacaaaugcgauaauacuuguauggaaucagugaagaacggcaccuacgacuaucccaaauacagugaagaggccaagcugaauagagaagagauugauggggucaaacuugaguccacaaggaucuaucaaauucuggcuauauacagcaccguggcgucuucauugguccucgugguuagucugggagcaaucagcuuuuggaugugcuccaacgguucuuuacagugccggauuuguaucuga

SEQ ID NO: 130250 - RNA, 1701 nt, Artificial Sequence; identical to SEQ ID NO: 128883
  derived and/or modified sequence opt3 from hemagglutinin__InfluenzaA__AFB77628

SEQ ID NO: 130251 - RNA, 1701 nt, Artificial Sequence
  derived and/or modified sequence opt3 from hemagglutinin__InfluenzaA__AFB77629
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaggagcucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaccuagucguuccuagguacgccuuugcuauggaacggaaugccggguccggaaucauaauuagcgacaccccagugcaugauugcaacacgacuugucaaacaccgaaaggcgcaaucaauaccucgcuccccuuccagaacauucacccuaucacuaucgguaagugcccaaaguauguaaaaucuacaaagcugcgccuugcuaccgggcugagaaaugugcccuccauucagucaaggggauuguuuggcgccauagcgggcuucaucgaagggggauggacggguauggucgacggcugguacggguaucaucaccagaacgaacaaggaaguggcuacgccgcagaccucaaaagcacccagaaugcuauugauaagaucacaaacaaaguuaauuccgugauagagaagaugaacacucaguuuaccgccguggguaaggaguucaaucaccuggaaaaacggauugagaacuuaaauaagaaagucgacgauggguuccuggacaucuggacauacaacgaggaacuccuugugcuguuggaaaaugagcgcacucuagauuaucaugacucuaacguaaagaaccuguacgagaaaguucgaaaucagcucaagaacaaugcuaaggaaaucggcaacggauguuuugaguucuaucacaaaugcgauaauaccuguauggaaagcgugaagaacggcacauacgacuauccuaaauacucagaggaagccaagcugaauagagaggagauugauggggucaaacuugaaaguaccaggaucuaucaaauucuggcaauauacuccacuguggccagcucuuugguccucgugguuucacugggagcuaucaguuuuuggaugugcagcaacgguuccuuacagugccggauuuguaucuga

SEQ ID NO: 130252 - RNA, 1701 nt, Artificial Sequence
  derived and/or modified sequence opt3 from hemagglutinin__InfluenzaA__AFB77630
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgaaucaaauaagggugucaccgccgcuuguccucaugcaggggccaaaaguuuuuauaagaaccugaucuggcucgugaaaaagggaaauagcuacccaaaauuaucuaaguccuauauaaacgacaagggcaaagagguacugguucuuuggggcauccaccaccccucaacgacugcugaucaacagagcuuguaccagaaugccgacgcguacguguucgucgggaccagucgcuauucuaagaaauuuaagccugagauugcaauccgaccaaaagugcgugaucaggaaggaagaaugaacuacuauuggacacugguggagcccggugacaagauuacuuucgaagccaccggcaaccuagucguuccuagguacgcuuuugccauggagcggaaugcaggguccggaaucauaauuagcgauacaccagugcaugacugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgauggcugguacggguaucaucaccagaacgagcaaggaaguggcuacgcagcugaccucaaaagcacgcagaaugccauugacaagaucaccaacaaaguuaauuccgugauagagaagaugaacacacaguuuacugcuguggguaaggaguucaaucaccuggagaaacggauugaaaacuuaaauaagaaagucgaugacggguuccuggauaucuggaccuacaacgccgagcuccuugugcuguuggaaaaugagcgcacacuagacuaucaugauucuaacguaaagaaccuguacgagaaaguucgaaaucagcucaagaacaaugcaaaggaaaucggcaacggauguuuugaguucuaucacaaaugcgacaauacuuguauggaaagcgugaagaacggcaccuacgauuauccuaaauacucagaggaagccaagcugaauagagaggagauugacggggucaaacuugaaaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 130253 - RNA, 1701 nt, Artificial Sequence
  derived and/or modified sequence opt3 from hemagglutinin__InfluenzaA__AFB77631
augaaggccauccuggugguccuccuuuacaccuucacaacugcuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucaauuacgaggagcucagggagcagcugagcaguguguccucuuucgaacgguuugagauuuucccgaagaccagcuccuggcccaaccacgacucaaauaagggugucacggcagccuguccucaugcuggggcaaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaccuagucguuccuagguacgccuuugcuauggaacggaaugccggguccggaaucauaauuagcgacaccccagugcaugauugcaacacgacuugucaaacaccgaaaggcgcaaucaauaccucgcuccccuuccagaacauucacccuaucacuaucgguaagugcccaaaguauguaaaaucuacaaagcugcgccuugcuaccgggcugagaaaugugcccuccauucagucaaggggauuguuuggcgccauagcgggcuucaucgaagggggauggacggguauggucgacggcugguacggguaucaucaccagaacgaacaaggaaguggcuacgccgcagaccucaaaagcacccagaaugcuauugauaagaucacaaacaaaguuaauuccgugauagagaagaugaacacucaguuuaccgccguggguaaggaguucaaucaccuggaaaaacggauugagaacuuaaauaagaaagucgacgauggguuccuggacaucuggacauacaacgcugaacuccuugugcuguuggagaaugaacgcacucuagauuaucaugacucuaacguaaagaaccuguacgagaaaguucgaaaucagcucaagaccaacgccaaggagaucggcaauggauguuuugaguucuaucacaaaugcgauaacacauguauggaaagcgugaagaauggcaccuacgacuauccuaaauacucagaagaggcaaagcugaacagagaagagauugauggggucaaacuugagaguacuaggaucuaucaaauucuggccauauacuccacgguggcuagcucuuugguccucgugguuucacugggagcgaucaguuuuuggaugugcagcaaugguuccuuacagugccggauuuguaucuga

SEQ ID NO: 130254 - RNA, 1701 nt, Artificial Sequence
  derived and/or modified sequence opt3 from hemagglutinin__InfluenzaA__AFB77632
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugacaaccgcaucaaguuggagcuacauuguugagacuuccucuucggacaacggaacaugcuauccaggcgauuuuaucaauuacgaggagcucagggagcagcugucaagcgugaguuccuucgaacgguuugagauuuucccgaagaccucuagcuggcccaaccacgacuccaauaagggugucacggccgcuuguccucaugcaggggccaaaucauuuuauaagaaccugaucuggcucgugaaaaagggaaauaguuacccaaaauuaagcaagucuuauauaaacgauaagggcaaagaaguacugguucuuuggggcauccaccaccccuccacuaccgcugaccaacagucauuguaccagaaugccgaugcguacguguucgucgggacaagccgcuauaguaagaaauuuaagccugagauugcaauccgaccaaaagugcgugaccaggagggaagaaugaacuacuauuggacucugguggaacccggugauaagauuaccuucgaggccacaggcaaccuagucguuccuagguacgcuuuugccauggaacggaaugcagggucuggaaucauaauuuccgacaccccagugcaugauugcaacacgacuugucaaacaccgaaaggcgcuaucaauaccagccuccccuuccagaacauucacccuaucacuaucgguaagugcccaaaguauguaaaaucgacaaagcugcgccuugccaccgggcugagaaaugugcccucuauucaguccaggggauuguuuggcgcgauagccggcuucaucgaagggggauggacggguauggucgacggcugguacggguaucaucaccagaacgaacaaggaucaggcuacgcagcugaccucaaaaguacccagaaugccauugauaagaucacaaacaaagugaauagcguuauagagaagaugaacacucaguuuaccgcuguggguaaggaguucaaucaccuggaaaaacggauugagaacuuaaauaagaaagucgacgauggguuccuggacaucuggacauacaacgccgaacuccuugugcuguuggagaaugaacgcacucuagauuaucaugacuccaacguaaagaaccuguacgagaaaguucgaaaucagcucaagaacaaugcaaaggagaucggcaacggauguuuugaguucuaucacaaaugcgauaauaccuguauggaaucugugaagaacggcacauacgacuauccuaaauacagcgaagaggccaagcugaauagagaagagauugauggggucaaacuugagucaaccaggaucuaucaaauucuggcuauauacaguacuguggcguccagcuugguccucgugguuucucugggagcaaucucauuuuggaugugcaguaacgguagcuuacagugcaagauuuguaucuga

SEQ ID NO: 130255 - RNA, 1701 nt, Artificial Sequence
  derived and/or modified sequence opt3 from hemagglutinin__InfluenzaA__AFB77633
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguagucaugcaggggccaagagcuuuuauaagaaccugaucuggcucgugaaaaagggaaauucuuacccuaaauuauccaagucauauauaaacgauaagggcaaagaaguacugguucuuuggggcauccaccacccaagcacgacugcugaccaacagaguuuguaccagaaugccgaugcguacguguucgucgggaccucucgcuauuccaagaaauuuaagcccgagauugcaauccgaccuaaagugcgugaccaggagggaagaaugaacuacuauuggacacugguggaaccaggugauaagauuacuuucgaggccaccggcaaccuagucguucccagguacgcuuuugccauggaacggaaugcagggagcggaaucauaauuucggacacaccugugcaugauugcaacaccacgugucaaacuccaaaaggcgcuaucaauacaucucucccguuccagaacauucaccccaucaccaucgguaagugcccuaaguauguaaaauccacuaagcugcgccuugccacagggcugagaaaugugccaucaauucagaguaggggauuguuuggcgcgauagccggcuucaucgaagggggauggaccgguauggucgacggcugguacggguaucaucaccagaacgaacaaggaagcggcuacgcagcugaccucaaauccacgcagaaugccauugauaagaucaccaacaaaguuaauucugugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacagcaacguaaagaaccuguacgagaaaguuaagaaucagcucaagaacaaugcaaaagagaucggcaacggauguuuugaguucuaucacaagugcgauaauacucccauuaaaaacgugaagaauggcaccuacgacuauccuaaauacucagaagaagccaagcugaaccgagaggaaaucgauggggucaaacuugagaguacaagaauuuaucaaauacuggcuaucuacuccaccguggcgagcucuuugguccucgugguuucacugggagcaauuaguuuuuggauguguagcaaugguuccuuacagugcaggaucugcaucuga

SEQ ID NO: 130256 - RNA, 1701 nt, Artificial Sequence
  derived and/or modified sequence opt3 from hemagglutinin__InfluenzaA__AFB77634
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugagaagauuacuuucgaagccaccggcaaccuagucguuccuagguacgcuuuugccauggagcggaaugcaggguccggaaucauaauuagcgauacaccagugcaugacugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgauggcugguacggguaucaucaccagaacgagcaaggaaguggcuacgcagcugaccucaaaagcacgcagaaugccauugacaagaucaccaacaaaguuaauuccgugauagagaagaugaacacacaguuuacugcuguggguaaggaguucaaucaccuggagaaacggauugaaaacuuaaauaagaaagucgaugacggguuccuggauaucuggaccuacaacgccgagcuccuugugcuguuggaaaaugagcgcacacuagacuaucaugauucuaacguaaagaaccuguacgagaaaguucgaaaucagcucaagaacaaugcaaaggaaaucggcaacggauguuuugaguucuaucacaaaugcgacaauacuuguauggaaagcgugaagaacggcaccuacgauuauccuaaauacucagaggaagccaagcugaauagagaggagauugacggggucaaacuugaaaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 130257 - RNA, 1701 nt, Artificial Sequence
  derived and/or modified sequence opt3 from hemagglutinin__InfluenzaA__AFB77635
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguccauggagcuacauuguugagaccuccucuucggacaacggaacuugcuauccgggcgauuuuaucaauuacgaggagcucagggagcagcugucaagcgugaguuccuucgaacgguuugagauuuuccccaagacaucuagcuggccuaaccacgacuccaauaagggugucaccgccgcuuguccacaugcaggggccaaaucauuuuauaagaaccugaucuggcucgugaaaaagggaaauaguuaccccaaauuaagcaagucuuauauaaacgauaagggcaaagaaguacugguucuuuggggcauccaccacccuuccacgacugcugaccaacagucauuguaccagaaugccgaugcguacguguucgucgggaccagccgcuauaguaagaaauuuaagccagagauugcaauccgacccaaagugcgugaccaggagggaagaaugaacuacuauuggacacugguggaaccuggugauaagauuacuuucgaggccaccggcaaccuagucguuccaagguacgcuuuugccauggaacggaaugcagggucuggaaucauaauuuccgacacaccggugcaugauugcaacaccacgugucaaacucccaaaggcgcuaucaauacaagccucccuuuccagaacauucacccaaucaccaucgguaagugccccaaguauguaaaaucgacuaagcugcgccuugccacagggcugagaaaugugccuucuauucaguccaggggauuguuuggcgcgauagccggcuucaucgaagggggauggaccgguauggucgacggcugguacggguaucaucaccagaacgaacaaggaucaggcuacgcagcugaccucaaaaguacgcagaaugccauugauaagaucaccaacaaagugaauagcguuauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacuccaacguaaagaaccuguacgagaaaguucgaaaucagcucaagaacaaugcaaaggagaucggcaacggauguuuugaguucuaucacaaaugcgauaauacuuguauggaaucugugaagaacggcaccuacgacuauccaaaauacagcgaagaggccaagcugaauagagaagagauugauggggucaaacuugagucaacaaggaucuaucaaauucuggcuauauacaguaccguggcguccagcuugguccucgugguuucucugggagcaaucucauuuuggaugugcaguaacgguagcuuacagugccggauuuguaucuga

SEQ ID NO: 130258 - RNA, 1701 nt, Artificial Sequence
  derived and/or modified sequence opt3 from hemagglutinin__InfluenzaA__AFB77636
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaagcaggguccggaaucauaauuagcgacacaccagugcaugauugcaauaccacgugucaaacuccgaagggcgcuaucaacacaucgcuccccuuccagaauauucacccuaucaccaucgguaagugcccaaaauauguaaagucuacuaaacugcgccuugccacagggcugagaaacgugcccuccauucagucaaggggauuguuuggcgcgauagccggcuucaucgaagggggauggaccgguauggucgacggcugguacggguaucaucaccagaaugaacaaggaaguggcuacgcagcugaccucaagagcacgcagaacgccauugauaaaaucaccaauaaggugaacuccguuauagagaagaugaauacacaguuuacugcuguggguaaagaguucaaccaccuggaaaagcggauugagaauuuaaacaaaaaggucgacgauggguuccuggacaucuggaccuacaaugccgaacuccuugugcuguuggagaacgaacgcacacuagauuaucaugacucuaauguaaagaaccuguacgagaagguucgaaaccagcucaagaauaacgcaaaagagaucggcaauggauguuuugaguucuaucacaagugcgauaacacuuguauggaaagcgugaaaaauggcaccuacgacuauccuaaguacucagaagaggccaaacugaacagagaagagauugauggggucaaacuugagaguacaaggaucuaucaaauucuggcuauauacuccaccguggcgagcucuuuggucauggugguuucacucggagcaaucaguuuuuggaugugcagcaaugguucccugcagugccggauuuguaucuga

SEQ ID NO: 130259 - RNA, 1701 nt, Artificial Sequence
  derived and/or modified sequence opt3 from hemagglutinin__InfluenzaA__AFB77637
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaaggacgugaccaggaggguagaaugaacuacuauuggacacugguggaacccggcgauaagauuacuuucgaggccaccgggaaccuaguggucccuagguacgcuuuugccauggaacggaaugcaggauccggcaucauaauuagcgacacaccaguucaugauugcaacaccacgugucaaacuccgaaaggugcuaucaauacaucgcuccccuuccagaacauucacccuaucaccaucgggaagugcccaaaguaugugaaaucuacuaagcugcgccuugccacaggacugagaaauguacccuccauucagucaaggggcuuguuuggcgcgauagccggguucaucgagggagguuggaccggcaugguggacgggugguacggauaucaucaccagaacgaacaaggcagugguuacgcagcugaccucaaaagcacgcagaaugccauugauaagaucaccaacaaagucaauuccgugauagagaagaugaacacacaguuuacugcuguugggaaggaguucaaucaccuggaaaaacggauugagaacuuaaauaagaaaguggacgauggcuuccuggacaucuggaccuacaacgccgaacuccuuguccuguuggagaaugaacgcacacuagauuaucaugacucuaacgugaagaaccuguacgagaaaguacgaaaucagcucaagaacaaugcaaaggagaucggaaacggcuguuuugaguucuaucacaaaugcgauaauacuuguauggagagcguuaagaacgggaccuacgacuauccuaaauacucagaagaggccaagcugaauagagaagagauugauggagugaaacuugagaguacaaggaucuaucaaauucuggcuauauacuccaccgucgcgagcucuuuggugcucgucgugucacugggugcaaucaguuuuuggaugugcagcaacggcuccuuacagugccggauuuguaucuga

SEQ ID NO: 130260 - RNA, 1701 nt, Artificial Sequence
  derived and/or modified sequence opt3 from hemagglutinin__InfluenzaA__AFB77638
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguucuauauaaacgauaagggcaaagaaguacugguucuuuggggcauccaccaccccuccacgacugcugaccaacagucauuguaccagaaugccgaugcguacguguuugucgggaccagccgcuauaguaagaaauucaagccugagauugcaauccgaccaaaagugcgugaccaggagggaagaaugaacuacuauuggacacugguggaacccggugauaagauuacuuuugaggccaccggcaaccuagucguuccuagguacgcuuucgccauggaacggaaugcagggucuggaaucauaauuuccgacacaccagugcaugauugcaacaccacgugucaaacuccgaaaggcgcuaucaauacaagccuccccuuucagaacauucacccuaucaccaucgguaagugcccaaaguauguaaaaucgacuaagcugcgccuugccacagggcugagaaaugugcccucuauucaguccaggggauuguucggcgcgauagccggcuuuaucgaagggggauggaccgguauggucgacggcugguacggguaucaucaccagaacgaacaaggaucaggcuacgcagcugaccucaaaaguacgcagaaugccauugauaagaucaccaacaaagugaauagcguuauagagaagaugaacacacaguucacugcuguggguaaggaguucaaucaccuggaaaaacggauugagaacuuaaauaagaaagucgacgauggguuucuggacaucuggaccuacaacgccgaacuccuugugcuguuggagaaugaacgcacacuagauuaucaugacuccaacguaaagaaccuguacgagaaaguucgaaaucagcucaagaacaaugcaaaggagaucggcaacggauguuucgaauuuuaucacaaaugcgauaauacuuguauggagucugugaagaacggcaccuacgacuauccuaaauacagcgaagaggccaagcugaauagagaagagauugauggggucaaacuugagucaacaaggaucuaucaaauucuggcuauauacaguaccguggcguccagcuugguccucgugguuucucugggagcaaucucauucuggaugugcaguaacgguagcuuacagugccggauuuguaucuga

SEQ ID NO: 130261 - RNA, 1701 nt, Artificial Sequence; identical to SEQ ID NO: 128883
  derived and/or modified sequence opt3 from hemagglutinin__InfluenzaA__AFB77639

SEQ ID NO: 130262 - RNA, 1701 nt, Artificial Sequence
  derived and/or modified sequence opt3 from hemagglutinin__InfluenzaA__AFB77640
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagggguuguaccagaaugccgaugcguacguguucgucggaaccagccgcuauaguaagaaauuuaagccugagauugcaauccgaccaaaagugcgugaccaggaggguagaaugaacuacuauuggacacugguggaacccggcgauaagauuacuuucgaggccaccgggaaccuagucguuccuagguacgcuuuugccauggaacggaaugcaggaucuggcaucauaauuuccgacacaccagugcaugauugcaacaccacgugucaaacuccgaaaggugcuaucaauacaagccuccccuuccagaacauucacccuaucaccaucgggaagugcccaaaguauguaaaaucgacuaagcugcgccuugccacaggacugagaaaugugcccucuauucaguccaggggcuuguuuggcgcgauagccggguucaucgagggagguuggaccggcauggucgacgggugguacggauaucaucaccagaacgaacaaggcucagguuacgcagcugaccucaaaaguacgcagaaugccauugauaagaucaccaacaaagugaauagcguuauagagaagaugaacacacaguuuacugcuguggggaaggaguucaaucaccuggaaaaacggauugagaacuuaaauaagaaagucgacgauggcuuccuggacaucuggaccuacaacgccgaacuccuugugcuguuggagaaugaacgcacacuagauuaucaugacuccaacguaaagaaccuguacgagaaaguucgaaaucagcucaagaacaaugcaaaggagaucggaaacggcuguuuugaguucuaucacaaaugcgauaauacuuguauggagucugugaagaacgggaccuacgacuauccuaaauacagcgaagaggccaagcugaauagagaagagauugauggagucaaacuugagucaacaaggaucuaucaaauucuggcuauauacaguaccguggcguccagcuugguccucgugguuucucugggugcaaucucauuuuggaugugcaguaacggcagcuuacagugccggauuuguaucuga

SEQ ID NO: 130263 - RNA, 1701 nt, Artificial Sequence
  derived and/or modified sequence opt3 from hemagglutinin__InfluenzaA__AFB77641
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcgauaauauguguauggaaagcgugaagaacggcacuuacgacuauccuaaauacucagaagaggccaagcugaauagagaagagauugauggggucaaacuugagaguaccaggaucuaucaaauucuggcuauauacuccacaguggcgagcucuuugguccucgugguuucacugggagcaaucaguuuuuggaugugcagcaacgguuccuuacagugccggauuuguaucuga

SEQ ID NO: 130264 - RNA, 1701 nt, Artificial Sequence; identical to SEQ ID NO: 128883
  derived and/or modified sequence opt3 from hemagglutinin__InfluenzaA__AFB77642

SEQ ID NO: 130265 - RNA, 1701 nt, Artificial Sequence
  derived and/or modified sequence opt3 from hemagglutinin__InfluenzaA__AFB77643
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagcccagcuccuggccuaaccacgacucaaauaagggugucacagccgcuuguccacaugcaggggccaaaaguuuuuauaagaaccugaucuggcucgugaaaaagggaaauagcuaccccaaauuaucuaaguccuauauaaacgauaagggcaaagaaguacugguucuuuggggcauccaccacccuucaaccacggcugaccaacagagcuuguaccagaaugccgaugcguacguguucgucgggacuucccgcuauucuaagaaauuuaagccagagauugcaauccgacccaaagugcgugaccaggagggaagaaugaacuacuauuggacccugguggaaccuggugauaagauuacauucgaggccacuggcaaccuagucguuccaagguacgcuuuugccauggaacggaaugcaggguccggaaucauaauuagcgacaccccggugcaugauugcaacacaaccugucaaacgcccaaaggcgcuaucaauacuucgcucccuuuccagaacauucacccaaucacaaucgguaagugccccaaguauguaaaaucuaccaagcugcgccuugccacugggcugagaaaugugccuuccauucagucaaggggauuguuuggcgcgauagccggcuucaucgaagggggauggacagguauggucgacggcugguacggguaucaucaccagaacgaacaaggaaguggcuacgcagcugaccucaaaagcacccagaaugccauugauaagaucacgaacaaagugaauaguguuauagagaagaugaacacccaguuuacagcuguggguaaggaguucaaucaccuggaaaaacggauugagaacuuaaauaagaaagucgacgauggguuccuggacaucuggacuuacaacgccgaacuccuugugcuguuggagaaugaacgcacccuagauuaucaugacucuaacguaaagaaccuguacgagaaaguucgaaaucagcucaagaacaaugcaaaggagaucggcaacggauguuuugaguucuaucacaaaugcgauaauacauguauggaaagcgugaagaacggcacuuacgacgauaccaaagacucagaagaggccaagcugaauagagaagagauugauggggucaaacuugagaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 130266 - RNA, 1701 nt, Artificial Sequence
  derived and/or modified sequence opt3 from hemagglutinin__InfluenzaA__AFB77691
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgaaaaacuuuacauuuggggaguccaccauccuggcacagacaaagaucagaucuuuuuguaugcccaagcuaguggccguauuacugugagcaccaagagaucucagcaggccguaaucccaaauauaggguccaggcugcggguucgcaacauucccucaagaaucagcauuuacuggacaaucgugaaaccuggagacauccuacucauuaauaguaccgguaaccugaaugcgccaaggggcuacuucaagauacggucugggaaauccagcaucaugcgcucggaugcaccgauuggaaaguguaacucugagugcaucacgcccaauggcuccauaccuaacgacaagccauuucagaaugucaaccgaauuacuuauggugccugucccagauacgugaaacaaaauacacuuaagcuggcuaccgggaugaggaacgugccugaaaaacagacucggggaaucuucggcgccaucgcaggcuuuauugagaaugggugggagggaauggucgacgguugguauggcuuccgucaccagaacucagaagggcgcggacaagcugccgauuugaagaguacacaggcggccaucgaccagauuaacggcaaacucaauagacugauagguaagaccaacgagaaauuccaccagaucgaaaaggaguuuagcgaaguugaggggaggauucaagauuuagagaaguacguggaagacacgaaaaucgaucugugguccuauaaugcagagcuccuuguagcucuggaaaaccagcauaccaucgacuugacagauucugagaugaauaagcuauucgaaaagacuaagaaccagcugcgggagaaugccgaggacaugggcaacggaugcuuuaaaauuuaccacaagugugauaauaccugcauaggcagcauccgaaacgggacauaugaccaugaugcuuaccgcgacgaagcccucaauaacagauuccagauuaagggaguggagcugaaaucagguuacaaggacuggauccuuuggauuaguuuugcaaucuccugcuuccuguugugugucgcccuccugggcuuuauaaugugggcuugccaaaaagggaauaucagguguaacauuugcaucuga

SEQ ID NO: 130267 - RNA, 1701 nt, Artificial Sequence
  derived and/or modified sequence opt3 from hemagglutinin__InfluenzaA__AFB77692
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaagcuaguggccguauuacugugagcaccaagagaucucagcaggccguaaucccaaauacaggguccaggccccggguucgcaacauaccuucaagaauuagcaucuacuggaccauugugaaaccaggagauauccugcuaaucaauaguacggguaaccucauugcgccgaggggcuacuucaagauacggucugggaaauccagcaucaugcgcucggacgcacccauuggaaaguguaauucugaaugcaucacuccuaacggcuccauaccaaaugacaagcccuuucagaacgucaaucgaauuacauauggugccuguccuagauacgugaaacaaaacacccugaaacuugcuacugggaugaggaaugugccagagaagcagacacggggaaucuucggcgccaucgcaggcuuuauugaaaacgggugggagggaauggucgaugguugguauggcuuccgucaccaaaauucagaggggcgcggacaggcugccgaccugaagaguacccaggcggccaucgaucagauuaacggcaaauugaacagacucauagguaagacgaaugaaaaauuccaccagaucgagaaggaauuuagcgagguugaagggaggauucaagaccuggagaaguacguggaggauaccaaaaucgacuuaugguccuauaacgcagaacugcucguagcucuugagaaucagcauacaaucgaucugacugacucugaaaugaacaaguuguucgagaaaaccaagaaacagcuacgggaaaaugccgaggauaugggcaacggaugcuuuaagauuuaccacaagugugacaaugcuugcauaggcagcauccgaaacgggacauaugaucaugacguguaccgcgacgaggcccugaauaacagauuccagauuaaaggagucgaacucaagucagguuacaaagauuggauccuguggauuaguuuugcaaucuccugcuuccuucuguguguggccuugcucggcuuuauaaugugggcuugccaaaaggggaauaucagguguaacauuugcaucuga

SEQ ID NO: 130268 - RNA, 1701 nt, Artificial Sequence; identical to SEQ ID NO: 129798
  derived and/or modified sequence opt3 from hemagglutinin__InfluenzaA__AFB77693

SEQ ID NO: 130269 - RNA, 1701 nt, Artificial Sequence
  derived and/or modified sequence opt3 from hemagglutinin__InfluenzaA__AFB77694
augaagaccaucauugcccugagcuacauacucugccuuguguucgcucagaaacugcccggcaacgacaauuccacagcaacuuuguguuuagggcaccaugccgucccuaacggaacgaucguuaagaccauugcgaaugaucaaaucgaggugacaaacgcuacugaacugguacaaaauucuucaaccggugagauuugcgacaguccacaccagauccuagauggcgaaaacuguacacucauagacgcccugcuuggggauccgcagugcgacgauuuucagaauaaaaagugggaccuguucguggagagaagcaaagcauauuccaacuguuaccccuaugaugucccugacuacgccucuuugaggucgcucguggcuucaagcggaacccuggaauuuaauaacgagaguuucaauuggacuggcguuacacagaacgguaccuccucugcaugcauccggcgcagcaauaacuccuuuuucucacgacugaauuggcucacgcauuuaaacuuuaaguauccagcccugaacgugacuaugcccaauaacgagcaguucgauaaacuuuacauuuggggaguccaccauccugggaccgacaaggaucagaucuuuuuguaugcucaagccaguggccguauuacagugagcacuaagagaucucagcaggcgguaaucccaaauauaggcuccaggccccggguucgcaacauuccuucaagaaucagcauuuacuggaccaucgugaaaccaggggacauccugcuaauuaauaguacaggaaaccucauagcaccgagggguuacuucaagauccggucuggcaaauccagcauuaugcgcucggacgcccccaucgggaaguguaauucugaaugcauaaccccuaacggauccauuccaaaugauaagcccuuucagaacgucaaucgaaucacguauggcgcuuguccuagauacgugaaacaaaacacucugaaacuugccacagguaugaggaaugugccagagaagcagacccgggggaucuucggagcaauugcuggcuuuaucgaaaacggcugggaggggauggucgacggaugguaugguuuccgucaccaaaauucagagggccgcgggcaggccgcggaucugaagaguacucaggccgcaauugaccagauaaacggaaaauugaacagacucaucggcaagacaaaugaaaaauuccaccagauugagaaggaauuuagcgagguugaagguaggauccaagaucuggagaaguacguggaggacaccaaaaucgauuuaugguccuauaacgcugaacugcucguagcccuugagaaucagcauacgauugaccugaccgauucugaaaugaacaaguuguucgagaaaacaaagaaacagcuacgggaaaaugcugaggacauggggaacggcugcuuuaagauauaccacaagugugauaauacuugcaucggaagcauucgaaacggcaccuaugaccaugacguguaccgcgaugaggcccugaauaacagauuccagaucaaaggggucgaacucaagucaggauacaaagacuggauucuguggaucaguuuugcaauauccugcuuccuucuguguguggccuugcucgguuuuaucaugugggcuugccaaaagggcaauauuagguguaacaucugcauuuga

SEQ ID NO: 130270 - RNA, 1701 nt, Artificial Sequence
  derived and/or modified sequence opt3 from hemagglutinin__InfluenzaA__AFB77695
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcgaaaacuguacccucauagacgcucugcuuggggauccgcagugcgacgauuuucagaauaaaaagugggaccuguucguggagagaagcaaagccuauuccaacuguuaccccuaugaugucccugacuacgcaucuuugaggucgcucguggccucaagcggaacucuggaauuuaauaacgagaguuucaauuggacaggcguuacccagaacgguacguccucugcuugcauccggcgcagcaauaacuccuuuuucucacgacugaauuggcucacucauuuaaacuuuaaguauccagcacugaacgugaccaugcccaauaacgagcaguucgauaaacuuuacauuuggggaguccaccauccugggacagacaaggaucagaucuuuuuguaugcccaagcuaguggccguauuacugugagcaccaagagaucucagcaggccguaaucccaaauauaggcuccaggccccggguucgcaacauuccuucaagaaucagcauuuacuggacaaucgugaaaccaggggacauccugcuaauuaauaguaccggaaaccucauagcgccgagggguuacuucaagauccggucuggcaaauccagcauuaugcgcucggacgcacccaucgggaaguguaauucugaaugcauaacgccuaacggauccauuccaaaugauaagcccuuucagaacgucaaucgaaucacuuauggcgccuguccuagauacgugaaacaaaacacacugaaacuugcuaccgguaugaggaaugugccagagaagcagacucgggggaucuucggagccauugcaggcuuuaucgaaaacggcugggaggggauggucgacggaugguaugguuuccgucaccaaaauucagagggccgcgggcaggcugccgaucugaagaguacacaggcggccauugaccagauaaacggaaaauugaacagacucaucggcaagaccaaugaaaaauuccaccagauugagaaggaauuuagcgagguugaagguaggauccaagaucuggagaaguacguggaggacacgaaaaucgauuuaugguccuauaacgcagaacugcucguagcucuugagaaucagcauaccauugaccugacagauucugaaaugaacaaguuguucgagaaaacuaagaaacagcuacgggaaaaugccgaggacauggggaacggcugcuuuaagauauaccacaagugugauaaugcuugcaucggaagcauucgaaacggcaccuaugaccaugacguguaccgcgaugaggcccugaauaacagauuccagaucaaaggggucgaacucaagucaggauacaaagacuggauucuguggaucaguuuugcaauauccugcuuccuucuguguguggccuugcucgguuuuaucaugugggcuugccaaaagggcaauauuagguguaacaucugcauuuga

SEQ ID NO: 130271 - RNA, 1701 nt, Artificial Sequence
  derived and/or modified sequence opt3 from hemagglutinin__InfluenzaA__AFB78126
augaagaccaucauugcccugagcuacauacucugccuuguguucgcucagaaacugcccggcaacgacaauuccacagcaacuuuguguuuagggcaccaugccgucucuaacggaacgcugguuaagaccaucacaaaugaucaaauugaggugacuaacgcgaccgaacuuguacagucaaguagcacagguagaaucugcgacuccccucaccagauucucgauggcgagaauuguacccugaucgacgcccuucugggggauccacauugcgacggauuucagaacaaagaaugggauuuguucguggagaggucuaaggcuuauucgaauuguuacccguaugacguccccgauuacgcaucacuccggagccugguggccaguuccggcacucuggaauuuaacaaugagucuuucaacuggacagguguugcucaagacgggaccagcuccgcaugcaaacgccgaucaaauaagagcuuuuucagccgucucaacugguuacaccagcugaaguauaaauacccugcccuuaaugugacgaugccaaacaaugagaaguuugauaaauuguauauauggggaguccaucaccccucuacugacuccgaucagaucucaauuuacgcucaggccagcggcagagugaccguaaguacaaagaggucucaacagacuguuaucccuaacauuggcuccagcccaugggugcgcggggcgucgucucggaucuccauauacuggaccauugucaaacccggagacauccugcuaauuaacucaacagguaaucucaucgcaccuagaggcuauuucaagaucaggagugggaagaguuccauuaugcggucugacgccccaauaggaaaauguaacagcgaaugcaucaccccgaauggcucaauucccaacgauaagccuuuucagaaugugaaccgcaucacguacggugcuuguccacgauaugugaaacagaauacucugaagcuagccacagggaugagaaacguccccgagaaacaaaccaggggaauauucggcgcaauugcuggcuuuaucgaaaaugggugggagggaaugguugacgguugguacggcuuccggcaccagaacagugaggggacuggacaggccgcggaucugaaguccacacaagccgcaaccaaucagaucaacggcaaauugaaucgucucauugaaaagacgaacgagaaguuucaucagaucgaaaaagaguucagcgaaguggagggucgcauucaggaccuggagaaguauguagaagauaccaaaauagacuuauggucuuacaaugcugagcugcucguggcccuugaaaaccaacacacaaucgaucugacugacucagagaugaacaaguuguucgaaagaaccaaaaagcagcuaagggagaaugcugaggauauggggaacggcugcuuuaagauuuaucauaaaugugacaaugccugcaucggaaguauccggaacggcacauacgaucacgacgucuaccgagacgaagcacugaauaaccgcuuccagauuaaggggguggagcucaaaagcggauauaaggauuggauacuguggaucuccuuugccauuucuugcuuccuucuguguguuguguugcucgguuuuaucaugugggcuugccagaaaggcaauauuagauguaacaucugcauauga

SEQ ID NO: 130272 - RNA, 1701 nt, Artificial Sequence
  derived and/or modified sequence opt3 from hemagglutinin__InfluenzaA__AFC34056
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaaaggacacugaaacuugccaccgggaugcggaacgugccagagaagcagacucguggaauuuucggcgcuaucgccggcuuuauugaaaaugggugggagggaaugguggaugguugguauggcuuccgccaccagaacuccgaggggagaggacaagcagcugaccugaagucuacacaggccgcgauagaucagaucaauggcaaauugaacaggcucauugguaagaccaaugaaaaauuccaccagaucgagaaggaauuuagcgaggucgaagggcggauccaagaccuggagaaguacguugaggauacgaaaauugacuuauggucauauaacgccgaacugcucguggcacuugagaaccagcauaccauagaucugacagacagugaaaugaauaaguuguucgagaaaacuaagaaacagcuacgagaaaacgcugaggauaugggcaauggaugcuuuaagaucuaccacaagugugacaacgccugcauuggcuccauccgcaaugggaccuauaaccaugauguauacagagacgaggcucugaauaacagguuccagauuaaaggaguggaacucaagagcgguuacaaagacuggauccuguggauaucuuuugccaucucaugcuuccuucugugugucgcauugcucggcuuuauuaugugggccugccaaaaggggaauauccgguguaacauuugcaucuga

SEQ ID NO: 130273 - RNA, 1701 nt, Artificial Sequence; identical to SEQ ID NO: 130272
  derived and/or modified sequence opt3 from hemagglutinin__InfluenzaA__AFC34057

SEQ ID NO: 130274 - RNA, 1701 nt, Artificial Sequence
  derived and/or modified sequence opt3 from hemagglutinin__InfluenzaA__AFD32426
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucuguaaacugagaggagucgcaccccuucaucuggguaagugcaacauagccggcaggaucuuggggaauccugagugugaaagucucagcacugcuuccucuuggucguauauuguggagaccccaucaagcgauaacggaacaugcuacccgggcgacuucaucgauuaugaagaacugcgggagcagcugaguuccguuucuagcuuugaacgcuucgagauuuuucccaaaaccuccucauggccuaaucacgacaguaacaagggugugacugcagccuguccacaugcuggggccaagagcuucuacaaaaaucucaucugguuagucaagaaaggaaacucuuaucccaagcuguccaaaucauacauaaaugauaagggcaaggaagugcuuguauuguggggcauccaccacccuagcacaagugcggaccaacagucucuguaucagaacgcagauaccuacguuuuugugggguccagccgauacucgaaaaaguucaaaccagagauugccauccgucccaaggucagagaccaggagggaaggaugaauuauuacuggacgcuaguggaaccuggugauaaaauuacuuuugaggcuaccggcaaccucguggucccacgguaugccuucgcaauggaacgcaacgcugggucuggaaucauaauuuccgacacaccgguucaugacugcaauacuaagugucaaacaccccugggcgccaucaacucaagucuuccuuaccagaauauucacccagugaccaucggugagugccccaaauauguaagaagcgcgaagcugaggauggugaccggguugcggaacacgccuuccauccagucucgcggacucuuuggcgccauugcaggcuucauagaagggggauggacugguaugaucgauggcugguacggguaucaucaccagaaugagcaaggaagcggcuacgcugccgaccagaagucaacacagaacgcuauuaaugguaucaccaacaaagucaauacugugauagagaagaugaacauucaguuuacagccguugggaaagaguucaauaagcuggagaaacgaauggaaaacuuaaauaagaagguggaugacggcuuucuggauaucuggaccuacaacgcagagcuccuuguccuguuggaaaaugagagaacgcuagacuuccacgauaguaacgugaaaaaccuguaugagaagguaaaaucccaacucaagaauaacgccaaagaaaucggaaauggcuguuucgaguuuuaccauaagugcgacaacgaauguauggagagcguuaggaaugggaccuaugauuacccaaaguauucugaagagucaaaacugaaccgggagaagguggacggagucaaacuugaaaguauggguauuuaccagauccuggcuauuuauagcacaguggcguccucuuugguccuccuggugucguuaggcgcaaucagcuucuggaugugcuccaaugggucacugcagugccguauauguauuuga

SEQ ID NO: 130275 - RNA, 1698 nt, Artificial Sequence
  derived and/or modified sequence opt3 from hemagglutinin__InfluenzaA__AFD32427
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucugugaucuggacggagucaaaccccuuauacugagagauugcaguguggcagguugguugcucggcaacccuaugugugacgaguucaucaauguuccagaauggagcuauauuguggagaaggccaacccggucaaugaucugugcuaccccggggacuuuaacgauuaugaagaacugaaacaucucuuauccaggaucaaucacuucgagaagauucagaucauaccuaagucuucguggucaagccaugaagcuagucugggaguguccucugcauguccauaccaaggcaaaagcuccuuuuuccggaacguaguuuggcuuaucaagaaaaauucaacuuaucccaccauuaagcgcaguuacaacaauacaaaccaggaggacuugcuggugcuaugggguauccaccacccuaacgaugccgcugaacagaccaaacucuaucagaauccaacuacauacauuagcgucgggaccucuacgcugaaccaacgacuugugccccguaucgccacuagauccaaggugaauggacagucaggcaggauggaguuuuucuggaccauacugaagccuaacgacgcgauuaauuuugagagcaacggcaauuucaucgcaccagaauacgccuauaaaauugucaagaaaggggacaguacaaucaugaagucugaguuggaauacggaaacugcaauacuaaaugucagaccccgcucggugcuaucaacuccagccugcccuaucagaauauucauccuguuacaauaggcgagugcccaaaguacgugcggucggccaaauuacgcaugguaaccgggcugagaaacacgcccucuauccaauccaggggacucuuuggcgcaauugcugguuucaucgaagggggauggacuggcaugauagauggcugguauggguaccaccaucagaaugagcagggaucagguuaugccgcggaccagaagaguacacaaaacgccauuaauggcaucaccaacaaggugaacacugucaucgagaaaaugaauauucaguuuacagcaguggggaaggaguucaacaaacuugagaagcggauggaaaaucugaacaaaaagguugaugacggauuuuuggauaucuggaccuacaaugcugagcuacuggugcuccuggaaaacgagcgcacgcuugacuuccacgauagcaaugucaagaaccuguacgagaaagugaagucccaguugaaaaauaacgccaaggaaauuggcaaugguuguuucgaguuuuaucacaaaugcgacaacgaauguauggagucuguacgaaaugggaccuacgauuauccuaaguacagcgaagagucaaagcucaacagagagaaaguugacggcgugaagcuggaaaguaugggaauauaucaaaucuuagcuauuuacuccacagucgccagcucucuggugcuacucgucucacugggcgcaaucaguuucuggaugugcagcaaugggucccuucagugcaggaucuguauuuga

SEQ ID NO: 130276 - RNA, 1722 nt, Artificial Sequence
  derived and/or modified sequence opt3 from hemagglutinin__InfluenzaA__AFD32428
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgaccuagauggcgugaaaccacucauccugagagacuguagcgucgcuggguggcuucugggaaauccgaugugcgaugaauuuauaaacgugcccgagugguccuauaucguugaaaaggccaauccugugaacgacuuguguuacccaggcgauuucaaugacuaugaggagcucaaacaucugcugucuaggauuaaccacuuugaaaagauccagauuauccccaagucgucauggagcagucacgaggcaucccucggugucucuagcgccugcccuuaccaggggaaauccucauucuuucggaaugugguaugguuaauaaagaaaaacaguaccuauccaacuauuaagcgcagcuacaauaacacaaaucaagaagaucugcuuguuuuguggggaauccaucaccccaacgacgcugcagagcagaccaaacuguaucagaacccuacgacuuacauuucugugggcaccuccacacuaaaucagcgacucgucccacguaucgccacuagaucaaaggugaacggccaaagcgggaggauggaguucuuuuggaccauccugaagccgaaugaugcuauuaacuucgaaaguaauggaaacuuuauagcccccgaguacgcguauaaaaucgugaagaaaggugacucuacaauuaugaaguccgaacuugaguacggcaauuguaacagcgaaugcaucaccccuaaugggucgauaccaaacgauaaacccuuccagaaugucaaccggauuacguauggagcauguccucgcuacguuaagcagaauacucugaaauuggccacaggcaugagaaacgugccagagaagcagaccagggguaucuuuggggcuaucgccggauucauugagaauggcugggaaggcaugguagacgggugguauggauuucggcaccaaaacucugagggucgcggccaggcagcugaccucaaguccacucaggccgcgaucgaucaaauuaacgggaaacugaaucgauuaauaggaaagacaaacgaaaaauuccaucagaucgagaaggaguucucagaaguggagggcaggauucaggaccuggaaaaauacgucgaggauaccaagaucgaccucuggaguuauaaugccgaacuucugguggcauuggagaaccagcacacgaucgaucuaaccgacagcgaaaugaauaagcuguuugagaaaacaaagaaacaacucagagagaacgcugaagauauggguaaugggugcuucaagauuuaccauaaaugugacaacgccugcauaggcuccauccggaauggaacuuacgaucacgacguuuaucgugaugaggcucugaacaaucgcuuucagauuaagggcguggaacuuaagucuggguacaaagacuggauccuguggauuagcuucgccaucucaugcuuuuugcucugugucgcacuguuaggauucauaaugugggccugccagaaggguaacaucagauguaauauuugcaucuga

SEQ ID NO: 130277 - RNA, 1704 nt, Artificial Sequence
  derived and/or modified sequence opt3 from hemagglutinin__InfluenzaA__AFD32429
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcacccagggcaaaagaccaacugaccuagggcaguguggacuccugggcacacuuaucgguccgccccaaugcgaucaguuucuggaguucgacgcugauuugauaaucgaaaggcgggaagggaccgacguguguuauccuggaaaguuuacgaaugaggagagccuccgccagauucugcgaggcuccggcgggaucgauaaagaaucuaugggauucacuuacucggguauucguaccaacggcgccacaucagcaugcagaaggagcgggaguuccuuuuaugccgagaugaaguggcugcucucuaauagcgacaacgcugaguucccacagaugacuaaguccuaccggaauccccgcaacaaaccugcauuaaucauauggggaguccaccauucaggcagugccaccgaacaaacaaagcuguaugguagcgggaauaaacuuauuaccgugggaucuuccaaguaccagcagucauuuacgccaagccccggcgcuagaccucagguuaacggccaaagugggaggaucgauuuccacugguugcugcuagacccaaaugauacugugacauuuaccuucaacggagccuuuauugcgccggaccgggcaucuuucuuucgcggugagucccucggcguccagagcgaugugccccuggacucgggguguaauucugaaugcaucacuccuaacggauccaucccaaacgacaaacccuuccagaauguaaaccgaauuacauauggcgccuguccuagauacguuaagcaaaauacccuuaagcuggcuacggguaugaggaacgugccagagaaacagacccgggggauauucggcgccaucgcaggauuuauugaaaauggcugggaggggauggucgauggaugguacgguuuccgucaucagaacucagaaggccgcgggcaggcugccgacuugaagaguacacaagcggccaucgaucagauaaauggaaaacucaacagacugauuggcaagacuaaugagaaauuucaccagaucgagaaggaguucagcgaaguggaagguaggauccaggacuuagagaaauauguggaagauaccaagauugaccugugguccuacaacgcagagcuccuugucgcucuggagaaucaacacacaaucgauuugacugacucugaaaugaacaagcuauuugagaaaaccaagaaacagcugcgggaaaaugccgaggauauggggaacggcugcuucaagauuuaucauaaaugugacaaugcuugcauaggaagcauccgaaacggcacauacgaucacgacguuuaucgcgacgaagcccucaacaauagauuucagauuaaggggguggagcugaagucaggauacaaagauuggauccuuuggaucaguuucgcaauuuccugcuuucuguuguguguagcccuccuggguuucauaaugugggcuugccagaagggcaacaucagguguaauauuugcaucuga

SEQ ID NO: 130278 - RNA, 1701 nt, Artificial Sequence; identical to SEQ ID NO: 122089
  derived and/or modified sequence opt3 from hemagglutinin__InfluenzaA__AFD63527

SEQ ID NO: 130279 - RNA, 1701 nt, Artificial Sequence
  derived and/or modified sequence opt3 from hemagglutinin__InfluenzaA__AFD63538
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucaaucguggccagcagugguacucucgaguuuaacaaugaauccuucaacuggacagggguuacccagaauggaacgucuagcgcuugcaagcggaaguccaacaaaucauuuuucagucgccugaauuggcugacucaucucaaguauaaauacccagcauuaaacgugaccaugcccaauaacgagaaguuugacaaacuguauauuuggggcguccaccauccuggcacagauaacgaccagaucagccuuuacgcccaggcuucugggcgaauuacuguguccaccaagcguucacaacagacaguaaucccaaauauaggaagcagacccaggguucgggaugugaguucucgcauuuccaucuacuggaccauugucaagccuggugacaucuugcugaucaacagcacgggcaaucuaauugccccaagaggguauuucaaaauaaggucgggaaagucuuccaucaugcggucagacgcgccgauuggcaaauguaacagugagugcaucacucccaaugguagcauaccuaacgauaagccauuucagaaugugaaccgcauuacauacggggcauguccccgauaugugaaacagaauacccucaagcuggccacuggaaugagaaacgucccugaaaaacaaacaaggggcaucuucggcgcuaucgccggguuuauugagaauggaugggaagguaugguugacggcugguacggguuccggcaccagaacuccgagggaaccggccaggcagcugaucuuaagucuacgcaagccgcgaucaaucagauuaacgguaagcugaaucguuugauagggaaaaccaacgagaaguuucaccagaucgaaaaagaguucagcgaaguggagggccgcauucaggaccucgaaaaguauguagaggauacaaaaaucgaccuguggucauacaacgccgaguuacugguggcacucgaaaaucaacauacuaucgaucuuaccgacagugagaugaacaagcuguucgaaagaacaaagaaacaguugagggagaaugcugaagauaugggaaacggcugcuuuaagauuuaucacaaaugugacaaugccugcauaggguccauccggaacggaacuuacgaucaugacgucuaccgagacgaggcucuaaauaaccgcuaucagauuaaggguguggagcugaaaagcggcuacaaggauuggauccucuggauuucuuucgccaucucaugcuuucugcuuuguguugcacuguugggguucauaaugugggccugccagaagggaaauaucagauguaacauuugcaucuga

SEQ ID NO: 130280 - RNA, 1701 nt, Artificial Sequence
  derived and/or modified sequence opt3 from hemagglutinin__InfluenzaA__AFD63549
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacaacgaucagaucaguuuguacgcccaggcuagcgggcguauuacugugucuaccaagagaucccaacagacaguaaucccaaacauaggaucaaggccccggguucgcgacgugagcaguagaauuucuaucuacuggaccauugucaagccuggugacauccugcuaaucaauuccacgggcaaccucauugccccaaggggguauuucaagauacggagcggaaaaucgucuaucaugcgcuccgaugcgccgauuggcaaguguaauucagagugcaucacucccaacgguaguauaccuaaugacaaaccauuucagaacgugaaucgaauuacauacggggcaugucccagauaugugaagcagaacacccugaaacuugccacuggaaugaggaaugucccugaaaagcaaacacggggcaucuucggcgcuaucgccggguuuauugagaacggaugggaagguaugguugauggcugguacggguuccgucaccagaauagcgagggaaccggccaggcagcugaccugaaauccacgcaagccgcgaucaaccagauuaaugguaaguugaaccgccucauagggaagaccaaugagaaauuucaccagaucgaaaaggaguucucugaaguggagggcaggauucaggaucuggaaaaauauguagaggacacaaagaucgauuuauggagcuacaacgccgagcugcucguggcacuugaaaaccaacauacuaucgaccugaccgauucagagaugaauaaauuguucgaaagaacaaagaagcagcuacgggagaacgcugaagacaugggaaauggcugcuuuaaaauuuaucacaagugugauaacgccugcauagggaguauccgaaauggaacuuacgaccaugacgucuaccgcgaugaggcucugaacaauagauuccagauuaaagguguggagcucaaguccggcuauaaagacuggauccuguggauuagcuuugccaucucuugcuuccuucuguguguugcauugcucggguuuauaaugugggccugccagaagggaaacaucagguguaauauuugcaucuga

SEQ ID NO: 130281 - RNA, 1701 nt, Artificial Sequence; identical to SEQ ID NO: 122089
  derived and/or modified sequence opt3 from hemagglutinin__InfluenzaA__AFD63571

SEQ ID NO: 130282 - RNA, 1701 nt, Artificial Sequence
  derived and/or modified sequence opt3 from hemagglutinin__InfluenzaA__AFD63615
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaaaucauuuuucagucgccugaauuggcucacucauuuaaaguauaaauacccagcacugaacgugaccaugcccaauaacgagaaguuugacaaacuuuauaucuggggcguccaccauccuggcacagauaacgaccagauuagcuuguacgcccaggcuucugggcgaaucacuguguccaccaagcguucacaacagacaguaauuccaaauaucggaagcagacccaggguucgggaugugaguucucgcauauccauuuacuggaccaucgucaagccuggugacauucugcuaaucaacagcacgggcaaucucaucgccccaagaggguauuucaaaauuaggucgggaaagucuuccauaaugcggucagacgcgccgaucggcaaauguaacagugagugcauuacucccaaugguagcaucccuaacgauaagccauuucagaaugugaaccgcauaacauacggggcauguccccgauaugugaaacagaauacccugaaacuugccacuggaaugagaaacgucccugaaaagcaaacaaggggcauuuucggcgcuaucgccggguuuaucgagaauggaugggaagguaugguugacggcugguacggguuccggcaccagaacuccgagggaaccggccaggcagcugaucugaagucuacgcaagccgcgauuaaucagaucaacgguaaguugaaucgucucauugggaaaaccaacgagaaguuucaccagauagaaaaagaguucagcgaaguggaggaacgcauccaggaccuggagaaguauguagaggauacaaaaauugacuuauggucauacaacgccgaacugcucguggcacuugagaaucaacauacuaucgaucugaccgacagugaaaugaacaaguuguucgagagaacaaagaaacagcuaagggaaaaugcugaggauaugggcaacggaugcuuuaagaucuaucacaaaugugacaaugccugcauuggcuccauacggaacgggacuuacgaucaugacgucuaccgagacgaggcucugaauaaccgcuuccagaucaagggaguggaacucaaaagcgguuauaaggauuggauucuguggaucucuuuugccauuucaugcuuccuucuguguguugcauugcucggcuuuaucaugugggccugccagaaggggaauauaagauguaacaucugcauuuga

SEQ ID NO: 130283 - RNA, 1701 nt, Artificial Sequence
  derived and/or modified sequence opt3 from hemagglutinin__InfluenzaA__AFD63626
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacagugaucagaucagcuuguacgcccaggcuucugggcguauuacuguguccaccaagagaucacaacagacaguaaucccaaacauaggaagcaggccccggguucgcgacauuaguucuagaaucuccauuuacuggaccaucgugaagccuggugacauccugcuaauuaacagcacgggcaaucucauagccccaaggggguauuucaagauccggucgggaaaaucuuccauuaugcgcucagaugcgccgaucggcaaguguaacagugagugcauaacucccaaugguagcauuccuaacgacaaaccauuucagaaugucaaccgaaucacauacggggcaugucccagauaugugaagcagaauacccugaaacuugccacuggaaugaggaacgugccugaaaagcaaacacggggcaucuucggcgcuauugccggguuuaucgagaauggaugggaagguauggucgauggcugguacggguuccgucaccagaacuccgagggaaccggccaggcagcugaccugaaaucuacgcaagccgcgauuaaucagauaaacgguaaguugaaucgccucaucgggaagaccaacgagaaauuucaccagauugaaaaggaguucagcgaaguugagggcagaauccaggaucuggaaaaauauguggaggacacaaagaucgauuuauggucauacaaugccgagcugcucguagcacuugaaaaccaacauacuauugaccugaccgauagugagaugaacaaauuguucgaaaggacaaagaagcagcuacgggagaaugcugaagacaugggaaacggcugcuuuaaaauauaucacaagugugauaaugccugcaucggguccauucgaaacggaacuuacgaccaugacguguaccgcgaugaggcucugaauaacagauuccagaucaaaggugucgagcucaagagcggcuauaaagacuggauucuguggaucucuuuugccauaucaugcuuccuucuguguguggcauugcucggguuuaucaugugggccugccagaagggaaauauuagguguaacaucugcauuuga

SEQ ID NO: 130284 - RNA, 1701 nt, Artificial Sequence
  derived and/or modified sequence opt3 from hemagglutinin__InfluenzaA__AFD63637
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucuacuugcaagcggcgcagcaauaaguccuuuuucucacgacugaacuggcucacccauuuaaaauauaaguacccagcucugaaugugacaaugcccaacaaugagaaauuugauaaacuuuauauuuggggcguccaccauccuggcacugacagugaucagaucagcuuguacgcacaggccucugggcguauuaccguguccacaaagagaucacaacagaccguaaucccaaacauaggaagcaggccccggguucgcgacgugaguucuagaauuuccaucuacuggacgauugucaagccuggugacauccugcuaaucaacagcacuggcaaucucauugcuccaaggggguauuucaagauacggucgggaaaaucuuccaucaugcgcucagaugccccgauuggcaaguguaacagugagugcaucacacccaaugguagcauaccuaacgacaaaccauuucagaaugugaaccgaauuaccuacggggcgugucccagauaugugaagcagaauacucugaaacuugcaacaggaaugaggaacgucccugaaaagcaaacccggggcaucuucggcgccaucgcuggguuuauugagaauggaugggaagguaugguugauggcugguacggguuccgucaccagaacuccgagggaacgggccaggccgcagaccugaaaucuacccaagcugccaucaaucagauuaacgguaaguugaaucgccucauagggaagacaaacgagaaauuucaccagaucgaaaaggaguucagcgaaguggagggcaggauucaggaucuggaaaaauauguagaggacacuaagaucgauuuauggucauacaaugcggagcugcucguggcccuugaaaaccaacauaccaucgaccugacagauagugagaugaacaaauuguucgaaagaacuaagaagcagcuacgggagaaugcagaagacaugggaaacggcugcuuuaaaauuuaucacaagugugauaaugcuugcauaggguccauccgaaacggaaccuacgaccaugacgucuaccgcgaugaggcccugaauaacagauuccagauuaaagguguggagcucaagagcggcuauaaagacuggauccuguggauuucuuuugcuaucucaugcuuccuucuguguguugccuugcucggguuuauaaugugggcaugccagaagggaaauaucagguguaacauuugcaucuga

SEQ ID NO: 130285 - RNA, 1701 nt, Artificial Sequence
  derived and/or modified sequence opt3 from hemagglutinin__InfluenzaA__AFD63648
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacagauuucuucaaccgguggcaucugcgacaguccacaccagauacuagauggggagaauuguacacucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacccuggaguuuaacaaugaaaguuucgacuggacugggguuacacagaacggaaccuccucugcuugcaagcggcgcagcaauaaguccuuuuucucacgacugaacuggcucacgcauuuaaaauauaaguacccagcacugaaugugacuaugcccaacaaugagaaauuugauaaacuuuauauuuggggcguccaccauccuggcaccgacagugaucagaucagcuuguacgcccaggcuucugggcguauuacaguguccacuaagagaucacaacagaccguaaucccaaacauaggaagcaggccccggguucgcgacgugaguucuagaauuuccaucuacuggacaauugucaagccuggugacauccugcuaaucaacagcaccggcaaucucauugccccaaggggguauuucaagauacggucgggaaaaucuuccaucaugcgcucagaugcgccgauuggcaaguguaacagugagugcaucacgcccaaugguagcauaccuaacgacaaaccauuucagaaugugaaccgaauuacuuacggggcaugucccagauaugugaagcagaauacacugaaacuugccaccggaaugaggaacgucccugaaaagcaaacucggggcaucuucggcgcuaucgccggguuuauugagaauggaugggaagguaugguugauggcugguacggguuccgucaccagaacuccgagggaacaggccaggcagcugaccugaaaucuacccaagccgcgaucaaucagauuaacgguaaguugaaucgccucauagggaagacgaacgagaaauuucaccagaucgaaaaggaguucagcgaaguggagggcaggauucaggaucuggaaaaauauguagaggacaccaagaucgauuuauggucauacaaugccgagcugcucguggcacuugaaaaccaacauacaaucgaccugacugauagugagaugaacaaauuguucgaaagaaccaagaagcagcuacgggagaaugcugaagacaugggaaacggcugcuuuaaaauuuaucacaagugugauaaugccugcauaggguccauccgaaacggaacauacgaccaugacgucuaccgcgaugaggcucugaauaacagauuccagauuaaagguguggagcucaagagcggcuauaaagacuggauccuguggauuucuuuugccaucucaugcuuccuucuguguguugcauugcucggguuuauaaugugggccugccagaagggaaauaucagguguaacauuugcaucuga

SEQ ID NO: 130286 - RNA, 1701 nt, Artificial Sequence; identical to SEQ ID NO: 122089
  derived and/or modified sequence opt3 from hemagglutinin__InfluenzaA__AFD63659

SEQ ID NO: 130287 - RNA, 1701 nt, Artificial Sequence
  derived and/or modified sequence opt3 from hemagglutinin__InfluenzaA__AFD63681
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaaaucauuuuucagucgccugaauuggcucacucauuuaaaguauaaauacccagcacugaacgugaccaugcccaauaacgagaaguuugacaaacuuuauaucuggggcguccaccauccuggcacagauaacgaccagauuagcuuguacgcccaggcuucugggcgaaucacuguguccaccaagcguucacaacagacaguaauuccaaauaucggaagcagacccaggguucgggaugugaguucucgcauauccauuuacuggaccaucgucaagccuggugacauucugcuaaucaacagcacgggcaaucucaucgccccaagaggguauuucaaagugaggucgggaaagucuuccauuaugcggucagacgcgccgauaggcaaauguaacagugagugcaucacucccaaugguagcauuccuaacgauaagccauuucagaaugugaaccgcaucacauacggggcauguccccgauaugucaaacagaauacccugaaacuugccacuggaaugagaaacguuccugaaaagcaaacaaggggcauauucggcgcuauugccggguuuaucgagaauggaugggaagguaugguggacggcugguacggguuccggcaccagaacuccgagggaaccggccaggcagcugaucugaagucuacgcaagccgcgaucaaucagauuaacgguaaguugaaucgucucaucgggaaaaccaacgagaaguuucaccagauugaaaaagaguucagcgaaguagagggccgcauacaggaccuggaaaaguauguggaggauacaaaaaucgacuuauggucauacaacgccgagcugcucgucgcacuugaaaaucaacauacuauugaucugaccgacagugagaugaacaaguuguucgaaagaacaaagaaacagcuaagggagaaugcugaagauaugggaaacggcugcuuuaagaucuaucacaaaugugacaaugccugcaucggguccauucggaacggaacuuacgaucaugacguguaccgagacgaggcucugaauaaccgcuuccagauaaaggguguugagcucaaaagcggcuauaaggauuggauccuguggauuucuuuugccaucucaugcuuccuucuguguguggcauugcucggguuuauuaugugggccugccagaagggaaauaucagauguaacauaugcaucuga

SEQ ID NO: 130288 - RNA, 1701 nt, Artificial Sequence
  derived and/or modified sequence opt3 from hemagglutinin__InfluenzaA__AFD63692
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcgucuugcacccuggcacagacagcgaucagauuucucuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucuacucaucaacucgacgggcaaucugaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccuuaaacuggccacuggaaugaggaacgucccugaaaagcaaacacggggcauuuucggcgcuaucgccggguuuaucgagaauggaugggaagguaugguugauggcugguacggguuccgucaucagaacucugagggaaccggccaggcagcugacuugaaaagcacgcaagccgcgauuaaucagaucaacgguaagcucaaucgccugauugggaagaccaacgagaaauuucaccagauagaaaaggaguucucagaaguggagggcagaauccaggauuuagaaaaauauguagaggacacaaagauugaucuguggaguuacaaugccgagcuccuuguggcacuggaaaaccaacacacuaucgacuugaccgauuccgagaugaacaaacuauucgaaaggacaaagaagcagcugcgggagaaugcugaagacaugggaaacggcugcuuuaaaaucuaucauaagugugauaaugccugcauugggagcauacgaaacggaacuuacgaccacgacgucuaccgcgaugaggcucucaauaacagauuccagaucaaagguguggagcugaagucuggcuauaaagacuggauucuuuggaucucauuugccauuaguugcuuccuguuguguguugcacuccugggguuuaucaugugggccugccagaagggaaauauaagguguaacaucugcauuuga

SEQ ID NO: 130289 - RNA, 1701 nt, Artificial Sequence
  derived and/or modified sequence opt3 from hemagglutinin__InfluenzaA__AFD63703
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaagugguaucugcgacagcccauaucagauacuagauggcgagaauuguacccucaucgacgcucugcuuggggauccgcagugcgacggauuucaaaacaaaaagugggaucuguucguggaaagauccaaagccuacucuaauuguuaucccuacgacgucccugauuaugcaucguugaggucacucguggccagcaguggcacucuggaguuuaacaaugaauccuucgacuggacagguguuacccagaacgggacgucuagcgcuugcaagcggcgcuccaauaagucauuuuucagucgacugaacuggcucacucacuuaaaauacaaguauccagcacugaaugugaccaugcccaacaaugagaaauuugauaaacuuuacauuuggggaguccaucacccuggcacagacagcgaucagaucucuuuguacgcccaggcuuccggccguauuacugugucaaccaagagaagccaacagacaguaaucccaaacauagggaguaggccccggguucgcgacgugucuucccagauuagcaucuauuggaccauugucaagccuggagacauccugcuaaucaacucgacggguaaucucauugccccaagaggcuacuucaagauaaggucugggaaauccucaaucaugcggagugaugcgccgauuggaaaguguaacagcgagugcaucacucccaauggcuccauaccuaacgacaaaccauuucagaaugugaaccgcauuacauauggugcauguccccgauacgugaagcaaaauacccugaaacuugccacugggaugagaaacgucccugaaaagcagacaaggggaaucuucggcgcuaucgccggcuuuauugagaaugggugggaaggaaugguugaugguugguauggcuuccggcaucagaacucugaggggaccggacaagcagcugaccugaaaagcacgcaggccgcgaucaaucagauuaacggcaaguugaaucgucucauagguaagaccaacgagaaauuucaccagaucgaaaaggaguucucagaaguggaggggcgcauucaagaucuggaaaaauacguagaggacacaaagaucgauuuauggaguuauaaugccgagcugcucguggcacuugaaaaccagcacacuaucgaccugaccgauuccgagaugaacaaauuguucgaaagaacaaagaagcagcuaagggagaaugcugaagacaugggcaacggaugcuuuaaaauuuaccauaagugugauaaugccugcauaggcagcauccggaacgggacuuacgaccacgacgucuaucgagaugaggcucugaauaaccgcuuccagauuaaaggaguggagcucaagucugguuacaaagacuggauccuguggauuucauuugccaucaguugcuuccuucuguguguugcauugcucggcuuuauaaugugggccugccaaaaggggaauaucagauguaacauuugcaucuga

SEQ ID NO: 130290 - RNA, 1701 nt, Artificial Sequence
  derived and/or modified sequence opt3 from hemagglutinin__InfluenzaA__AFD63714
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucuacuugcaagcggcgcagcaauaaguccuuuuucucacgacugaacuggcucacccauuuaaaauauaaguacccagcucugaaugugacaaugcccaacaaugagaaauuugauaaacuuuauauuuggggcguccaccauccuggcacugacaacgaucagaucaguuuguacgcacaggccagcgggcguauuaccgugucuacaaagagaucccaacagaccguaaucccaaacauaggaucaaggccccggguucgcgacgugagcaguagaauuucuaucuacuggacgauugucaagccuggugacauccugcuaaucaauuccacuggcaaccucauugcuccaaggggguauuucaagauacggagcggaaaaucgucuaucaugcgcuccgaugccccgauuggcaaguguaauucagagugcaucacacccaacgguaguauaccuaaugacaaaccauuucagaacgugaaucgaauuaccuacggggcgugucccagauaugugaagcagaacacucugaaacuugcaacaggaaugaggaaugucccugaaaagcaaacccggggcaucuucggcgccaucgcuggguuuauugagaacggaugggaagguaugguugauggcugguacggguuccgucaccagaauagcgagggaacgggccaggccgcagaccugaaauccacccaagcugccaucaaccagauuaaugguaaguugaaccgccucauagggaagacaaaugagaaauuucaccagaucgaaaaggaguucucugaaguggagggcaggauucaggaucuggaaaaauauguagaggacacuaagaucgauuuauggagcuacaacgcggagcugcucguggcccuugaaaaccaacagaccaucgaccugacagauucagagaugaauaaauuguucgaaagaacuaagaagcagcuacgggagaacgcagaagacaugggaaauggcugcuuuaaaauuuaucauaagugugauaacgcuugcauagggaguauccgaaauggaaccuacgaccacgacgucuaccgcgaugaggcccugaacaauagauuccauauuaaagguguggagcucaaguccggcuauaaagacuggauccuguggauuagcuuugcuaucucuugcuuccuucuguguguugccuugcucggguuuauaaugugggcaugccagaagggaaacaucagguguaauauuugcaucuga

SEQ ID NO: 130291 - RNA, 1701 nt, Artificial Sequence
  derived and/or modified sequence opt3 from hemagglutinin__InfluenzaA__AFD63736
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucuacuugcaagcggcgcagcaauaaguccuuuuucucacgacugaacuggcucacccauuuaaaauauaaguacccagcucugaaugugacaaugcccaacaaugagaaauuugauaaacuuuauauuuggggcguccaccauccuggcacugacaacgaucagaucaguuuguacgcacaggccagcgggcguauuaccgugucuacaaagagaucccaacagaccguaaucccaaacauaggaucaaggccccggguucgcgacgugagcaguagaauuucuaucuacuggacgauugucaagccuggugacauccugcuaaucaauuccacuggcaaccucauugcuccaaggggguauuucaagauacggagcggaaaaucgucuaucaugcgcuccgaugccccgauuggcaaguguaauucagagugcaucacacccaacgguaguauaccuaaugacaaaccauuucagaacgugaaucgaauuaccuacggggcgugucccagauaugugaagcagaacacucugaaacuugcaacaggaaugaggaaugucccugaaaagcaaacccggggcaucuucggcgccaucgcuggguuuauugagaacggaugggaagguaugguugauggcugguacggguuccgucaccagaauagcgagggaacgggccaggccgcagaccugaaauccacccaagcugccaucaaccagauuaaugguaaguugaaccgccucauagggaagacaaaugagaaauuucaccagaucgaaaaggaguucucugaaguggagggcaggauucaggaucuggaaaaauauguagaggacacuaagaucgauuuauggagcuacaacgcggagcugcucguggcccuugaaaaccaacauaccaucgaccugacagauucagagaugaauaaauuguucgaaagaacuaagaagcagcuacgggagaacgcagaagacaugggaaauggcugcuuuaaaauuuaucacaagugugauaacgcuugcauagggaguauccgaaauggaaccuacgaccaugacgucuaccgcgaugaggcccugaacaauagauuccacauuaaagguguggagcucaaguccggcuauaaagacuggauccuguggauuagcuuugcuaucucuugcuuccuucuguguguugccuugcucggguuuauaaugugggcaugccagaagggaaacaucagguguaauauuugcaucuga

SEQ ID NO: 130292 - RNA, 1701 nt, Artificial Sequence
  derived and/or modified sequence opt3 from hemagglutinin__InfluenzaA__AFD63747
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuuccgggcguaucacugugucaaccaagagaagccaacagacaguaauuccaaacaucggaaguaggccccggguucgcgacgugucuuccagaauaagcauuuacuggaccaucgucaagccuggugacauucugcuaaucaacucgacgggcaaucucaucgccccaaggggguauuucaagauucggucuggaaaauccucaauaaugcgcagugaugcgccgaucggcaaguguaacagcgagugcauuacucccaaugguuccaucccuaacgacaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugauggcugguacggguuccgucaccagaacucugagggaaccggccaggcagcugaccugaaaagcacgcaagccgcgauuaaucagaucaacgguaaguugaaucgccucauugggaagaccaacgagaaauuucacagaauagaaaaggaguucucagaaguggagggcaggauccaggaucuggaaaaauauguagaggacacaaagauugauuuauggaguuacaaugccgagcugcucguggcacuugaaaaccagcauacuaucgaccugaccgauuccgagaugaacaaauuguucgaacggacaaagaagcaacuacgagagaaugcugaagacaugggaaacggcugcuuuaaaaucuaucacaagugugauaaugccugcauugggagcauacgcaacggaacuuacgaccaugacgucuacagagaugaggcucugaauaacagguuccagaucaaagguguggagcucaagucuggcuauaaagacuggauucuguggaucucauuugccauuaguugcuuccuucuguguguugcauugcucggguuuaucaugugggccugccagaagggaaauauacgguguaacaucugcauuuga

SEQ ID NO: 130293 - RNA, 1701 nt, Artificial Sequence
  derived and/or modified sequence opt3 from hemagglutinin__InfluenzaA__AFD63758
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaaaucauuuuucagucgccugaauuggcucacucauuuaaaguauaaauacccagcacugaacgugaccaugcccaauaacgagaaguuugacaaacuuuauaucuggggcguccaccauccuggcacagauaacgaccagauuagcuuguacgcccaggcuucugggcgaaucacuguguccaccaagcguucacaacagacaguaauuccaaauaucggaagcagacccaggguucgggaugugaguucucgcauauccauuuacuggaccaucgucaagccuggugacauucugcuaaucaacagcacgggcaaucucaucgccccaagaggguauuucaaaauuaggucgggaaagucuuccauaaugcggucagacgcgccgaucggcaaauguaacagugagugcauuacucccaaugguagcaucccuaacgauaagccauuucagaaugugaaccgcauaacauacggggcauguccccgauaugugaaacagaauacccugaaacuugccacuggaaugagaaacgucccugaaaagcaaacaaggggcauuuucggcgcuaucgccggguuuaucgagaauggaugggaagguaugguugacggcugguacggguuccggcaccagaacuccgagggaaccggccaggcagcugaucugaagucuacgcaagccgcgauuaaucagaucaacgguaaguugaaucgucucauugggaaaaccaacgagaaguuucaccagauagaaaaagaguucagcgaaguggagggccgcauccaggaccuggaaaaguauguagaggauacaaaaauugacuuauggucauacaacgccgagcugcucguggcacuugaaaaucaacauacuaucgaucugaccgacagugagaugaacaaguuguucgaaagaacaaagaaacagcuaagggagaaugcugaagauaugggaaacggcugcuuuaagaucuaucacaaaugugacaaugccugcauuggguccauacggaacggaacuuacgaucaugacgucuaccgagacgaggcucugaauaaccgcuuccagaucaaggguguggagcucaaaagcggcuauaaggauuggauucuguggaucucuuuugccauuucaugcuuccuucuguguguugcauugcucggguuuaucaugugggccugccagaagggaaauauaagauguaacaucugcauuuga

SEQ ID NO: 130294 - RNA, 1701 nt, Artificial Sequence
  derived and/or modified sequence opt3 from hemagglutinin__InfluenzaA__AFD63769
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacaacgaucagaucaguuuguacgcccaggcuagcgggcguauuacugugucuaccaagagaucccaacagacaguaaucccaaacauaggaucaaggccccggguucgcgacgugagcaguagaauuucuaucuacuggaccauugucaagccuggugacauccugcuaaucaauuccacgggcaaccucauugccccaaggggguauuucaagauacggagcggaaaaucgucuaucaugcgcuccgaugcgccgauuggcaaguguaauucagagugcaucacucccaacgguaguauaccuaaugacaaaccauuucagaacgugaaucgaauuacauacggggcaugucccagauaugugaagcagaacacccugaaacuugccacuggaaugaggaaugucccugaaaagcaaacacggggcaucuucggcgcuaucgccggguuuauugagaacggaugggaagguaugguugauggcugguacggguuccgucaccagaauagcgagggaaccggccaggcagcugaccugaaauccacgcaagccgcgaucaaccagauuaaugguaaguugaaccgccucauagggaagaccaaugagaaauuucaccagaucgaaaaggaguucucugaaguggagggcaggauucaggaucuggaaaaauauguagaggacacaaagaucgauuuauggagcuacaacgccgagcugcucguggcacuugaaaaccaacauacuaucgaccugaccgauucagagaugaauaaauuguucgaaagaacaaagaagcagcuacgggagaacgcugaagacaugggaaauggcugcuuuaaaauuuaucacaagugugauaacgccugcauagggaguauccgaaauggaacuuacgaccaugacgucuaccgcgaugaggcucugaacaauagauuccacauuaaauccguggagcucaagagcgguuauaaagacuggauccuguggauuucuuuugccaucucaugcuuccuucuguguguugcauugcucggcuuuauaaugugggccugccagaaggggaacaucagguguaauauuugcaucuga

SEQ ID NO: 130295 - RNA, 1701 nt, Artificial Sequence; identical to SEQ ID NO: 122089
  derived and/or modified sequence opt3 from hemagglutinin__InfluenzaA__AFD63780

SEQ ID NO: 130296 - RNA, 1701 nt, Artificial Sequence; identical to SEQ ID NO: 130293
  derived and/or modified sequence opt3 from hemagglutinin__InfluenzaA__AFD63791

SEQ ID NO: 130297 - RNA, 1701 nt, Artificial Sequence; identical to SEQ ID NO: 122089
  derived and/or modified sequence opt3 from hemagglutinin__InfluenzaA__AFD63802

SEQ ID NO: 130298 - RNA, 1701 nt, Artificial Sequence
  derived and/or modified sequence opt3 from hemagglutinin__InfluenzaA__AFD63813
augaagaccaucauugcccugagcuacauacucucccuuguguucgcucagaaauuucccggcaacgacaauucuacagcaacucugugcuuggggcaccaugccgucccuaacggaacgaucguuaagaccauuacaaaugaucaaaucgaggugacuaacgcgaccgaauuaguacagauuucaaguacagguggcaucugugacagcccacaccagauacuggauggggagaauugcacccuaaucgacgcucuccugggagauccgcagugugacggcuuccaaaacaaaaagugggaucuuuuuguggaaagauccaaagccuauucuaauugcuaccccuaugacgucccugauuacgcaucgcugaggucauugguggccagcagugguucccucgaguucaacaaugaaucuuuugacuggacugggguuacacagaacggaaccagcuccgcuuguaagcggcgcucaaauaagaguuucuuuagccgacugaacuggcugacgcaucucaaauauaaguacccagcauuaaaugugacuaugcccaacaaugagaaauucgauaagcuguauauuuggggcguccaccauccuggcaccgacucugaucagaucucccuuuacgcccaggcuucagggcguauuacagugagcacuaaaagaagucaacagaccguaaucccaaacauaggaucuaggccccggguucgcgacauuuccagcagaaucucgauuuacuggacaaucgugaagccuggugacaucuugcugauuaacucuaccggcaaucuaauagccccaaggggguauuuuaagauccgguccggaaaaucaaguauuaugcgcagcgaugcgccgaucggcaagugcaacuccgaguguauaacgcccaaugguucuauuccuaacgacaaaccauuccagaaugucaaccgaaucacuuacggggcaugccccagauaugugaagcagaauacacucaaacuggccaccggaaugaggaacgugccugaaaagcaaacucggggcaucuuuggcgcuauugccggguucaucgagaauggaugggaagguauggucgauggcugguacggguuucgucaccagaacagcgagggaacaggccaggcagcugaccuuaaaucaacccaagccgcgauuaaucagauaaacgguaagcugaaucgcuugaucgggaagacgaacgagaaauuccaccagauugaaaaggaguucagugaaguugagggcagaauccaggaucucgaaaaauauguggaggacaccaagaucgaucugugguccuacaaugccgaguuacugguagcacucgaaaaccaacauacaauugaccuuacugauagcgagaugaacaaacuguuugaaaggaccaagaagcaguugcgggagaaugcugaagacaugggaaacggcuguuucaaaauauaucacaagugcgauaaugccuguaucgggucuauucgaaacggaacauacgaccaugacguguaccgcgaugaggcucuaaauaacagauuucagaucaaaggugucgagcugaagucaggcuauaaagacuggauucucuggaucaguuucgccacuagcugcuuucugcuuugcguggcacuguugggguucauaaugugggccugucagaagggaaauaucaggugcaacauuuguaucuga

SEQ ID NO: 130299 - RNA, 1701 nt, Artificial Sequence; identical to SEQ ID NO: 130283
  derived and/or modified sequence opt3 from hemagglutinin__InfluenzaA__AFD63824

SEQ ID NO: 130300 - RNA, 1701 nt, Artificial Sequence; identical to SEQ ID NO: 122089
  derived and/or modified sequence opt3 from hemagglutinin__InfluenzaA__AFD63846

SEQ ID NO: 130301 - RNA, 1701 nt, Artificial Sequence; identical to SEQ ID NO: 123327
  derived and/or modified sequence opt3 from hemagglutinin__InfluenzaA__AFD63857

SEQ ID NO: 130302 - RNA, 1701 nt, Artificial Sequence; identical to SEQ ID NO: 122089
  derived and/or modified sequence opt3 from hemagglutinin__InfluenzaA__AFD63868

SEQ ID NO: 130303 - RNA, 1701 nt, Artificial Sequence; identical to SEQ ID NO: 122089
  derived and/or modified sequence opt3 from hemagglutinin__InfluenzaA__AFD63890

SEQ ID NO: 130304 - RNA, 1701 nt, Artificial Sequence; identical to SEQ ID NO: 122089
  derived and/or modified sequence opt3 from hemagglutinin__InfluenzaA__AFD63901

SEQ ID NO: 130305 - RNA, 1701 nt, Artificial Sequence; identical to SEQ ID NO: 122089
  derived and/or modified sequence opt3 from hemagglutinin__InfluenzaA__AFD63912

SEQ ID NO: 130306 - RNA, 1701 nt, Artificial Sequence
  derived and/or modified sequence opt3 from hemagglutinin__InfluenzaA__AFD63923
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaaaucauuuuucagucgccugaauuggcucacucauuuaaaguauaaauacccagcacugaacgugaccaugcccaauaacgagaaguuugacaaacuuuauaucuggggcguccaccauccuggcacagauaacgaccagauuagcuuguacgcccaggcuucugggcgaaucacuguguccaccaagcguucacaacagacaguaauuccaaauaucggaagcagacccaggguucgggauauaaguucucgcauuuccaucuacuggaccauugugaagccuggugacauccugcuaaucaacagcacgggcaaucucauugccccaagaggguauuucaaaauaaggucgggaaagucuuccaucaugcggucagacgcgccgauuggcaaauguaacagugagugcaucacucccaaugguagcauaccuaacgauaagccauuucagaaugucaaccgcauuacauacggggcauguccccgauaugugaaacagaauacccugaaacuugccacuggaaugagaaacgugccugaaaagcaaacaaggggcaucuucggcgcuaucgccggguuuauugagaauggaugggaagguauggucgacggcugguacggguuccggcaccagaacuccgagggaaccggccaggcagcugaucugaagucuacgcaagccgcgaucaaucagauuaacgguaaguugaaucgucucauagggaaaaccaacgagaaguuucaccagaucgaaaaagaguucagcgaaguugagggccgcauucaggaccuggaaaaguauguggaggauacaaaaaucgacuuauggucauacaacgccgagcugcucguagcacuugaaaaucaacauacuaucgaucugaccgacagugagaugaacaaguuguucgaaagaacaaagaaacagcuaagggagaaugcugaagauaugggaaacggcugcuuuaagauuuaucacaaaugugacaaugccugcauaggguccauccggaacggaacuuacgaucaugacguguaccgagacgaggcucugaauaaccgcuuccagauuaagggugucgagcucaaaagcggcuauaaggauuggauccuguggauuucuuuugccaucucaugcuuccuucuguguguggcauugcucggguuuauaaugugggccugccagaagggaaauaucagauguaacauuugcaucuga

SEQ ID NO: 130307 - RNA, 1701 nt, Artificial Sequence
  derived and/or modified sequence opt3 from hemagglutinin__InfluenzaA__AFD63934
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagagagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccgucgugaagccuggugacauccugcuaauuaacucgacgggcaaucucaucgccccaaggggguauuucaagauccggucuggaaaauccucaauuaugcgcagugacgcgccgauaggcaaguguaacagcgaaugcaucacucccaaugguuccauuccuaacgauaaaccauuucagaaugugaaccgaaucacauacggggcaugucccagauaugucaagcagaauacccugaaacuugccacuggaaugaggaacguuccugagaagcaaacacggggcauauucggcgcuauugccggguuuaucgaaaauggaugggaggguaugguggacggcugguacggguuccgucaccagaacucugagggaaccggccaggcagcugaucugaaaagcacgcaagccgcgaucaaucagauuaacgguaaguugaaucgccucaucgggaagaccaacgaaaaauuucaccagauugagaaggaguucucagaaguagaaggcagaauacaggaccuggagaaauauguggaggauacaaagaucgacuuauggaguuacaaugccgaacugcucgucgcacuugagaaccaacauacuauugaucugaccgacuccgaaaugaacaaauuguucgagaggacaaagaagcagcuacgggaaaaugcugaggauaugggaaacggcugcuuuaaaaucuaucacaagugugacaaugccugcaucgggagcauucgaaacggaacuuacgaucaugacguguaccgcgacgaggcucugaauaacagauuccagauaaaagguguugaacucaagucuggcuauaaagauuggauccuguggauuucauuugccaucaguugcuuccuucuguguguggcauugcucggguuuauuaugugggccugccagaagggaaauaucagguguaacauaugcaucuga

SEQ ID NO: 130308 - RNA, 1701 nt, Artificial Sequence; identical to SEQ ID NO: 130283
  derived and/or modified sequence opt3 from hemagglutinin__InfluenzaA__AFD63945

SEQ ID NO: 130309 - RNA, 1701 nt, Artificial Sequence; identical to SEQ ID NO: 130283
  derived and/or modified sequence opt3 from hemagglutinin__InfluenzaA__AFD63956

SEQ ID NO: 130310 - RNA, 1701 nt, Artificial Sequence; identical to SEQ ID NO: 130283
  derived and/or modified sequence opt3 from hemagglutinin__InfluenzaA__AFD63967

SEQ ID NO: 130311 - RNA, 1701 nt, Artificial Sequence; identical to SEQ ID NO: 122089
  derived and/or modified sequence opt3 from hemagglutinin__InfluenzaA__AFD63989

SEQ ID NO: 130312 - RNA, 1701 nt, Artificial Sequence; identical to SEQ ID NO: 122089
  derived and/or modified sequence opt3 from hemagglutinin__InfluenzaA__AFD64000

SEQ ID NO: 130313 - RNA, 1701 nt, Artificial Sequence
  derived and/or modified sequence opt3 from hemagglutinin__InfluenzaA__AFD64011
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuucuuuguacgcccaggcuccagggaagaucacuguguccaccaagcguucacaacagacaguaauucccaacaucggaagcagaccuaggguucgggacgugaguucucgcauauccauuuacuggaccaucgucaagccaggugacauucugcuaaucaacagcacgggcaaucucaucgccccgagaggguauuucaaaauuaggucgggaaagucuuccauaaugcggucagaugcgcccaucggcaaauguaacagugagugcauuacuccuaaugguagcaucccaaacgacaagcccuuucagaaugugaaccgcauaacauacggggcauguccucgauaugugaaacagaauacccugaaacuugccacuggaaugagaaacgucccagaaaagcaaacaaggggcauuuucggcgcuaucgccggguuuaucgagaauggaugggaagguaugguugauggcugguacggguuccggcaccagaacuccgagggaaccggccaggcagcugaccugaagucuacgcaagccgcgauuaaucagaucaacgguaaguugaaucgucucauugggaaaaccaacgagaaguuucaccagauagaaaaagaguucagcgaaguggagggccgcauccaggaucuggaaaaguauguagaggacacaaaaauugauuuauggucauacaaugccgagcugcucguggcacuugaaaaccaacauacuaucgaccugaccgauagugagaugaacaaguuguucgaaagaacaaagaaacagcuaagggagaaugcugaagacaugggaaacggcugcuuuaagaucuaucacaaaugugauaaugccugcauuggguccauacggaacggaacuuacgaccaugacgucuaccgagaugaggcucugaauaaccgcuuccagaucaaggguguggagcucaaaagcggcuauaaggacuggauucuguggaucucuuuugccauuucaugcuuccuucuguguguugcauugcucggguuuaucaugugggccugccagaagggaaauauaagaugugauaucugcauuuga

SEQ ID NO: 130314 - RNA, 1701 nt, Artificial Sequence; identical to SEQ ID NO: 122089
  derived and/or modified sequence opt3 from hemagglutinin__InfluenzaA__AFD64022

SEQ ID NO: 130315 - RNA, 1701 nt, Artificial Sequence; identical to SEQ ID NO: 122089
  derived and/or modified sequence opt3 from hemagglutinin__InfluenzaA__AFD64033

SEQ ID NO: 130316 - RNA, 1701 nt, Artificial Sequence
  derived and/or modified sequence opt3 from hemagglutinin__InfluenzaA__AFD64044
augaagaccaucauugcccugagcuacauacucugccuuguguucgcucagaaacugcccggcaacgaaaauuccacagcaacuuuguguuuagggcaccaugccgucccuaacggaacgaucguuaagaccauuacaaaugaccaaaucgaagugacuaacgcgaccgagcugguacagucuucaaguacagguggcauuugcgauagcccacaccagauccuagacggggaaaauuguacccucauagaugcucugcuuggagacccgcagugcgauggcuuucaaaacaaaaagugggaccuguucguggagagauccaaagccuauucuaauuguuaccccuaugaugucccugacuacgcaucguugaggucacucguggccagcagugguacucuggaauuuaacaaugaguccuucgauuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugacaaacuuuauaucuggggcguccaccauccuggcacagauagcgaccagauuucuuuguacgcccaggcuuccgggcguaucacugugucaaccaagagaagccaacagacaguaauuccaaacaucggaaguaggccccggguucgcgaugugucuuccagaauaagcauuuacuggaccaucgucaagccuggugacauucugcuaaucaacucgacgggcaaucucaucgccccaaggggguauuucaagauucggucuggaaaauccucaauaaugcgcagugacgcgccgaucggcaaguguaacagcgaaugcauuacucccaaugguuccaucccuaacgauaaaccauuucagaaugugaaccgaauaacauacggggcaugucccagauaugugaagcagaauacccugaaacuugccacuggaaugaggaacgucccugagaagcaaacacggggcauuuucggcgcuaucgccggguuuaucgaaaauggaugggaggguaugguugacggcugguacggguuccgucaccagaacucugagggaaccggccaggcagcugaucugaaaagcacgcaagccgcgauuaaucagaucaacgguaaguugaaucgccucauugggaagaccaacgaaaaauuucaccagauagagaaggaguucucagagguggaaggcagaauccaggaccuggagaaauauguagaggauacaaagauugacuuauggaguuacaaugccgaacugcucguggcacuugagaaccaacauacuaucgaucugaccgacuccgaaaugaacaaauuguucgagaggacaaagaagcagcuacgggaaaaugcugaggauaugggaaacggcugcuuuaaaaucuaucacaagugugacaaugccugcauugggagcauacgaaacggaacuuacgaucaugacgucuaccgcgacgaggcucugaauaacagauuccagaucaaagguguggaacucaagucuggcuauaaagauuggauucuguggaucucauuugccauuaguugcuuccuucuguguguugcauugcucggguuuaucaugugggccugccagaagggaaauauaagguguaacaucugcauuuga

SEQ ID NO: 130317 - RNA, 1701 nt, Artificial Sequence; identical to SEQ ID NO: 130293
  derived and/or modified sequence opt3 from hemagglutinin__InfluenzaA__AFD64055

SEQ ID NO: 130318 - RNA, 1701 nt, Artificial Sequence
  derived and/or modified sequence opt3 from hemagglutinin__InfluenzaA__AFD64066
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacacuucguugaggucacucguggcaagcagugguacacuggaguuuaacaaugaauccuucaacuggaccgggguuacgcagaauggaacuucuagcgccugcaagcggcgcuccaacaagucauuuuucagucgacugaauuggcucacccauuuaaaauuuaaguauccagcucugaacgugacaaugcccaauaacgagaaauucgacaaacuuuacaucuggggcguccaccauccuggcacugauaacgaccagauuagcuuguaugcacaggccucugggcguaucaccguguccacaaagagaucacaacagaccguaauuccaaauaucggaagcaggccccggguucgcgaugugccuaguagaauaucuauuuacuggacgaucgucaagccaggugacauucugcuaaucaacuccacuggcaaucucaucgcuccgaggggguacuuuaagauucggagcggaaaaucgucuauaaugcgcuccgacgcccccaucggcaaguguaacucagagugcauuacaccuaaugguaguaucccaaacgauaaacccuuccagaaugugaaccgaauaaccuauggggcguguccuagauacgugaagcagaauacucugaaacuugcaacaggaaugaggaacgucccagaaaagcaaacccggggcauuuuuggcgccaucgcuggguucaucgagaauggaugggaagguaugguugacggcugguauggguuucgucaccagaacgccgagggaacgggccaggcagcugaucugaaaagcacccaagccgcgauuaaucagaucaacgguaaguugaaucgccucauugggaagacaaacgagaaauuccaccagauagaaaaggaguucuccgaaguggagggcagaauccaggaccuggaaaaauacguagaggauacuaagauugacuuauggucuuauaacgccgagcugcucguggcacuugaaaaucaacauaccaucgaucugacagacagcgagaugaacaaauuguuugaaaggacuaagaagcagcuacgggagaaugcugaagauaugggaaacggcugcuucaaaaucuaccacaagugugacaaugccugcauugggucaauacgaaacggaaccuaugaucaugacgucuaccgcgacgaggcucugaauaacagauuucagaucaaagguguggagcucaagaguggcuacaaaaauuggauucuguggaucuccuucgccauuagcugcuuucuucuguguguugcauugcucggguucaucaugugggccugccagaagggaaacauaagguguaauaucugcauuuga

SEQ ID NO: 130319 - RNA, 1701 nt, Artificial Sequence
  derived and/or modified sequence opt3 from hemagglutinin__InfluenzaA__AFD64077
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucgacuggacagguguuacccagaacgggacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggaguccaccauccuggcacagacagugaucagaucagcuuguacgcccaggcuucuggccguauuacuguguccaccaagagaucacaacagacaguaaucccaaacauagggagcaggccccggauucgcgacguuaguucuagaaucuccauuuacuggaccaucgugaagccuggagacauccugcuaauuaacagcacggguaaucucauagccccaaggggcuauuucaagauccggucggggaaaucuuccauuaugcgcucagaugcgccgaucggaaaguguaacagugaaugcauaacucccaauggcagcauuccuaacgacaaaccauuucagaaugucaaccgaaucacauacggugcaugucccagauaugugaagcagaauacccugaaacuugccacugggaugaggaacgugccugagaagcaaacacggggaaucuucggcgcuauugccggcuuuaucgaaaaugggugggagggaauggucgaugguugguacggcuuccgucaccagaacuccgaggggaccggacaggcagcugaccugaaaucuacgcaagccgcgauuaaucagauaaacggcaaguugaaucgccucaucgguaagaccaacgaaaaauuucaccagauugagaaggaguucagcgaaguugaagggagaauccaggaucuggagaaauauguggaggacacaaagaucgauuuauggucauacaaugccgaacugcucguagcacuugagaaccaacauacuauugaccugaccgauagugaaaugaacaaauuguucgagaggacaaagaagcagcuacgggaaaaugcugaggacaugggcaacggaugcuuuaaaauauaucacaagugugauaaugccugcaucggcuccauucgaaacgggacuuacgaccaugacguguaccgcgaugaggcucugaauaacagauuccagaucaaaggagucgaacucaagagcgguuauaaagacuggauucuguggaucucuuuugccauaucaugcuuccuucuguguguggcauugcucggcuuuaucaugugggccugccagaaggggaauauuagguguaacaucugcauuuga

SEQ ID NO: 130320 - RNA, 1701 nt, Artificial Sequence; identical to SEQ ID NO: 122089
  derived and/or modified sequence opt3 from hemagglutinin__InfluenzaA__AFD64088

SEQ ID NO: 130321 - RNA, 1701 nt, Artificial Sequence; identical to SEQ ID NO: 122089
  derived and/or modified sequence opt3 from hemagglutinin__InfluenzaA__AFD64099

SEQ ID NO: 130322 - RNA, 1701 nt, Artificial Sequence; identical to SEQ ID NO: 130293
  derived and/or modified sequence opt3 from hemagglutinin__InfluenzaA__AFD64110

SEQ ID NO: 130323 - RNA, 1701 nt, Artificial Sequence
  derived and/or modified sequence opt3 from hemagglutinin__InfluenzaA__AFD64121
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccagggccuauucuaauuguuaccccuaugacgucccugauuacgcaucguugcggucacucguggccagcagugguacucuggaguuuaacaaugaauccuucaacuggacagggguuacccagaauggaacgucuagcgcuugcaaacgcaaguccaacaagucauuuuucagucgacugaauuggcucacucauuuaaaauauaaguacccagcacugaacgugaccaugcccaauaacgagaaauuugacaaacuuuauaucuggggcguccaccauccuggcacagauaacgaccagauuagcuuguacgcccaggcuucugggcguaucacuguguccaccaagagaucacaacagacaguaauuccaaauaucggaagcaggccccggguucgcgaugugaguucuagaauauccauuuacuggaccaucgucaagccuggugacauucugcuaaucaacagcacgggcaaucucaucgccccaaggggguauuucaagauucggucgggaaaaucuuccauaaugcgcucagacgcgccgaucggcaaguguaacagugagugcauuacucccaaugguagcaucccuaacgauaaaccauuucagaaugugaaccgaauaacauacggggcaugucccagauaugugaagcagaauacccugaaacuugccacuggaaugaggaacgucccugaaaagcaaacacggggcauuuucggcgcuaucgccggguuuaucgagaauggaugggaagguaugguugacggcugguacggguuccgucaccagaacuccgagggaaccggccaggcagcugaucugaaaucuacgcaagccgcgauuaaucagaucaacgguaaguugaaucgccucauugggaagaccaacgagaaauuucaccagauagaaaaggaguucagcgaaguggagggcagaauccaggaccuggaaaaauauguagaggauacaaagauugacuuauggucauacaacgccgagcugcucguggcacuugaaaaucaacauacuaucgaucugaccgacagugagaugaacaaauuguucgaaaggacaaagaagcagcuacgggagaaugcugaagauaugggaaacggcugcuuuaaaaucuaucacaagugugacaaugccugcauuggguccauacgaaacggaacuuacgaucaugacgucuaccgcgacgaggcucugaauaacagauuccagaucaaagguguggagcucaagagcggcuauaaagauuggauucuguggaucucuuuugccauuucaugcuuccuucuguguguugcauugcucggguuuaucaugugggccugccagaagggaaauauaagguguaacaucugcauuuga

SEQ ID NO: 130324 - RNA, 1701 nt, Artificial Sequence; identical to SEQ ID NO: 122089
  derived and/or modified sequence opt3 from hemagglutinin__InfluenzaA__AFD64132

SEQ ID NO: 130325 - RNA, 1701 nt, Artificial Sequence; identical to SEQ ID NO: 130283
  derived and/or modified sequence opt3 from hemagglutinin__InfluenzaA__AFD64143

SEQ ID NO: 130326 - RNA, 1701 nt, Artificial Sequence; identical to SEQ ID NO: 122089
  derived and/or modified sequence opt3 from hemagglutinin__InfluenzaA__AFD64154

SEQ ID NO: 130327 - RNA, 1701 nt, Artificial Sequence
  derived and/or modified sequence opt3 from hemagglutinin__InfluenzaA__AFD64179
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacagugaucagaucagcuuguacgcccaggcuucugggcguauuacuguguccaccaagagaucacaacagacaguaaucccaaacauaggaagcaggccccggguucgcgacgugaguucucagauuuccaucuacuggaccauugucaagccuggugacauccugcuaaucaacagcacgggcaaucucauugccccaagaggguauuucaagauaaggucgggaaaaucuuccaucaugcggucagaugcgccgauuggcaaguguaacagugagugcaucacucccaaugguagcauaccuaacgacaaaccauuucagaaugugaaccgcauuacauacggggcauguccccgauaugugaagcaaaauacccugaaacuugccacuggaaugagaaacgucccugaaaagcagacaaggggcaucuucggcgcuaucgccggguuuauugagaauggaugggaagguaugguugauggcugguacggguuccggcaccagaacuccgagggaaccggccaagcagcugaccugaaaucuacgcaggccgcgaucaaucagauuaacgguaaguugaaucgucucauagggaagaccaacgagaaauuucaccagaucgaaaaggaguucagcgaaguggagggccgcauucaagaucuggaaaaauauguagaggacacaaagaucgauuuauggucauacaaugccgagcugcucguggcacuugaaaaccagcauacuaucgaccugaccgauagugagaugaacaaauuguucgaaagaacaaagaagcagcuaagggagaaugcugaagacaugggaaacggcugcuuuaaaauuuaucacaagugugauaaugccugcauaggguccauccggaacggaacuuacgaccaugacgucuaccgagaugaggcucugaauaaccgcuuccagauuaaagguguggagcucaagagcggcuauaaagacuggauccuguggauuucuuuugccaucucaugcuuccuucuguguguugcauugcucggguuuauaaugugggccugccaaaagggaaauaucagauguaacauuugcaucuga

SEQ ID NO: 130328 - RNA, 1701 nt, Artificial Sequence; identical to SEQ ID NO: 130327
  derived and/or modified sequence opt3 from hemagglutinin__InfluenzaA__AFD64190

SEQ ID NO: 130329 - RNA, 1701 nt, Artificial Sequence; identical to SEQ ID NO: 130283
  derived and/or modified sequence opt3 from hemagglutinin__InfluenzaA__AFD64201

SEQ ID NO: 130330 - RNA, 1701 nt, Artificial Sequence; identical to SEQ ID NO: 130293
  derived and/or modified sequence opt3 from hemagglutinin__InfluenzaA__AFD64212

SEQ ID NO: 130331 - RNA, 1701 nt, Artificial Sequence
  derived and/or modified sequence opt3 from hemagglutinin__InfluenzaA__AFD64223
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaagcuguauaucuggggcgucuugcacccuggcacagauagcgaccagauucgucuguacgcccaggcuucugggagaaucacuguguccaccaaaaggucacaacagacaguaauuccaaacaucggaagccggccccgcguuagagaugugaguucuaggauauccauuuacuggaccaucgucaagccuggugacauucuacucaucaauagcacgggcaaccugaucgccccacggggguauuucaagauucgcucgggaaaaucuuccauaaugcgaucagacgcgccgaucggcaaguguaauagugagugcauuacucccaacgguagcaucccuaaugauaaaccauuucagaacgugaauagaauaacauacggggcaugucccagguauauuaagcagaacacccuuaaacuggccacuggaaugcggaaugugccugaaaagcaaacacguggcaucuucggcgcuaucgccggguuuauugagaacggaugggaagguauggucgacggcugguacggguuccgccaucaaaauuccgagggaaccggccaggcagcugauuugaaaucuacgcaggccgcgaucaaccagauuaaugguaagcucaacagacugauagggaagaccaaugagaaauuucaccagaucgaaaaggaguucagcgaaguugagggcaggauucaggacuuagaaaaauauguggaggauacaaagaucgaccuguggucauacaacgccgagcuccuuguagcacuggaaaaccaauauacuaucgauuugaccgacagugagaugaauaaacuauucgaacggacaaagaagcagcugcgagagaacgcugaagauaugggaaauggcugcuuuaaaauuuaccacaagugugacaacgccugcauaggguccauccgcaauggaacuuacgaucaugacguguauagagacgaggcucucaacaauagguuccagauuaaaggugucgagcuuaagagcggcuacaaagauuggauccuuuggauuucuuuugccaucucaugcuuccuguuguguguggcacuccugggguuuauaaugugggccugccagaagggaaacauccgguguaauauuugcaucuga

SEQ ID NO: 130332 - RNA, 1701 nt, Artificial Sequence
  derived and/or modified sequence opt3 from hemagglutinin__InfluenzaA__AFD64315
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucgacuggacagggguuacccagaacggaacguccucugcuugcaagcggcgcagcaauaaguccuuuuucucacgacugaacuggcucacucauuuaaaauauaaguacccagcacugaaugugaccaugcccaacaaugagaaauuugauaaacuuuauauuuggggcguccaccauccuggcacagacagugaucagaucagcuuguacgcccaggcuucugggcguauuacuguguccaccaagagaucacaacagacaguaaucccaaacauaggaagcaggccccggguucgcgacgugaguucuagaauuuccaucuacuggaccauugucaagccuggugacauccugcuaaucaacagcacgggcaaucucauugccccaaggggguauuucaagauacggucgggaaaaucuuccaucaugcgcucagaugcgccgauuggcaaguguaacagugagugcaucacucccaaugguagcauaccuaacgacaaaccauuucagaaugugaaccgaauuacauacggggcaugucccagauaugugaagcagaauacccugaaacuugccacuggaaugaggaacgucccugaaaagcaaacacggggcaucuucggcgcuaucgccggguuuauugagaauggaugggaagguaugguugauggcugguacggguuccgucaccagaacuccgagggaaccggccaggcagcugaccugaaaucuacgcaagccgcgaucaaucagauuaacgguaaguugaaucgccucauagggaagaccaacgagaaauuucaccagaucgaaaaggaguucagcgaaguggagggcaggauucaggaucuggaaaaauauguagaggacacaaagaucgauuuauggucauacaaugccgagcugcucguggcacuugaaaaccaacauacuaucgaccugaccgauagugagaugaacaaauuguucgaaagaacaaagaaucagcuacgggagaacgcugaagacaugggaaauggcugcuuuaagauuuaucacaaaugugauaacgccugcauaggguccauccgaaauggaacuuacgaccaugacgucuaccgcgaugaggcucugaacaauagauuccagauuaaggguguggagcucaaaagcggcuauaaggacuggauccuguggauuucuuuugccaucucaugcuuccuucuguguguugcauugcucggguuuauaaugugggccugccagaaaggaaacaucagguguaauauuugcaucuga

SEQ ID NO: 130333 - RNA, 1701 nt, Artificial Sequence; identical to SEQ ID NO: 130323
  derived and/or modified sequence opt3 from hemagglutinin__InfluenzaA__AFD64326

SEQ ID NO: 130334 - RNA, 1701 nt, Artificial Sequence; identical to SEQ ID NO: 130293
  derived and/or modified sequence opt3 from hemagglutinin__InfluenzaA__AFD64337

SEQ ID NO: 130335 - RNA, 1701 nt, Artificial Sequence; identical to SEQ ID NO: 122089
  derived and/or modified sequence opt3 from hemagglutinin__InfluenzaA__AFD64348

SEQ ID NO: 130336 - RNA, 1701 nt, Artificial Sequence; identical to SEQ ID NO: 130293
  derived and/or modified sequence opt3 from hemagglutinin__InfluenzaA__AFD64359

SEQ ID NO: 130337 - RNA, 1701 nt, Artificial Sequence
  derived and/or modified sequence opt3 from hemagglutinin__InfluenzaA__AFD64370
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcauugcgacggcuuucagaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccaaaauggaacgucuagcgcuugcaagcggaaguccaacaaaucauuuuucagucgccugaauuggcucacucacuuaaaguauaaauacccagcacugaacgugaccaugcccaauaacgagaaguuugacaaacuuuauaucuggggcguccaucacccuggcacagauaacgaccagauuagcuuguacgcccaggcuucugggcgaaucacuguguccaccaagcguucacagcaaacaguaauuccaaauaucggaagcagacccaggguucgggauauaaguucucgcauuuccaucuacuggaccauugugaagccuggugacauccugcuaaucaacagcacgggcaaucucauugccccaagaggguauuucaaaauaaggucgggaaagucuuccaucaugcggucagacgcgccgauuggcaaauguaacagugagugcaucacucccaaugguagcauaccuaacgauaagccauuucagaaugucaaccgcauuacauacggggcauguccccgauaugugaaacagaauacccugaaacuugccacuggaaugagaaacgugccugaaaagcagacaaggggcaucuucggcgcuaucgccggguuuauugagaauggaugggaagguauggucgacggcugguacggguuccggcaccaaaacuccgagggaaccggccaggcagcugaucugaagucuacgcaggccgcgaucaaucaaauuaacgguaaguugaaucgucucauagggaaaaccaacgagaaguuucaucagaucgaaaaagaguucagcgaaguugagggccgcauucaggaccuggaaaaguauguggaggauacaaaaaucgacuuauggucauacaacgccgagcugcucguagcacuugaaaaucagcacacuaucgaucugaccgacagugagaugaacaaguuguucgaaagaacaaagaaacaacuaagggagaaugcugaagauaugggaaacggcugcuuuaagauuuaucauaaaugugacaaugccugcauaggguccauccggaacggaacuuacgaucacgacguguaccgagacgaggcucugaauaaccgcuuccagauuaagggugucgagcucaaaagcggcuauaaggauuggauccuguggauuucuuuugccaucucaugcuuccuucuguguguggcauugcucggguuuauaaugugggccugccagaagggaaauaucagauguaacauuugcaucuga

SEQ ID NO: 130338 - RNA, 1701 nt, Artificial Sequence; identical to SEQ ID NO: 122089
  derived and/or modified sequence opt3 from hemagglutinin__InfluenzaA__AFD64381

SEQ ID NO: 130339 - RNA, 1701 nt, Artificial Sequence; identical to SEQ ID NO: 130293
  derived and/or modified sequence opt3 from hemagglutinin__InfluenzaA__AFD64392

SEQ ID NO: 130340 - RNA, 1701 nt, Artificial Sequence; identical to SEQ ID NO: 130283
  derived and/or modified sequence opt3 from hemagglutinin__InfluenzaA__AFD64403

SEQ ID NO: 130341 - RNA, 1701 nt, Artificial Sequence; identical to SEQ ID NO: 130283
  derived and/or modified sequence opt3 from hemagglutinin__InfluenzaA__AFD64414

SEQ ID NO: 130342 - RNA, 1701 nt, Artificial Sequence
  derived and/or modified sequence opt3 from hemagglutinin__InfluenzaA__AFD64425
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccuaacuacgcaucuuugaggucgcucguggccucaagcgguacucuggaguuuaauaacgaaaguuucgauuggacagggguuacccagaauggaacguccucugcuugcaagcggcgcagcaacaaguccuuuuucucacgacugaauuggcucacucauuuaaaauauaaguacccagcacugaacgugaccaugcccaauaacgagaaauuugacaaacuuuauauuuggggcguccaccauccuggcacagauagugaccagaucagcuuguacgcccaggcuucugggcguauuacuguguccaccaagagaucacaacagacaguaaucccaaacauaggaagcaggccccggguucgcgaugugaguucuagaauuuccaucuacuggaccauugucaagccuggugacauccugcuaaucaauagcacgggcaaccucauugccccaaggggguauuucaagauacggucgggaaaaucuuccaucaugcgcucagacgcgccgauuggcaaguguaauagugagugcaucacucccaacgguagcauaccuaaugauaaaccauuucagaacgugaaucgaauuacauacggggcaugucccagauaugugaagcagaacacccugaaacuugccacuggaaugaggaaugucccugaaaagcaaacacggggcaucuucggcgcuaucgccggguuuauugagaacggaugggaagguaugguugacggcugguacggguuccgucaccaaaauuccgagggaaccggccaggcagcugaucugaaaucuacgcaggccgcgaucaaccagauuaaugguaaguugaaccgccucauagggaagaccaaugagaaauuucaccagaucgaaaaggaguucagcgaaguggagggcaggauucaggaccuggaaaaauauguagaggauacaaagaucgacuuauggucauacaacgccgagcugcucguggcacuugaaaaccaacauacuaucgaucugaccgacagugagaugaauaaauuguucgaaagaacaaagaagcagcuacgggagaacgcugaagauaugggaaauggcugcuuuaaaauuuaucacaagugugacaacgccugcauaggguccauccgaaauggaacuuacgaucauaacgucuaccgcgacgaggcucugaauaacagauuccagauuaaagguguggagcucaagagcggcuauaaagacuggauccuguggauuucuuuugccaucucaugcuuccuucuguguguugcauugcucggguuuauaaugugggccugccagaagggaaauaucagguguaacauuugcaucuga

SEQ ID NO: 130343 - RNA, 1701 nt, Artificial Sequence; identical to SEQ ID NO: 122089
  derived and/or modified sequence opt3 from hemagglutinin__InfluenzaA__AFD64436

SEQ ID NO: 130344 - RNA, 1701 nt, Artificial Sequence; identical to SEQ ID NO: 122089
  derived and/or modified sequence opt3 from hemagglutinin__InfluenzaA__AFD64447

SEQ ID NO: 130345 - RNA, 1701 nt, Artificial Sequence
  derived and/or modified sequence opt3 from hemagglutinin__InfluenzaA__AFD64458
augaagaccaucauugcccugagcuacauacucugccuuguguucgcucagaaacugcccggcaacgacaauuccacagcaacuuuguguuuagggcaccaugccguccaaaacggaacgaucguuaagaccauuacaaaugaucagaucgaggugacuaacgcgaccgaacugguacagucuucaaguacagguggcauuugcgacagcccucaccagauccuagauggggagaauuguacccucauagacgcucugcuuggagauccacaaugcgacggcuuucagaacaaaaagugggaucuguucguggaaagauccaaagccuauucuaauuguuacccguaugacguccccgauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccugcacugaaugugaccaugccaaacaaugagaaauuugauaaacuuuauaucuggggcguccaccaucccggcacagacagcgaucagauuucuuuguacgcccaggcuuccgggcguaucacugugucaaccaagagaagccaacagacaguaauuccuaacaucggaaguaggccacggguucgcgacgugucuuccagaauaagcauuuacuggaccaucgucaagcccggugacauucugcuaaucaacucgacgggcaaucucaucgccccuaggggguauuucaagauucggucuggaaaauccucaauaaugcgcagugaugcgccaaucggcaaguguaacagcgagugcauuacuccgaaugguuccauccccaacgacaaaccuuuucagaaugugaaccgaauaacauacggggcauguccaagauaugugaagcaaaauacccugaaacuugccacuggaaugaggaacguccccgaaaagcagacacggggcauuuucggcgcuaucgccggguuuaucgagaauggaugggaagguaugguugauggcugguacggguuccgucaccagaacucugagggaaccggccaagcagcugaccugaaaagcacgcaggccgcgauuaaucagaucaacgguaaguugaaucgccucauugggaagaccaacgagaaauuucaccagauagaaaaggaguucucagaaguggagggcagaauccaagaucuggaaaaauauguagaggacacaaagauugauuuauggaguuacaaugccgagcugcucguggcacuugaaaaccagcauacuaucgaccugaccgauuccgagaugaacaaauuguucgaaaggacaaagaagcagcuacgggagaaugcugaagacaugggaaacggcugcuuuaaaaucuaucacaagugugauaaugccugcauugggagcauacgaaacggaacuuacgaccaugacgucuaccgcgaugaggcucugaauaacagauuccagaucaaagguguggagcucaagucuggcuauaaagacuggauucuguggaucucauuugccauuaguugcuuccuucuguguguugcauugcucggguuuaucaugugggccugccaaaagggaaauauaagguguaacaucugcauuuga

SEQ ID NO: 130346 - RNA, 1701 nt, Artificial Sequence; identical to SEQ ID NO: 128871
  derived and/or modified sequence opt3 from hemagglutinin__InfluenzaA__AFD64795

SEQ ID NO: 130347 - RNA, 1701 nt, Artificial Sequence; identical to SEQ ID NO: 128998
  derived and/or modified sequence opt3 from hemagglutinin__InfluenzaA__AFD64799

SEQ ID NO: 130348 - RNA, 1701 nt, Artificial Sequence
  derived and/or modified sequence opt3 from hemagglutinin__InfluenzaA__AFD64802
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaauugaccagaucaacggcaaauugaacagacucauugguaagacgaaugagaaauuccaucagauagaaaaggaguuuuccgaaguggaggggaggauccaagaucuggaaaaguauguagaggacaccaaaauugauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagaucuaucauaagugugauaaugccugcauuggcucaauacgaaacgggacauacgaccacgaugucuaucgcgacgaggcacugaauaacagauuccagaucaaaggaguggagcucaagagugaauacaaagacuggauucuguggaucuccuuugccauuagcugcuuccuucuguguguugcuuugcucgguuuuaucaugugggcgugccaaaagggcaauauaagguguaacaucugcauuuga

SEQ ID NO: 130349 - RNA, 1701 nt, Artificial Sequence
  derived and/or modified sequence opt3 from hemagglutinin__InfluenzaA__AFD64804
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaaacagacucggggaaucuucggcgcaaucgcuggcuuuauugagaacgggugggaaggaaugauggacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguugaggggaggauucaagaucuggaaaaguauguggaggacacgaaaaucgauuuauggucuuacaacgcugagcugcucguagcccuugaaaaucagcacaccaucgaccugacagauagcgagaugaacaaguuguucgaaaagacuaagaaacagcuacgggagaaugcugaagacaugggcaacggaugcuuuaagauuuaucauaagugugauaaugccugcauaggcucaauccgaaacgggaccuacgaccacgauguguaucgcgacgaggcacugaauaacagauuccagauuaaaggagucgagcucaagagugguuacaaagacuggauccuguggauuuccuuugccaucagcugcuuccuucuguguguggcuuugcucggcuuuauaaugugggcgugccaaaaggggaauaucagguguaacauuugcaucuga

SEQ ID NO: 130350 - RNA, 1701 nt, Artificial Sequence
  derived and/or modified sequence opt3 from hemagglutinin__InfluenzaA__AFD64806
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaauugaccagaucaacggcaaauugaacagacucauugguaagacgaaugagaaauuccaucagauagaaaaggaguuuuccgaaguggaggggaggauccaagaucuggaaaaguauguagaggacaccaaaauugauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagaucuaucauaagugugauaaugccugcauuggcucaauacgaaacgggacauacgaccacgaugucuaucgcgacgaggcacugaauaacagauuccagaucaaaggaguggagcucaagagugguuacaaagacuggauucuguggaucuccuuugccauuagcugcuuccuucuguguguugcuuugcucggcuuuaucaugugggcgugccaaaaggggaauauaagguguaacaucugcauuuga

SEQ ID NO: 130351 - RNA, 1701 nt, Artificial Sequence
  derived and/or modified sequence opt3 from hemagglutinin__InfluenzaA__AFD64807
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaguuguauauuuggggaguccaucacccuggcacagacaaagaucagacuuuucuuuacgcccaagcuagcggccguaucaccgugucuacaaagagaucccagcaggccguaauuccaaauaucgggucaaggccccggguucgcgacauaccuagcagagugaguauuuauuggaccaucgucaaaccaggagauauucugcuaaucaacucuacggguaaucucaucgcgccgaggggcuacuucaagauucgguccgggaaaagcucgauaaugcgcucugacgcaccccugggaaagugucacuccgccugcaucacuccuaacggcucaauuccaaaugacaagcccuuucagaacgugaaucgaaucacauacggugcuuguccuagauaugugaaacaaaacacccuuaagcuggccacugggaugaggaaugucccagaaaaacagacacggggaauauucggcgcaauugcuggcuuuaucgagaacgggugggaaggaaugguugaugguugguacggcuuccgucaucagaauagugaggggcgcggacaagccgcggacuugaaaagcacccaggccgcaaucgaucagauuaacggcaaacucaauagacugaucgguaagacgaacgagaaauuccaccagauugaaaaggaguuuuccgaaguggaggggaggauacaagacuuagaaaaguauguagaggauaccaaaaucgaccuguggucuuacaacgcugagcuccuuguggcccuggaaaaucagcauacaauugauuugacugacagcgagaugaacaagcuauucgaaaagaccaagaaacagcugcgggagaaugcugaagauaugggcaacggaugcuuuaagaucuaucacaagugugacaaugccugcaucggcucaauucgaaacgggacauacgaucacgacauguaucgcgacgaggcacucaauaacagauuccagauaaaaggagucgagcugaagagugguuacaaagauuggauccuuuggauuuccuuugccaucagcugcuuccuguuguguguggcucuccugggcuuuauuaugugggcgugccaaaaggggaauaucagguguaacauaugcaucuga

SEQ ID NO: 130352 - RNA, 1701 nt, Artificial Sequence
  derived and/or modified sequence opt3 from hemagglutinin__InfluenzaA__AFD64810
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaaacagacucggggaaucuucggcgcaaucgcuggcuuuauugagaacgggugggaaggaaugguugacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguggaggggaggauucaagaucuggaaaaguauguagaggacacgaaaaucgauuuauggucuuacaacgcugagcugcucguggcccuugaaaaucagcacaccaucgaccugacagauagcgagaugaacaaguuguucgaaaagacuaagaaacagcuacgggagaaugcugaagacaugggcaacggaugcuuuaagauuuaucauaagugugauaaugccugcauaggcucaauccgaaacgggaccuacgaccccgaugucuaucgcgacgaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucagguguaacauuugcaucuga

SEQ ID NO: 130353 - RNA, 1701 nt, Artificial Sequence
  derived and/or modified sequence opt3 from hemagglutinin__InfluenzaA__AFD64812
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaacggaccagauuaacggcaaauugaacagacucaucgguaagaccaaugagaaauuccaucagauugaaaaggaguuuuccgaaguggaggggaggauacaagaucuggaaaaguauguagaggacacaaaaaucgauuuauggucuuacaacgcugagcugcucguggcccuugaaaaucagcacacuauugaccugaccgauagcgagaugaacaaguuguucgaaaagacaaagaaacagcuacgggagaaugcugaagacaugggcaacggaugcuuuaagaucuaucauaagugugauaaugccugcaucggcucaauucgaaacgggacuuacgaccacgaugucuaucgcgacgaggcacugaauaacagauuccagauaaaaggaguggagcucaagagugguuacaaagacuggauccuguggauuuccuuugccaucagcugcuuccuucuguguguugcuuugcucggcuuuauuaugugggcgugccaaaaggggaauaucagguguaacauaugcaucuga

SEQ ID NO: 130354 - RNA, 1701 nt, Artificial Sequence
  derived and/or modified sequence opt3 from hemagglutinin__InfluenzaA__AFD64814
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaauugaccagaucaacggcaaauugaacagacucauugguaagacgaaugagaaauuccaucagauagaaaaggaguuuuccgaaguggaggggaggauccaagaucuggaaaaguauguagaggacaccaaaauugauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagaucuaucauaagugugauaaugccugcauuggcucaauacgaaacgggacauacgaccccgaugucuaucgcgacgaggcacugaauaacagauuccagaucaaaggaguggagcucaagagugguuacaaagacuggauucuguggaucuccuuugccauuagcugcuuccuucuguguguugcuuugcucggcuuuaucaugugggcgugccaaaaggggaauauaagguguaacaucugcauuuga

SEQ ID NO: 130355 - RNA, 1701 nt, Artificial Sequence
  derived and/or modified sequence opt3 from hemagglutinin__InfluenzaA__AFD64816
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcaauagcccacaccagauccuagacggugagaacuguacccucauagaugcucugcuuggcgacccgcagugcgauggguuucaaaauaaaaagugggaccuguucguggaaagauccaaagcccauucuaacuguuaucccuacgaugucccugacuaugcaucguugaggucacucguggccagcaguggaacucuggaguuuaauaacgaguccuucaauuggacaggcguuacccagaacgguacgucuagcgcuugcaugcggcgcuccaauaacucauuuuucagucgacugaauuggcucacucacuuaaacuuuaaguacccagcacugaacgugaccaugcccaauaacgaacaguucgauaagcuguauaucuggggaguccaucacccugggacagacaaagaucagauuuuucuuuacgcccaagcuagcggccguaucacugugucuaccaagagaucccagcaggccguaauuccaaauaucggcucaaggccccggguucgcaacauaccuagcagagugaguauuuauuggacaaucgucaaaccaggggacauucugcuaaucaauucuaccggaaaccucaucgcgccgagggguuacuucaagauucgguccggcaaaagcucgauaaugcgcucugaugcacccaucgggaaguguaauuccgccugcauuacgccuaacggaucaaucccaaaugacaagcccuuucagaacgugaaucgaauaacuuacggcgcuuguccuagauaugugaaacaaaacacacugaaguuggccaccgguaugaggaaugucccagagaaacagacucgggggauuuucggagcaaucgcuggcuuuaucgaaaacggcugggaggggaugguugacggaugguacgguuuccgucaccagaauagugagggccgcgggcaagccgcggaucuuaagagcacacaggccgcaauugaccagaucaacggaaaauugaacagacucauuggcaagaccaaugaaaaauuccaucagauagagaaggaauuuuccgagguggaagguaggauccaagaucuggagaaguauguagaggacacgaaaauugauuuauggucuuacaacgcugaacugcucguggcccuugagaaucagcacaccaucgaccugacagauagcgaaaugaacaaguuguucgagaaaacuaagaaacagcuacgggaaaaugcugaggacauggggaacggcugcuuuaagaucuaucauaagugugauaaugccugcauuggaucaauacgaaacggcaccuacgaccacgaugucuaucgcgacgaggcacugaauaacagauuccagaucaaagggguggaacucaagaguggauacaaagacuggauucuguggaucuccuuugccauuagcugcuuccuucuguguguugcuuugcucgguuuuaucaugugggcgugccaaaagggcaauauaagguguaacaucugcauuuga

SEQ ID NO: 130356 - RNA, 1701 nt, Artificial Sequence
  derived and/or modified sequence opt3 from hemagglutinin__InfluenzaA__AFD64818
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaguuguauauuuggggaguccaucacccuggcacagacaaagaucagacuuuucuuuacgcccaagcuagcggccguaucaccgugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcaccccugggaaaguguaucuccgccugcauuacuccuaauggcucaaucccaaacgacaagcccuuucagaaugugaaccgaauaacauacggugcuuguccuagauaugugaaacaaaauacccuuaagcuggccacugggaugaggaacgucccagaaaaacagacacggggaauuuucggcgcaaucgcuggcuuuaucgagaaugggugggaaggaaugguugacgguugguacggcuuccgucaccagaacagugaggggcgcggacaagccgcggauuugaaaagcacccaggccgcaauugaccagaucaauggcaaacucaacagacugauugguaagacgaacgagaaauuccaucagauagaaaaggaguuuuccgaaguggaggggaggauccaagauuuagaaaaguauguagaggacaccaaaauugaucuguggucuuacaaugcugagcuccuuguggcccuggaaaaccagcacacaaucgacuugacugauagcgagaugaauaagcuauucgaaaagaccaagaaacagcugcgggagaacgcugaagacaugggcaauggaugcuuuaagaucuaucauaagugugauaacgccugcauuggcucaauacgaaaugggacauacgaccacgaugucuaucgcgacgaggcacucaacaauagauuccagaucaaaggaguggagcugaagagugguuacaaagacuggauucuuuggaucuccuuugccauuagcugcuuccuguuguguguugcucuccugggcuuuaucaugugggcgugccaaaaggggaacauaagguguaauaucugcauuuga

SEQ ID NO: 130357 - RNA, 1701 nt, Artificial Sequence
  derived and/or modified sequence opt3 from hemagglutinin__InfluenzaA__AFD64819
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggauacgcaacauuccuagcagaguuaguaucuauuggaccauugugaaaccaggagacauccugcuaaucaauucuacggguaaccucauugcgccgaggggcuacuucaagauacgguccgggaaaagcucgaucaugcgcucugaugcacccauuggaaaguguaucuccgccugcauaacuccuaauggcucaauuccaaacgacaagcccuuucagaaugucaaccgaaucacauacggugcuuguccuagauaugugaaacaaaauacccugaaacuugccacugggaugaggaacgugccagaaaaacagacacggggaaucuucggcgcaauugcuggcuuuaucgagaaugggugggaaggaauggucgacgguugguacggcuuccgucaccagaacagugaggggcgcggacaagccgcggaucuuaagagcacccaggccgcaauugaccagauaaauggcaaauugaacagacucaucgguaagacgaacgagaaauuccaucagauugaaaaggaguuuuccgaaguugaggggaggauccaagaucuggaaaaguauguggaggacaccaaaaucgauuuauggucuuacaaugcugagcugcucguagcccuugaaaaccagcacacaauugaccugacugauagcgagaugaauaaguuguucgaaaagaccaagaaacagcuacgggagaacgcugaagacaugggcaauggaugcuuuaagauauaucauaagugugauaacgccugcaucggcucaauucgaaaugggacauacgaccccgauguguaucgcgacgaggcacugaacaauagauuccagaucaaaggagucgagcucaagagugguuacaaagacuggauucuguggaucuccuuugccauaagcugcuuccuucuguguguggcuuugcucggcuuuaucaugugggcgugccaaaaggggaacauuagguguaauaucugcauuuga

SEQ ID NO: 130358 - RNA, 1701 nt, Artificial Sequence; identical to SEQ ID NO: 128998
  derived and/or modified sequence opt3 from hemagglutinin__InfluenzaA__AFD64820

SEQ ID NO: 130359 - RNA, 1701 nt, Artificial Sequence
  derived and/or modified sequence opt3 from hemagglutinin__InfluenzaA__AFD64822
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcaugcggcgcuccaauaacucauuuuucagucgacugaauuggcucacucacuuaaacuuuaaguacccagcacugaacgugaccaugcccaauaacgagcaguucgauaagcuguauaucuggggaguccaucacccuggcacagacaaagaucagaucuuuuuguacgcccaagcuagcggccguauuacugugucuaccaagagaucccagcaggccguaauuccaaauaucgggucaaggccccggguucgcaacauaccuagcagagugaguauuuauuggacaaucgucaaaccaggagacauucugcuaaucaauucuaccgguaaccucaucgcgccgaggggcuacuucaagauucgguccgggaaaagcucgauaaugcgcucugaugcacccaucggaaaguguaauuccgccugcauuacgccuaacggcucaaucccaaaugacaagcccuuucagaacgugaaucgaauaacuuacggugcuuguccuagauaugugaaacaaaacacacugaaacuugccaccgggaugaggaaugucccagaaaaacagacucggggaauuuucggcgcaaucgcuggcuuuaucgagaacgggugggaaggaaugguugacgguugguacggcuuccgucaccagaauagugaggggcgcggacaagccgcggaucuuaagagcacacaggccgcaauugaccagaucaacggcaaauugaacagacucauugguaagaccaaugagaaauuccaucagauagaaaaggaguuuuccgaaguggaggggaggauccaagaucuggaaaaguauguagaggacacgaaaauugauuuauggucuuacaacgcugagcugcucguggcccuugaaaaucagcacaccaucgaccugacagauagcgagaugaacaaguuguucgaaaagacuaagaaacagcuacgggagaaugcugaagacaugggcaacggaugcuuuaagaucuaucauaagugugauaaugccugcauuggcucaauacgaaacgggaccuacgaccacgaugucuaucgcgacgaggcacugaauaacagauuccagaucaaaggaguggagcucaagagugguuacaaagacuggauucuguggaucuccuuugccauuagcugcuuccuucuguguguugcuuugcucggcuuuaucaugugggcgugccaaaaggggaauauaagguguaacaucugcauuuga

SEQ ID NO: 130360 - RNA, 1701 nt, Artificial Sequence
  derived and/or modified sequence opt3 from hemagglutinin__InfluenzaA__AFD64823
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaggaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggacgauguaauucugcuugcaucacgccuaacggcuccauaccaaaugacaagcccuuucagaacgugaauagaauuacuuacggugccuguccuagguaugugaagcaaaacacacugaaacuugcaaccgggaugcggaaugucccagaaaagcagacucguggaaucuucggcgcuaucgccggcuuuauugagaacgggugggaaggaaugguugacgguugguacggcuuccgccaccaaaauucagaggggagaggacaggcggccgaucugaaaaguacacaggcagcuaucgaccagauuaacggcaaguugaacaggcucauagguaaaaccaaugagaaguuccaucagaucgaaaaagaguuuagcgaaguggaggggcggauucaagaucuggaaaaguauguagaggacacgaagaucgauuuaugguccuacaacgccgagcugcucguggcucuugaaaaucagcacaccaucgaccugacagauucugagaugaacaaauuguucgaaaagacuaaaaagcagcuacgagagaaugccgaagacaugggcaacggaugcuuuaaaauuuaucauaagugugauaaugcaugcauaggcagcauccgcaacgggaccuacgaccacgaugucuauagagacgaggcccugaauaacagguuccagauuaagggaguggagcucaaaucagguuacaaggacuggauccuguggauuaguuuugcuaucuccugcuuccuucuguguguugcguugcucggcuuuauaaugugggcaugccaaaaagggaauauccgguguaacauuugcaucuga

SEQ ID NO: 130361 - RNA, 1701 nt, Artificial Sequence
  derived and/or modified sequence opt3 from hemagglutinin__InfluenzaA__AFD64824
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaauugaccagaucaacggcaaauugaacagacucauugguaagacgaaugagaaauuccaucagauagaaaaggaguuuuccgaaguggaggggaggauccaagaucuggaaaaguauguagaggacaccaaaauugauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagaucuaucauaagugugauaaugccugcauuggcucaauacgaaacgggacauacgaccacgaugucuaucgcgacgaggcacugaauaacagauuccagaucaaaggaguggagcucaagagugguuacaaagacuggauucuguggaucuccuuugccacuagcugcuuccuucuguguguugcuuugcucggcuuuauuaugugggcgugccaaaaggggaauaucagguguaacauaugcaucuga

SEQ ID NO: 130362 - RNA, 1701 nt, Artificial Sequence; identical to SEQ ID NO: 130350
  derived and/or modified sequence opt3 from hemagglutinin__InfluenzaA__AFD64825

SEQ ID NO: 130363 - RNA, 1701 nt, Artificial Sequence; identical to SEQ ID NO: 130350
  derived and/or modified sequence opt3 from hemagglutinin__InfluenzaA__AFD64827

SEQ ID NO: 130364 - RNA, 1701 nt, Artificial Sequence
  derived and/or modified sequence opt3 from hemagglutinin__InfluenzaA__AFD64828
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaaacagacucggggaaucuucggcgcaaucgcuggcuuuauugagaacgggugggaaggaaugauggacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguugaggggaggauucaagaucuggaaaaguauguggaggacacgaaaaucgauuuauggucuuacaacgcugagcugcucguagcccuugaaaaucagcacaccaucgaccugacagauagcgagaugaacaaguuguucgaaaagacuaagaaacagcuacgggagaaugcugaagacaugggcaacggaugcuuuaagauuuaucauaagugugauaaugccugcauaggcucaauccgaaacgggaccuacgaccccgauguguaucgcgacgaggcacugaauaacagauuccagauuaaaggagucgagcucaagagugguuacaaagacuggauccuguggauuuccuuugccaucagcugcuuccuucuguguguggcuuugcucggcuuuauaaugugggcgugccaaaaggggaauaucagguguaacauuugcaucuga

SEQ ID NO: 130365 - RNA, 1701 nt, Artificial Sequence; identical to SEQ ID NO: 130359
  derived and/or modified sequence opt3 from hemagglutinin__InfluenzaA__AFD64830

SEQ ID NO: 130366 - RNA, 1701 nt, Artificial Sequence; identical to SEQ ID NO: 128998
  derived and/or modified sequence opt3 from hemagglutinin__InfluenzaA__AFD98095

SEQ ID NO: 130367 - RNA, 1701 nt, Artificial Sequence
  derived and/or modified sequence opt3 from hemagglutinin__InfluenzaA__AFD98106
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaaaaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaacccguggaaucuucggcgcaauugcuggcuuuaucgaaaacgggugggagggaaugauggaugguugguauggcuuccgccaccagaauagcgaggggagaggacaggccgcggaccugaaauccacucaagccgcaauugaucagauaaacggcaaguugaauaggcucaucgguaaaacaaacgaaaaguuccaucagauugagaaagaauuuucugaggucgaagggcggauccaggaccuggagaaguacguugaggauaccaagaucgacuuauggagcuauaacgcugaacugcucguggcccuugagaaucaacacacgauugaucugaccgacucagaaaugaacaaauuguucgagaagacaaagaagcagcuacgagaaaaugcugaggauaugggcaacggaugcuuuaaaauauaccauaagugugacaaugccugcaucggcaguauucgcaacgggacuuaugaucacgacguauacagagacgaggcacugaauaacagguuccagaucaagggaguggaacucaaauccgguuacaaggauuggauucuguggaucagcuuugccauaucuugcuuccuucugugugucgcuuugcucggcuuuaucaugugggcgugccagaaagggaauauucgguguaacaucugcauuuga

SEQ ID NO: 130368 - RNA, 1701 nt, Artificial Sequence
  derived and/or modified sequence opt3 from hemagglutinin__InfluenzaA__AFD98128
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcaacaguccacaccagauccuagacggcgaaaauuguacccucauagaugcucugcuuggggacccgcagugcgauggauuucagaacaaaaagugggaccuguucguggagagaagcaaagcccauuccaauuguuaucccuacgaugucccugacuaugcaucuuugaggucgcucguggccucaagcggcacucuggaauuuaacaaugagaguuucaacuggacagguguuacccagaaugggacguccucugcuugcaucagaaagagcaacaauuccuuuuucucacgccugaacuggcucacucacuuaaacuuuaaguacccagcacugaaugugaccaugcccaacaaugagcaguucgauaaacuuuauauuuggggaguccaucacccuggcacagacaaggaucagaucuuuuuguacgcccaagcugccggccgaauuacugugaguaccaaacguagccagcaggcgguaaucccaaacauagggucuagacccaggguucggaauauuccuucccgcgugucaaucuauuggacaauugucaagccaggagacauccugcuaaucaacagcaccgguaaucucauugcaccgagaggcuacuucaaaauaaggagugggaagucuuccaucaugcggagcgaugcccccauuggaaaguguaacucggcuugcaucacgccuaauggcucuauaccaaacgacaaacccuuucagaaugugaaccgcauuacuuacggugccuguccucgauaugugaagcaaaauacacugaaacuugcaaccgggaugagaaacgucccagaaaagcagacuaggggaaucuucggcgcuaucgccggcuuuauugagaaugggugggaaggaaugguugacgguugguacggcuuccggcaccagaacuccgaggggcguggacaagcggccgaucugaaaucaacacaggcagcuaucgaccagauuaacggcaaguugaaucgccucauagguaaaaccaacgagaaguuccaucagaucgaaaaggaguuuagugaaguggaggggcggauucaagaucuggaaaaauauguagaggacacgaagaucgauuuauggagcuacaaugccgagcugcucguggcucuugaaaaccagcacaccaucgaccugacagauuccgagaugaauaaauuguucgaaaagacuaaaaagcagcuaagggagaacgccgaagacaugggcaauggaugcuuuaagauuuaucauaaaugugauaacgcaugcauaggcucuauccggaaugggaccuacgaccacgaugucuaucgagacgaggcccugaacaaucgcuuccagauuaagggaguggagcucaaaagcgguuacaaggacuggauccuguggauuucauuugcuaucaguugcuuccuucuguguguugcguugcucggcuuuauaaugugggcaugccaaaaagggaacaucagauguaauauuugcaucuga

SEQ ID NO: 130369 - RNA, 1701 nt, Artificial Sequence; identical to SEQ ID NO: 128998
  derived and/or modified sequence opt3 from hemagglutinin__InfluenzaA__AFD98139

SEQ ID NO: 130370 - RNA, 1701 nt, Artificial Sequence
  derived and/or modified sequence opt3 from hemagglutinin__InfluenzaA__AFD98161
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucagcuggugagauuugcgacaguccacaccauauccuagauggcgaaaacuguacacucauagacgcccugcuuggggauccgcagugcgacggauuucagaauaaaaagugggaucuguucguggagagaagcagggcauauuccaacuguuaccccuaugacgucccugauuacgccucuuugcggucgcucguggcuucaagcggcacccuggaauuuaauaacgagaguuucaauuggacugguguuacacagaacgggaccuccucugcaugcauccgccgaagcaauaacuccuuuuucucacgucugaauuggcucacgcacuuaaacuuuaaauauccagcccugaacgugacuaugcccaauaacgagcaguucgacaaacuuuacauuuggggaguccaucacccuggcaccgauaaggaccagaucuuuuuguaugcucaggccaguggcagaauuacagugagcacuaaaaggucucaacaggcgguaaucccaaauauagggucccggccccgcguuagaaacauuccuucaaggaucagcauuuacuggaccaucgugaagccaggagauauccugcuaauuaauaguacagguaaccucauagcaccgcggggcuacuucaaaauccgcucugggaaguccagcauuaugcgaucggacgcccccaucggaaaauguaauucugaaugcauaaccccuaacggcuccauuccaaaugacaagcccuuucagaacgucaauagaaucacguauggugcuuguccuagguacgugaagcagucaacucugaaacuugccacagggaugcggaacgugccagagaagcaaacccguggaaucuucggcgcaauugcuggcuuuaucgaaaaugggugggagggaaugauggaugguugguauggcuuccgccaccagaacagugaggggagaggacaggccgcggaccugaaaagcacucaagccgcaauugaucagauaaauggcaaguugaacaggcucaucgguaaaacaaacgaaaaguuccaucagauugagaaagaauuuuccgaggucgaagggcggauccaggaccuggagaaguacguugaggauaccaagaucgacuuauggucuuauaaugcugaacugcucguggcccuugagaaccaacacacgauugaucugaccgacagcgaaaugaauaaauuguucgagaagacaaagaagcagcuacgagaaaacgcugaggauaugggcaauggaugcuuuaaaauauaccauaagugugacaacgccugcaucggcucaauucgcaaugggacuuaugaucacgacguauacagagacgaggcacugaacaauagguuccagaucaagggaguggaacucaaaagugguuacaaggauuggauucuguggaucuccuuugccauaagcugcuuccuucugugugucgcuuugcucggcuuuaucaugugggcgugccagaaagggaacauucgguguaauaucugcauuuga

SEQ ID NO: 130371 - RNA, 1701 nt, Artificial Sequence
  derived and/or modified sequence opt3 from hemagglutinin__InfluenzaA__AFD98172
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaaaaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaacccguggaaucuucggcgcaauugcuggcuuuaucgaaaacgggugggagggaaugauggaugguugguauggcuuccgccaccagaauagcgaggggagaggacaggccgcggaccugaaauccacucaagccgcaauugaucagauaaacggcaaguugaauaggcucaucgguaaaacaaacgaaaaguuccaucagauugagaaagaauuuucugaggucgaagggcggauccaggaccuggagaaguacguugaggauaccaagaucgacuuauggagcuauaacgcugaacugcucguggcccuugagaaucaacacacgauugaucugaccgacucagaaaugaacaaauuguucgagaagacaaagaagcagcuacgagaaaaugcugaggauaugggcaacggaugcuuuaaaauauaccauaagugugacaaugccugcaucggcaguauucgcaacgggacuuaugaucacgacguauacagagacgaggcacugaauaacagguuccagaucaagggaguggaacucaaauccgguuacaaggauuggguccuguggauuagcuuugccaucucuugcuuccuucuguguguggcuuugcucggcuuuauaaugugggcgugccagaaagggaauauccgguguaacauuugcaucuga

SEQ ID NO: 130372 - RNA, 1701 nt, Artificial Sequence
  derived and/or modified sequence opt3 from hemagglutinin__InfluenzaA__AFD98183
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagagaucccagcaggccguacugccaaauaucgggucaaggccccggguucgcaacauaccuagcagagugaguauuuauuggacaaucgucaaaccaggagacauucuacucaucaauucuaccgguaaccugaucgcgccgaggggcuacuucaagauucgguccgggaaaagcucgauaaugcgcucugaugcacccaucggaaaguguaauuccacgugcauuacuccuaacggcucaaucccaaaugacaagcccuuucagaacgugaaucgaauaacauacggugccuguccuagauaugugaaacaaaacacccuuaagcuggcuacugggaugaggaaugucccagaaaaacagacacggggaauuuucggcgccaucgcaggcuuuaucgagaacgggugggaaggaaugguugacgguugguacggcuuccgucaccagaauagugaggggcgcggacaagcugccgaucucaagagcacccaggcggccauugaccagaucaacggcaaauugaacagacugauugguaagacgaaugagaaauuccaucagauagaaaaggaguuuuccgaaguggaggggaggauccaagauuuagaaaaguauguagaggacaccaaaauugaucuguggucuuacaacgcagagcuccuuguggcucuggaaaaucagcacacaaucgacuugacugauagcgagaugaacaagcuauucgaaaagaccaagaaacagcugcgggagaaugccgaagacaugggcaacggaugcuuuaagaucuaucauaagugugauaaugcuugcauuggcucaauacgaaacgggacauacgaccacgaugucuaucgcgacgaggcccucaauaacagauuccagaucaaaggaguggagcugaagagugguuacaaagacuggauucuuuggaucuccuuugcaauuagcugcuuccuguuguguguugcccuccugggcuuuaucaugugggcuugccaaaaggggaauauaagguguaacaucugcauuuga

SEQ ID NO: 130373 - RNA, 1701 nt, Artificial Sequence; identical to SEQ ID NO: 128871
  derived and/or modified sequence opt3 from hemagglutinin__InfluenzaA__AFD98194

SEQ ID NO: 130374 - RNA, 1701 nt, Artificial Sequence; identical to SEQ ID NO: 128925
  derived and/or modified sequence opt3 from hemagglutinin__InfluenzaA__AFD98205

SEQ ID NO: 130375 - RNA, 1701 nt, Artificial Sequence; identical to SEQ ID NO: 130367
  derived and/or modified sequence opt3 from hemagglutinin__InfluenzaA__AFD98215

SEQ ID NO: 130376 - RNA, 1701 nt, Artificial Sequence; identical to SEQ ID NO: 128998
  derived and/or modified sequence opt3 from hemagglutinin__InfluenzaA__AFD98226

SEQ ID NO: 130377 - RNA, 1701 nt, Artificial Sequence
  derived and/or modified sequence opt3 from hemagglutinin__InfluenzaA__AFD98237
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcaauuccccacaccagauccuagacggcgaaaacuguacccucauagaugcucugcuuggggacccgcagugcgauggauuccaaaauaaaaagugggaccuguuuguggagagaucuaaagcccauucgaacuguuaucccuacgaugucccugacuaugcaucauugaggagccucguggccaguuccggcacucuggaguucaauaacgaaucuuuuaauuggacagguguuacccagaacgggacgagcuccgcuugcauccggcgcucaaauaacaguuucuuuagccgacugaauuggcucacucacuuaaacuucaaguacccagcacugaacgugaccaugcccaauaacgagcaguuugauaaacuuuauauuuggggaguccaucacccuggcacagacaaagaucagaucuucuuguacgcccaggcuucuggccguauuacuguguccaccaagagaucacaacaggccguaaucccaaauauagggagcaggccccggguucgcaacauuccuaguagagugucuaucuauuggacaauugucaaaccaggagacauccugcuaaucaauuccaccgguaaccucauugcgccgaggggcuacuuuaagauacggagcgggaaaucgucuaucaugcgcuccgaugcacccauuggaaaguguaauucagccugcaucacgccuaacggcaguauaccaaaugacaagcccuuccagaacgugaaucgaauuacuuacggugcuuguccuagauaugugaaacaaaacacacugaaacuugccaccgggaugaggaaugucccagaaaagcagacucggggaaucuuuggcgcaaucgcuggcuucauugagaacgggugggaaggaaugguugacgguugguacggcuuucgucaccagaauagcgaggggcgcggacaagccgcggaucugaaguccacacaggccgcaaucgaccagauuaacggcaaauugaacagacucauagguaagaccaaugagaaauuccaucagaucgaaaaggaguucucugaaguggaggggaggauucaagaucuggaaaaguauguagaggacacgaaaaucgauuuauggagcuacaacgcugagcugcucguggcccuugaaaaucagcacaccaucgaccugacagauucagagaugaacaaguuguuugaaaagacuaagaaacagcuacgggagaaugcugaagacaugggcaacggaugcuucaagauuuaucauaagugugauaaugccugcauaggcaguauccgaaacgggaccuacgaccacgaugucuaucgcgacgaggcacugaauaacagauuucagauuaaaggaguggagcucaaguccgguuacaaagacuggauccuguggauuagcuucgccaucucuugcuuucuucuguguguugcuuugcucggcuucauaaugugggcgugccaaaaggggaauaucagguguaacauuugcaucuga

SEQ ID NO: 130378 - RNA, 1701 nt, Artificial Sequence; identical to SEQ ID NO: 130370
  derived and/or modified sequence opt3 from hemagglutinin__InfluenzaA__AFD98248

SEQ ID NO: 130379 - RNA, 1701 nt, Artificial Sequence
  derived and/or modified sequence opt3 from hemagglutinin__InfluenzaA__AFD98259
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccaaagcauauucuaauuguuaccccuaugacguccaagauuacgccucguugaggucacucguggcuagcaguggcacccuggaauuuaacaaugaguccuucaacuggacugguguuacacagaaugggaccucuagcgcaugcauccggcgcuccaacaauucauuuuucagucgacugaacuggcucacgcacuuaaauuuuaaguauccugcccugaacgugacuaugccaaacaaugagcaguucgacaaacuuuacauuuggggaguccaucaccccggcaccgauaaggaccagaucuuuuuguaugcucaagccagcggccguauuacagugucuacuaagagaucccagcaggcgguaaucccuaacauagggucaaggccacggguucgcaauauucccagcagaaucaguauuuacuggaccaucgugaaaccuggagauauccugcuaauuaacucuacagguaaucucauagcaccaaggggcuacuucaagauccgguccgggaaaagcucgauuaugcgcucugacgccccgaucggaaaguguaacuccgaaugcauaacccccaauggcucaauuccuaacgacaagccauuucagaaugucaaccgaaucacguauggugcuugucccagauacgugaaacaaaguacucugaaacuugccacagggaugaggaaugugccugagaagcagacccggggaaucuucggcgcaauugcuggcuuuaucgaaaacgggugggagggaaugauggaugguugguauggcuuccgucaccagaauagcgaggggcgcggacaagccgcggaccugaaguccacucaggccgcaauugaucagauaaacggcaaauugaauagacucaucgguaagacaaacgaaaaauuccaucagauugagaaggaauuuucugaggucgaagggaggauccaagaccuggagaaguacguugaggauaccaaaaucgacuuauggagcuauaacgcugaacugcucguggcccuugagaaucagcacacgauugaucugaccgacucagaaaugaacaaguuguucgagaaaacaaagaaacagcuacgggaaaaugcugaggauaugggcaacggaugcuuuaagauauaccauaagugugacaaugccugcaucggcaguauucgaaacgggacuuaugaucacgacguauaccgcgacgaggcacugaauaacagauuccagaucaaaggaguggaacucaaguccgguuacaaagauuggauucuguggaucagcuuugccauaucuugcuuccuucugugugucgcuuugcucggcuuuaucaugugggcgugccaaaaggggaauauuagguguaacaucugcauuuga

SEQ ID NO: 130380 - RNA, 1701 nt, Artificial Sequence
  derived and/or modified sequence opt3 from hemagglutinin__InfluenzaA__AFD98270
augaaggccauccuggugguccuccuuuacaccuucguuacagcuaacgcagacacucugugcauuggcuaucacgccaauaacagcacggauaccguggacacaguauuggagaagaaugugacugucacccauuccgugaacuuacuggaagauaagcacaaugggaaacuauguaagcucagaggaguuacaccccugcaucuugguaaaugcaacauagcgggcuggauccuggggaauccugagugugaaucuuugucaaccgcuaguagcugguccuacauuguggagacuucuucgucagacaacggaacaugcuauccaggcgauuuuaucaauuacgaggagcucagggagcagcugagcagugucuccucuuucgaacgguuugagauuuucccgaacaccagcuccuggcccaaucacgacucaaacaagggugugacggccgcauguccucaugccggggcuaagaguuuuuauaaaaaucugaucuggcucguaaagaaaggaaacagcuacccaaaguuaucuaaauccuauauaaaugauaagggcaaggaaguucuggugcuuuggggcauccaccaccccucaacuaccgcagaccaacagagcuuguaccagaacgccgaugcuuacgucuucguggggacaagucgcuauucuaaaaaguuuaaaccugagauugccauccgaccaaaggugcgugaccaggagggaagaaugaacuacuauuggacucuggucgaacccggugauaaaauuaccuucgaggcgacaggcaaucuaguugugccuagguacgcauuugccauggaacggaacgcuggguccggaaucauaauuagcgacaccccaguacaugauugcaauacgacuugucaaacaccgaagggcgccaucaacaccucgcuccccuuccagaauauucacccuaucacuaucgguaaaugcccaaaguaugugaagucuacaaaacugcgccuugcaaccgggcugagaaacguccccuccauucagucaaggggauuguuuggcgcuauagccggcuucaucgaagggggauggacggguaugguggacggcugguacggguaucaucaccagaaugaacaaggaaguggcuacgcggccgaccucaagagcacccagaacgcaauugauaaaaucacaaauaagguuaacuccgugauagagaaaaugaauacucaguuuaccgcugucgguaaggaguucaaccaccuggaaaagcggauugagaauuuaaacaaaaagguggacgauggguuccuggacaucuggacauacaaugccgaacuccuuguacuguuggagaacgaacgcacucuagauuaucaugacucuaacguuaaaaaucuguacgagaaggugcgaaaccagcucaaaaauaacgcuaaggagaucggcaauggauguuuugaguucuaucacaagugcgauaacaccuguauggaaagcgucaaaaauggcacauacgacuauccuaaguacucagaagaggccaaacugaacagagaagagauugauggggugaaacuugagaguaccaggaucuaucaaauucuggcaauauacuccacugucgccagcucuuuggugcucguugugucacugggagcuaucaguuuuuggaugugcagcaaugguuccuuacagugccggauuuguaucuga

SEQ ID NO: 130381 - RNA, 1701 nt, Artificial Sequence
  derived and/or modified sequence opt3 from hemagglutinin__InfluenzaA__AFD98280
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugacucuuugucaacagcaaggaguuggagcuacauuguugaaaccuccucuucggauaacggaacuugcuauccaggcgacuuuaucgauuacgaggaacuccgggagcagcugucaagcgugaguuccuucgagcgcuuugaaauuuucccgaagacaucuagcuggcccaaucacgacuccaacaagggugucaccgccgcuuguccucaugcaggggccaaaggauuuuauaagaaucugaucuggcucgugaaaaagggcaacucauacccaaaauuaaguaagagcuauauaaaugauaagggcaaagagguacugguucuuugggggauccaccaccccucuacgacugcugaccaacaguccuuguaccagaacgccgauaccuacguguucgucggaacaucacgauauagcaagaaauuuaagccugaaauugcgauccguccaaaagugagagaccaggaggguaggaugaauuacuauuggacucugguggagcccggcgauaagauuaccuucgaagcaacagggaaccuagucguuccucgguacgccuuugcuauggagcgcaacgccggaaguggcaucauaauuucugacaccccagugcaugacugcaauacgacuugucaaacaccgaaaggugcaaucaacaccucccuccccuuccagaauauucacccuaucacuaucgggaagugcccaaaguauguaaaaagcacaaagcugagacuugcuaccggacugaggaacgugcccucgauucagucucggggcuuguuuggcgccauagcgggguucaucgaaggagguuggacgggcauggucgaugggugguacggauaucaucaccagaaugagcaaggcuccgguuacgccgcagaccucaaaucaacccagaacgcuauugauaagaucacaaauaaagugaacaguguuauagaaaagaugaauacucaguuuaccgccguggggaaggaguucaaccaccuggagaaacgcauugaaaauuuaaacaagaaagucgacgauggcuuccuggacaucuggacauacaaugcugagcuccuugugcuguuggaaaacgagcgaacucuagauuaucaugacagcaauguaaagaaccuguacgaaaaaguuagaaaccagcucaagaauaacgccaaggagaucggaaauggcuguuuugaguucuaucacaaaugcgauaacaccuguauggaauccgugaagaaugggacauacgacuauccuaaauacucugaggaagcaaagcugaacagggaggaaauugauggagucaaacuugagagcacccggaucuaucaaauucuggccauauacucaacuguggcuaguuccuugguccucgugguuagccugggugcgaucucuuuuuggaugugcucaaauggcaguuuacagugccguauuuguaucuga

SEQ ID NO: 130382 - RNA, 1701 nt, Artificial Sequence; identical to SEQ ID NO: 130359
  derived and/or modified sequence opt3 from hemagglutinin__InfluenzaA__AFD98290

SEQ ID NO: 130383 - RNA, 1701 nt, Artificial Sequence; identical to SEQ ID NO: 129102
  derived and/or modified sequence opt3 from hemagglutinin__InfluenzaA__AFD98310

SEQ ID NO: 130384 - RNA, 1701 nt, Artificial Sequence; identical to SEQ ID NO: 128470
  derived and/or modified sequence opt3 from hemagglutinin__InfluenzaA__AFD98320

SEQ ID NO: 130385 - RNA, 1701 nt, Artificial Sequence; identical to SEQ ID NO: 130370
  derived and/or modified sequence opt3 from hemagglutinin__InfluenzaA__AFD98340

SEQ ID NO: 130386 - RNA, 1701 nt, Artificial Sequence
  derived and/or modified sequence opt3 from hemagglutinin__InfluenzaA__AFD98351
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaaaaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaacccguggaaucuucggcgcaauugcuggcuuuaucgaaaacgggugggagggaaugauggaugguugguauggcuuccgccaccagaauagcgaggggagaggacaggccgcggaccugaaauccacucaagccgcaauugaucagauaaacggcaaguugaauaggcucaucgguaaaacaaacgaaaaguuccaucagauugagaaagaauuuucugaggucgaagggcggauccaggaccuggagaaguacguugaggauaccaagaucgacuuauggagcuauaacgcugaacugcucguggcccuugagaaucaacacacgauugaucugaccgacucagaaaugaacaaauuguucgagaagacaaagaagcagcuacgagaaaaugcugaggauaugggcaacggaugcuuuaaaauauaccauaagugugacaaugccugcaucggcacuauucgcaacgggaccuaugaucacgacguauacagagacgaggcacugaauaacagguuccagaucaagggaguggaacucaaaagugguuacaaggauuggauucuguggaucuccuuugccauaagcugcuuccuucugugugucgcuuugcucggcuuuaucaugugggcgugccagaaagggaauauucgguguaacaucugcauuuga

SEQ ID NO: 130387 - RNA, 1701 nt, Artificial Sequence
  derived and/or modified sequence opt3 from hemagglutinin__InfluenzaA__AFD98362
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacaaaauucuucaaccggugagauuugcgacaguccacaccagauccuagauggcgaaaacuguacacucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauccggcgcagcaauaacuccuuuuucucacgacugaauuggcucacgcauuuaaacuuuaaguauccagcacugaacgugacuaugcccaauaacgagcaguucgacaaacuuuacauuuggggaguccaccauccuggcaccgauaaggaccagaucuuuuuguaugcccaagcuaguggccguauuacagugagcacuaagagagggcagcaggccguaaucccaaauauaggaucuaggccccggguucgcaacauuccuuccagaaucucaauuuacuggaccaucgugaaaccaggugauauccugcuaauuaauagcacaggcaaccucauagcgccgaggggguacuucaagauccggaguggaaaaucuuccauuaugcgcagcgacgcacccaucggcaaguguaauucggaaugcauaaccccuaacgguucuauuccaaaugacaagcccuuucagaacgucaaucgaaucacguauggggccuguccuagauacgugaaacaaaacacucugaaacuugcuacaggaaugaggaaugugccagagaagcagacccggggcaucuucggcgccauugcaggguuuaucgaaaacggaugggaggguauggucgauggcugguauggguuccgucaccaaaauuccgagggacgcggccaggcugccgaccugaagucaacucaggcggccauugaucagauaaacgguaaauugaacagacucguugggaagacaaaugaaaaauuccaccagaucgagaaggaauuuagugagguggaaggcaggauucaagaccuggagaaguacguagaggauaccaaaaucgacuuauggagcuauaacgcagaacugcucguggcucuugagaaucagcauacgaucgaucugaccgacuccgaaaugaacaaguuguucgagaaaacaaagaaacagcuacgggaaaaugccgaggauaugggaaacggcugcuuuaagauuuaccacaagugugacaaugcuugcauagggucuauccgaaacggaacuuaugaucaugacgucuaccgcgacgaggcccugaauaacagauuccagauuaaagguguggaacucaagagcggcuacaaagauuggauccuguggauuucauuugcaaucaguugcuuccuucuguguguugccuugcucggguuuauaaugugggcuugccaaaagggaaauaucagguguaacauuugcaucuga

SEQ ID NO: 130388 - RNA, 1701 nt, Artificial Sequence; identical to SEQ ID NO: 130367
  derived and/or modified sequence opt3 from hemagglutinin__InfluenzaA__AFD98373

SEQ ID NO: 130389 - RNA, 1701 nt, Artificial Sequence; identical to SEQ ID NO: 128998
  derived and/or modified sequence opt3 from hemagglutinin__InfluenzaA__AFD98384

SEQ ID NO: 130390 - RNA, 1701 nt, Artificial Sequence
  derived and/or modified sequence opt3 from hemagglutinin__InfluenzaA__AFD98395
augaagaccaucauugcccugagcuacauacucugccuuguguucgcucagaaacugcccggcgacgauaacuccacagcaacuuuguguuuagggcaccaugccgucccuaauggaacgaucguuaagaccauuacaaacgaccaaaucgaggugacuaaugcgaccgaacugguacagaacucuucagcuggugagauuugcgauaguccacaccauauccuagacggcgaaaauuguacacucauagaugcccugcuuggggacccgcagugcgauggauuucagaacaaaaagugggaccuguucguggagagaagcagggcauauuccaauuguuaccccuaugaugucccugacuacgccucuuugcggucgcucguggcuucaagcggcacccuggaauuuaacaaugagaguuucaacuggacugguguuacacaaaaugggaccuccucugcaugcauccgccgaagcaacaauuccuuuuucucacgucugaacuggcucacgcacuuaaauuuuaaauauccagcccugaacgugacuaugcccaacaaugagcaguucgauaaacuuuacauuuggggaguccaucacccuggcaccgacaaggaucagaucuuuuuguaugcucaggccaguggcagaauuacagugagcacuaaaaggucucaacaggcgguaaucccaaacauagggucccggccccgcguuagaaauauuccuucaaggaucagcauuuacuggaccaucgugaagccaggagacauccugcuaauuaacaguacagguaaucucauagcaccgcggggcuacuucaaaauccgcucugggaaguccagcauuaugcgaucggacgcccccaucggaaaauguaacucugaaugcauaaccccuaauggcuccauuccaaacgauaagcccuuucagaaugucaacagaaucacguauggugcuuguccuagguacgugaagcagucaacucugaaacuugccacagggaugcggaaugugccagagaagcaaacccguggaaucuucggcgcaauugcuggcuuuaucgaaaacgggugggagggaaugauggacgguugguauggcuuccgccaccagaauagugaggggagaggacaggccgcggaucugaaaagcacucaagccgcaauugaccagauaaacggcaaguugaauaggcucaucgguaaaacaaacgaaaaguuccaucagauugagaaagaauuuuccgaggucgaagggcggauccaggaucuggagaaguacguugaggacaccaagaucgauuuauggucuuauaacgcugaacugcucguggcccuugagaaucaacacacgauugaccugaccgauagcgaaaugaacaaauuguucgagaagacaaagaagcagcuacgagaaaaugcugaggacaugggcaacggaugcuuuaaaauauaccauaagugugauaaugccugcaucggcucaauucgcaacgggacuuaugaccacgacguauacagagaugaggcacugaauaacagguuccagaucaagggaguggaacucaaaagugguuacaaggacuggauucuguggaucuccuuugccauaagcugcuuccuucugugugucgcuuugcucggcuuuaucaugugggcgugccagaaagggaauauucgguguaacaucugcauuuga

SEQ ID NO: 130391 - RNA, 1701 nt, Artificial Sequence; identical to SEQ ID NO: 130367
  derived and/or modified sequence opt3 from hemagglutinin__InfluenzaA__AFD98406

SEQ ID NO: 130392 - RNA, 1701 nt, Artificial Sequence; identical to SEQ ID NO: 130370
  derived and/or modified sequence opt3 from hemagglutinin__InfluenzaA__AFD98417

SEQ ID NO: 130393 - RNA, 1701 nt, Artificial Sequence
  derived and/or modified sequence opt3 from hemagglutinin__InfluenzaA__AFD98428
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaauugaccagaucaacggcaaauugaacagacucauugguaagacgaaugagaaauuccaucagauagaaaaggaguuuuccgaaguggaggggaggauccaagaucuggaaaaguauguagaggacaccaaaauugauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagaucuaucauaagugugauaaugccugcauuggcucaauacgaaacgggacauacgaccacgaugucuaucgcgacgaggcacugaauaacagauuccagaucaaaggaguggagcucaagagugguuacaaagacuggauucuguggaucuccuuuacuauuagcugcuuccuucuguguguugccuugcucggcuuuaucaugugggcuugccaaaaggggaauauaagguguaacaucugcauuuga

SEQ ID NO: 130394 - RNA, 1701 nt, Artificial Sequence; identical to SEQ ID NO: 128883
  derived and/or modified sequence opt3 from hemagglutinin__InfluenzaA__AFD98439

SEQ ID NO: 130395 - RNA, 1701 nt, Artificial Sequence
  derived and/or modified sequence opt3 from hemagglutinin__InfluenzaA__AFD98449
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaaaacuucaauuggacagguguuacccagaacgggacguccucugcuugcauccggcgcagcaaaaauuccuuuuucucacgacugaacuggcucacucauuuaaauuuuaaauucccagcacugaacgugaccaugcccaacaaugagcaguuugacaaacuuuauauuuggggaguccaccauccuggcacagauaaggaccagaucuucuuguacgcccaagcuaguggccguauuacugugagcaccaagagaucucagcagacagccaucccaaacauaggguccaggccccggguacgcaauauuccuucaagaaucagcauuuauuggaccaucguuaaaccaggagauauccugcuaauuaacaguacggguaaucucauagcgccgaggggcuacuuuaagauccggucugggaaguccagcauuaugcgcucggacgcacccaucggaaaauguaacucugagugcauaacuccuaauggcuccauuccaaacgacaagcccuuccagaaugugaaccgaaucacauacggugccuguccuagauaugucaaacaaaauacccugaaacuugcuacugggaugaggaacgugccagaaaagcagacacggggaaucuuuggcgccauugcaggcuucaucgagaaugggugggaaggaaugguggaugguugguacggcuuccgucaccagaacucagaggggcgcggacaagcugccgaccugaagaguacccaggcggccauugaucagauaaauggcaaauugaacagacucaucgguaagacgaacgagaaguuucaccagauugaaaaagaguucagcgaagucgaggggaggauccaagaccuggaaaaguauguugaggauaccaaaaucgacuuaugguccuacaaugcagagcugcucguggcucuugaaaaccagcauacaauugaucugacugacucugagaugaauaaguuguuugaaaagaccaagaagcagcuacgggagaacgccgaagauaugggcaauggaugcuucaaaauauaucacaagugugacaacgcuugcaucggcagcauucgaaaugggacauacaaccaugauguauaucgcgacgaggcccugaauaacagauuucagaucaaaggaguggagcucaagucagguuacaaagacuggauucuguggaucaguuucgcaauauccugcuuucuucugugugucgccuugcucggcuucaucaugugggcuugccaaaaggggaauauuagguguaacaucugcauuuga

SEQ ID NO: 130396 - RNA, 1701 nt, Artificial Sequence
  derived and/or modified sequence opt3 from hemagglutinin__InfluenzaA__AFD98460
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucaguaaacugaacuggcucacgcacuuaaauuuuaaguauccagcccugaacgugacuaugcccaacaaugagcaguucgacaaacuuuacauuuggggaguccaucacccuggcaccgauaaggaccagaucuuuuuguaugcucaggccagcggccguauuacagugucuacuaagagaucccaacaggcgguaaucccaaacauagggucaaggccccggguucgcaauauuccuagcagaaucaguauuuacuggaccaucgugaaaccaggagauauccugcuaauuaacucuacagguaaucucauagcaccgaggggcuacuucaagauccgguccgggaaaagcucgauuaugcgcucugacgcccccaucggaaaguguaacuccgaaugcauaaccccuaauggcucaauuccaaacgacaagcccuuucagaaugucaaccgaaucacguauggugcuuguccuagauacgugaaacagaguacucugaaacuugccacagggaugaggaaugugccagagaagcaaacccggggaaucuucggcgcaauugcuggcuuuaucgaaaacgggugggagggaaugauggaugguugguauggcuuccgucaccagaauagcgaggggcgcggacaggccgcggaccugaaguccacucaagccgcaauugaucagauaaacggcaaauugaauagacucaucgguaagacaaacgaaaaauuccaucagauugagaaggaauuuucugaggucgaagggaggauccaggaccuggagaaguacguugaggauaccaaaaucgacuuauggagcuauaacgcugaacugcucguggcccuugagaaucaacacacgauugaucugaccgacucagaaaugaacaaguuguucgagaaaacaaagaaacagcuacgggaaaaugcugaggauaugggcaacggaugcuuuaagauauaccauaagugugacaaugccugcaucggcaguauucgaaacgggacuuaugaucacgacguauaccgcgacgaggcacuguccaauagauuccagaucaaaggaguggaacucaagagcgguuacaaagauuggauucuguggaucucuuuugccauaucaugcuuccuucugugugucgcuuugcucggcuuuaucaugugggcgugccagaaggggaacauuagguguaauaucugcauuuga

SEQ ID NO: 130397 - RNA, 1701 nt, Artificial Sequence; identical to SEQ ID NO: 128883
  derived and/or modified sequence opt3 from hemagglutinin__InfluenzaA__AFD98471

SEQ ID NO: 130398 - RNA, 1701 nt, Artificial Sequence
  derived and/or modified sequence opt3 from hemagglutinin__InfluenzaA__AFD98481
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcaacaguccacaccagauccuagacggcgaaaauuguacccucauagaugcucugcuuggggacccgcagugcgauggauuucagaacaaaaagugggaccuguucguggagagaagcaaagcccauuccaauuguuaucccuacgaugucccugacuaugcaucuuugaggucgcucguggccucaagcggcacucuggaauuuaacaaugagaguuucaacuggacagguguuacccagaaugggacguccucugcuugcauccggcgcagcaacaauuccuuuuucucacgacugaacuggcucacucacuuaaacuuuaaguacccagcacugaaugugaccaugcccaacaaugagcaguucgauaaacuuuauauuuggggaguccaucacccuggcacagacaaagaucagaucuuuuuguacgcccaagcugccggccguauuacugugaguaccaagagaagccagcaggcgguaaucccaaacauagggucuaggccccggguucgcaauauuccuuccagagugucaaucuauuggacaauugucaaaccaggagacauccugcuaaucaacagcaccgguaaucucauugcaccgaggggcuacuucaagauacggagugggaaaucuuccgugaugcgcagcgaugcccccaucggaaaguguaacucggcuugcauuacgccuaauggcucuaucccaaacgacaagcccuuucagaaugugaaccgaauaacuuacggugccuguccuagauaugucaaacaaaauacacugaaacuugcaaccgggaugaggaacguuccagaaaagcagacucggggaauuuucggcgcuaucgccggcuuuaucgagaaugggugggaaggaaugguggacgguugguacggcuuccgucaccagaacuccgaggggcgcggacaagcggccgaucugaagucaacacaggcagcuauugaccagaucaacggcaaauugaauagacucauugguaagaccaacgagaaauuccaucagauagaaaaggaguuuagugaaguagaggggaggauccaagaucuggaaaaguauguggaggacacgaaaauugauuuauggagcuacaaugccgagcugcucgucgcucuugaaaaccagcacaccaucgaccugacagauuccgagaugaauaaguuguucgaaaagacuaagaaacagcuacgggagaacgccgaagacaugggcaauggaugcuuuaagaucuaucauaagugugauaacgcaugcauuggcucuauacgaaaugggaccuacgaccacgauguguaucgcgacgaggcccugaacaauagauuccagaucaaaggaguugagcucaagagcgguuacaaagacuggauucuguggaucucauuugcuauuaguugcuuccuucuguguguggcguugcucggcuuuaucaugugggcaugccaaaaggggaacauaagguguaauaucugcauuuga

SEQ ID NO: 130399 - RNA, 1701 nt, Artificial Sequence; identical to SEQ ID NO: 128998
  derived and/or modified sequence opt3 from hemagglutinin__InfluenzaA__AFD98492

SEQ ID NO: 130400 - RNA, 1701 nt, Artificial Sequence
  derived and/or modified sequence opt3 from hemagglutinin__InfluenzaA__AFD98503
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaagaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaaccaaaggaaucuucggcgcaauugcuggcuuuaucgaaaacgggugggagggaaugauggaugguugguauggcuuccgucaccagaauagcgaggggcgcggacaggccgcggaccugaaguccacucaagccgcaauugaucagauaaacggcaaauugaauagacucaucgguaagacaaacgaaaaauuccaucagauugagaaggaauuuucugaggucgaagggaggauccaggaccuggagaaguacguugaggauaccaaaaucgacuuauggagcuauaacgcugaacugcucguggcccuugagaaucaacacacgauugaucugaccgacucagaaaugaacaaguuguucgagaaaacaaagaaacagcuacgggaaaaugcugaggauaugggcaacggaugcuuuaagauauaccauaagugugacaaugccugcaucggcaguauucgaaacgggacuuaugaucacgacguauaccgcgacgaggcacugaauaacagauuccagaucaaaggaguggaacucaaguccgguuacaaagauuggauucuguggaucagcuuugccauaucuugcuuccuucugugugucgcuuugcucggcuuuaucaugugggcgugccagaaggggaauauuagguguaacaucugcauuuga

SEQ ID NO: 130401 - RNA, 1701 nt, Artificial Sequence; identical to SEQ ID NO: 128998
  derived and/or modified sequence opt3 from hemagglutinin__InfluenzaA__AFD98514

SEQ ID NO: 130402 - RNA, 1701 nt, Artificial Sequence; identical to SEQ ID NO: 130350
  derived and/or modified sequence opt3 from hemagglutinin__InfluenzaA__AFD98525

SEQ ID NO: 130403 - RNA, 1701 nt, Artificial Sequence; identical to SEQ ID NO: 128871
  derived and/or modified sequence opt3 from hemagglutinin__InfluenzaA__AFD98558

SEQ ID NO: 130404 - RNA, 1701 nt, Artificial Sequence
  derived and/or modified sequence opt3 from hemagglutinin__InfluenzaA__AFD98569
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaccuuuuuguacgcccaagcuagcggccguaucacugugucuacaaagagaucccagcaggccguaauuccaaauaucgggucaaggccccggguucgcaacauaccuagcagagugaguauuuauuggaccaucgucaaaccaggagacauucugcuaaucaauucuacggguaaccucaucgcgccgaggggcuacuucaagauucgguccgggaaaagcucgauaaugcgcucugaugcacccaucggaaaguguaauuccgccugcauuacuccuaacggcucaaucccaaaugacaagcccuuucagaacgugaaucgaauaacauacggugcuuguccuagauaugugaaacaaaacacccugaaacuugccacugggaugaggaaugucccagaaaaacagacacggggaauuuucggcgcaaucgcuggcuuuaucgagaacgggugggaaggaaugguugacgguugguacggcuuccgucaccagaauagugaggggcgcggacaagccgcggaucuuaagagcacccaggccgcaauugaccagaucaacggcaaauugaacagacucauugguaagacgaaugagaaauuccaucagauagaaaaggaguuuuccgaaguggaggggaggauccaagaucuggaaaaguauguagaggacaccaaaauugauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagaucuaucaugagugugauaaugccugcauuggcucaauacgaaacgggacauacgaccacgaugucuaucgcgacgaggcacugaauaacagauuccagaucaagggaguggaacucaaaagugguuacaaggacuggauucuguggaucuccuuugccauuagcugcuuccuucuguguguugcuuugcucggcuuuaucaugugggcgugccaaaaagggaauauaagguguaacaucugcauuuga

SEQ ID NO: 130405 - RNA, 1701 nt, Artificial Sequence; identical to SEQ ID NO: 128871
  derived and/or modified sequence opt3 from hemagglutinin__InfluenzaA__AFD98580

SEQ ID NO: 130406 - RNA, 1701 nt, Artificial Sequence
  derived and/or modified sequence opt3 from hemagglutinin__InfluenzaA__AFE02942
augaaggccauccuggugguccuccuuuacaccuucgcuacagcaaacgccgacacucugugcauuggcuaucacgcgaauaacagcacggauaccguugacacauuguuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuaacucggacaauggaacuugcuauccaggcgauuuuaucgacuacgaagaacugagggagcagcugucaagcguuaguuccuucgaacgguuugagauuuucccgaagacaucuagcuggcccaaccacgauuccaauaagggugugaccgccgcuuguccucaugcaggggccaaaucauuuuauaagaaccucaucugguuagucaaaaagggaaauaguuacccaaaacugagcaagucuuauauaaacgacaagggcaaagaagugcuuguauuguggggcauccaccaccccuccacgucagcugaucaacagagccuguaccagaaugccgacgcguacguuuucguguggaccagucgcuauucuaagaaauuuaagccugagauugcaauccgaccaaaaguccgugaucaggaggggagaaugaacuacuauuggacucuaguggaacccggagacaagauuacauucgaggccacugguaaccucguggucccuagguacgcuuuugccauggaucggaaugcaggcuccgggaucauaauuagcgacaccccaguucaugacugcaacacaaccugucaaacgccgaaaggagcuaucaauacuucgcugcccuuccagaacauucacccuaucacaaucggcaagugcccaaaguaugugaaaucuaccaagcugcgccuugccacugguuugagaaauguacccuccauucagucaagggggcucuuuggagcgauagccggcuucaucgaaggcggguggacaggaaugguggaugguugguacggcuaucaucaccagaacgagcaagggaguggauacgcagcugaccugaaaagcacccagaaugccauugaugaaaucacgaacaaggucaauuccgugauagagaaaaugaacacccaguuuacagcuguuggcaaggaguucaaucacuuagaaaagcggauugagaaccugaauaaaaagguggacgaugguuuccucgacaucuggacuuacaacgccgaacuucuggucuugcuagagaaugaacgcacccuggauuaucaugacucuaacgugaaaaaccucuacgagaagguacgaagccagcugaaaaauaacgcaaaggagaucgggaauggcuguuuugaguucuaucacaagugcgauaacacauguauggagucaguuaaaaauggaacuuacgacuauccuaaguacagugaagaggccaaacuuaacagagaagagauugauggcgugaagcuggaguccaccaggaucuaucaaauuuuggcuauauacagcacagucgcgucuucacucgugcuggucgugaguuuaggggcaaucagcuuuuggaugugcuccaauggaucucugcagugccggauuuguaucuga

SEQ ID NO: 130407 - RNA, 1701 nt, Artificial Sequence; identical to SEQ ID NO: 125849
  derived and/or modified sequence opt3 from hemagglutinin__InfluenzaA__AFE18688

SEQ ID NO: 130408 - RNA, 1701 nt, Artificial Sequence; identical to SEQ ID NO: 122666
  derived and/or modified sequence opt3 from hemagglutinin__InfluenzaA__AFE47624

SEQ ID NO: 130409 - RNA, 1701 nt, Artificial Sequence; identical to SEQ ID NO: 123416
  derived and/or modified sequence opt3 from hemagglutinin__InfluenzaA__AFE47635

SEQ ID NO: 130410 - RNA, 1701 nt, Artificial Sequence; identical to SEQ ID NO: 128998
  derived and/or modified sequence opt3 from hemagglutinin__InfluenzaA__AFF18506

SEQ ID NO: 130411 - RNA, 1701 nt, Artificial Sequence
  derived and/or modified sequence opt3 from hemagglutinin__InfluenzaA__AFF57124
augaaggccauccuggugguccuccuuuacaccuucgcuacagcaaacgccgacacucugugcauuggauaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaaggaaaauagcuacccaaaauuaucuaaguccuauauaaacgauaagggaaaagagguacugguucuuuggggcauccaccaccccucaacgacugcugaccaacagcgcuuguaccagaaugccgaugcguacguguucgucggcaccagccgauauaguaagaaauuuaagccugagauugcaauccguccaaaagugagagaccaggaagggaggaugaacuacuauuggacacugguggagcccggagauaagauuacuuucgaagccaccgguaaccuagucguuccucgguacgcuuuugccauggagcgcaaugcaggcucugggaucauaauuuccgacacaccagugcaugauugcaacaccacgugucaaacuccgaaaggagcuaucaauacaagccuccccuuccagaacauucacccuaucaccaucggcaagugcccaaaguauguaaaaucgacuaagcugagacuugccacaggucugaggaaugugcccucuauucagucccggggguuguuuggagcgauagccggcuucaucgaaggcggguggaccggaauggucgacgguugguacggcuaucaucaccagaacgagcaagggucaggauacgcagcugaccucaaaaguacgcagaaugccauugauaagaucaccaacaaagugaauagcguuauagagaagaugaacacacaguuuacugcugugggcaaggaguucaaucaccuggagaaacgcauugaaaacuuaaauaagaaagucgacgaugguuuccuggacaucuggaccuacaacgccgagcuccuugugcuguuggaaaaugagcgaacacuagauuaucaugacuccaacguaaagaaccuguacgagaaaguuagaaaucagcucaagaacaaugcaaaggaaaucgggaacggcuguuuugaguucuaucacaaaugcgauaauacuuguauggaaucugugaagaacggaaccuacgacuauccuaaauacagcgaggaagccaagcugaauagggaggagauugauggcgucaaacuugaaucaacacggaucuaucaaauucuggcuauauacaguaccguggcguccagcuugguccucgugguuucucugggggcaaucucauuuuggaugugcaguaacggcagcuuacagugccguauuuguaucuga

SEQ ID NO: 130412 - RNA, 1701 nt, Artificial Sequence
  derived and/or modified sequence opt3 from hemagglutinin__InfluenzaA__AFF57128
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcauuuaccagaaugccgaugcguacguguucgucgggaccagucgcuauucuaagaaauuuaagccugagaucgcaauucgaccaaaagugcgugaccaggagggaagaaugaacuacuauuggacauugguggaacccggugauaagaucacuuucgaggccaccggcaaccuggucguuccuagguacgcuuuugccauggaacggaaugcaggguccggaauaauuaucagcgacacaccagugcaugauugcaacaccacgugucaaacuccgaaaggcgcuauuaauacaucgcuacccuuccagaacauccacccuaucaccauugguaagugcccaaaguauguaaaaucuacuaagcuccgccuggccacagggcuuagaaaugugcccuccauacagucaaggggacuguuuggcgcgaucgccggcuucauugaagggggauggaccgguauggucgacggcugguacggguaucaucaccagaacgaacaaggaaguggcuacgcagcugacuugaaaagcacgcagaaugccaucgauaagauaaccaacaaaguuaauuccgugauugagaagaugaacacacaguuuacugcuguggguaaggaguucaaucaccucgaaaaacggaucgagaaccugaauaagaaagucgacgauggguucuuagacaucuggaccuacaacgccgaacugcucgugcuucuggagaaugaacgcacauuggauuaucaugacucuaacguaaagaaccuauacgagaaaguucgaaaucagcugaagaacaaugcaaaggagauuggcaacggauguuuugaguucuaucacaaaugcgauaauacuuguauggaaagcgugaagaacggcaccuacgacuauccuaaauacucagaagaggccaagcucaauagagaagagaucgauggggucaaacuggagaguacaaggauuuaucaaauacuugcuaucuacuccaccguggcgagcucucuggucuuggugguuucacucggagcaauuaguuuuuggaugugcagcaacgguucccugcagugccggaucuguaucuga

SEQ ID NO: 130413 - RNA, 1701 nt, Artificial Sequence
  derived and/or modified sequence opt3 from hemagglutinin__InfluenzaA__AFF57132
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucaauuuaccagaacgccgacaccuacguguucgucggaacaagccgcuauaguaagaaauuuaagccugagaucgcgauucgaccaaaagugcgugaucaggaggguagaaugaauuacuauuggacuuugguggaacccggcgacaagaucaccuucgaggcaacagggaaccuggucguuccuagguacgccuuugcuauggaacggaacgccggaucuggcauaauuaucuccgauaccccagugcaugacugcaauacgacuugucaaacaccgaaaggugcaauuaacaccagccuacccuuccagaauauccacccuaucacuauugggaagugcccaaaguauguaaaaucgacaaagcuccgccuggcuaccggacuuagaaacgugcccucuauacaguccaggggccuguuuggcgccaucgcgggguucauugagggagguuggacgggcauggucgacgggugguacggauaucaucaccagaaugaacaaggcucagguuacgccgcagauuugaaaaguacccagaacgcuaucgacaagauaacaaauaaagugaacagcguuauugagaagaugaauacucaguuuaccgccguggggaaggaguucaaccaccucgaaaaacggaucgagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagauuggaaauggcuguuuugaguucuaucacaaaugcgacaacaccuguauggagucugugaagaaugaaacauacgauuauccuaaauacagcgaggaagcaaagcucaacagagaggagaucgacggggucaaacuggaaucaaccaggauuuaucaaauacuugccaucuacaguacuguggcuuccagccuggucuuggugguuucucucggagcgauuucauuuuggaugugcaguaaugguagccugcagugccggaucuguaucuga

SEQ ID NO: 130414 - RNA, 1701 nt, Artificial Sequence
  derived and/or modified sequence opt3 from hemagglutinin__InfluenzaA__AFF57136
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugauagagagggaaggaugaauuacuauuggacucugguggaacccggugacaagauuaccuucgaggccacaggcaaccuagucguuccucgguacgcuuuugccauggaacgcaacgcagggucgggaaucauaauuucugauacuccaguguaugacugcaauaccacaugucagaccccgaaaggcgcuaucaacacgucccuccccuuccaaaauauucauccuaucacuaucgguaagugcccaaaguacguaaaaucaacaaagcugagacuugccaccgggcugaggaacgugcccaguauucagagccggggauuguuuggcgcgauagccggcuucaucgaagggggauggacugguauggucgacggcugguauggguaccaccaucagaaugaacagggauccggcuacgcagcugaucucaaaucuacacaaaacgccauugacgagaucaccaauaaggugaacagcguuauagagaaaaugaauacgcaguuuaccgcuguggguaaggaguucaaccaccuggaaaagcgcauugaaaauuuaaacaaaaaggucgaugacggguuccuggauaucuggacauauaaugccgagcuccuugugcuguuggaaaacgagcgaacucuagacuaccacgauucaaauguaaagaaccuguaugagaagguuagaagucagcucaaaaacaaugcaaaggaaaucggcaacggauguuuugaguucuaccauaagugcgacaauaccuguauggaauccgugaaaaacggcacauaugauuacccuaaguauagcgaggaagccaaacugaauagggaggagauugacggggucaaacuugaaucuacucggaucuaccagauucuggcuauauacucaaccguggcgaguagcuugguccucgugguuucccugggagcaaucucuuuuuggaugugcucgaacgguagcuuacaaugccguauuuguaucuga

SEQ ID NO: 130415 - RNA, 1701 nt, Artificial Sequence
  derived and/or modified sequence opt3 from hemagglutinin__InfluenzaA__AFF57144
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgaugaccaacagaguuuguaccagaacgaggaugcuuacguguucgucgggucuucccgcuauagcaagaaauuuaagccugagauugccauccgaccaaaagugcgugacagagaaggaaggaugaauuacuauuggacucugguggagcccggugauaagauuaccuucgaagcgacaggcaaccuagucguuccucgguacgcauuugccauggagcgcaacgcugggucgggaaucauaauuucugacacuccagugcaugacugcaauaccacaugucagaccccgaaaggcgccaucaacacgucccuccccuuccaaaauauucacccuaucacuaucgguaagugcccaaaguauguaaaaucaacaaagcugagacuugcaaccgggcugaggaacgugcccaguauucagagccggggauuguuuggcgcuauagccggcuucaucgaagggggauggacugguauggucgauggcugguacggguaucaucaccagaaugagcagggauccggcuacgcggccgaccucaaaucuacacaaaacgcaauugaugagaucaccaauaaggugaacagcguuauagaaaagaugaauacgcaguuuaccgcuguggguaaggaguucaaccaccuggaaaagcgcauugagaauuuaaacaaaaaggucgacgauggguuccuggacaucuggacauacaaugccgaacuccuugugcuguuggagaacgagcgaacucuagauuaucaugacucaaauguuaaaaaccuguacgaaaagguaagaagucagcucaaaaacaaugcuaaggagaucggcaacggauguuuugaguucuaucacaagugcgauaauaccuguauggaguccgugaaaaacggcacauacgacuauccuaaguacagcgaagaggccaaacugaauagggaggaaauugauggggucaaacuugagucuacucggaucuaucagauucuggcaauauacucaaccguggccaguagcuugguccucgugguuucccugggagcuaucucuuuuuggaugugcucgaacgguagcuuacaaugccguauuuguaucuga

SEQ ID NO: 130416 - RNA, 1701 nt, Artificial Sequence
  derived and/or modified sequence opt3 from hemagglutinin__InfluenzaA__AFF57148
augaaggccauccuggugguccuccuuuacaccuucgcuacagcaaacgccgacacucugugcauuggcuaucacgcgaauaacagcacggauaccguugacacauuguuagagaaaaaugugacuguaacccauuccgugaaccugcuagaagauaagcacaaugggaaacucuguaagcugagaggagucgcuccccuucaucuggguaaaugcaacauagccggcuggaucuuggggaauccugagugugaaucucucucaacagcaaguagcugguccuacauuguggagaccucuucgucagacaacggaacuugcuauccaggcgauuuuaucgacuacgaagaacugagggagcagcugagcaguguuuccucuuucgaacgguuugagauuuucccgaagacaagcuccuggcccaaucacgauucaaacaagggugugaccgccgcuuguccucaugcaggggccaaaaguuuuuauaagaaucucaucugguuagucaaaaagggaaacagcuacccaaaacugucuaaguccuauauaaaugacaagggcaaagaagugcuuguauuguggggcauccaccaccccucaacgagcgaugaccaacagagucuguaccagaacgaggaugcuuacguuuucguggggucuucccgcuauagcaagaaauuuaagccugagauugccauccgaccaaaaguccgugacagagaaggaaggaugaauuacuauuggacucuaguggagcccggugauaagauuaccuucgaagcgacaggcaaccucguggucccucgguacgcauuugccauggagcgcaacgcugggucgggaaucauaauuucugacacuccaguucaugacugcaauaccacaugucagaccccgaaaggcgccaucaacacgucccugcccuuccaaaauauucacccuaucacuaucgguaagugcccaaaguaugugaaaucaacaaaacuuagacuggcaaccggguugaggaacguacccaguauucagagccggggacucuuuggcgcuauagccggcuucaucgaagggggauggacugguaugguggauggcugguacggguaucaucaccagaaugagcagggauccggcuacgcggccgaccugaaaucuacacaaaacgcaauugaugagaucaccaauaaggucaacagcgugauagaaaagaugaauacgcaguuuaccgcuguugguaaggaguucaaccacuuagaaaagcgcauugagaaucugaacaaaaagguggacgauggguuccucgacaucuggacauacaaugccgaacuucuggucuugcuagagaacgagcgaacucuggauuaucaugacucaaaugugaaaaaccucuacgaaaagguaagaagucagcugaaaaacaaugcuaaggagaucggcaacggauguuuugaguucuaucacaagugcgauaauaccuguauggaguccguuaaaaacggcacauacgacuauccuaaguacagcgaagaggccaaacuuaauagggaggaaauugauggggugaagcuggagucuacucggaucuaucagauuuuggcaauauacucaaccgucgccaguagccucgugcuggucguguccuuaggagcuaucucuuuuuggaugugcucgaacgguagccugcaaugccguauuuguaucuga

SEQ ID NO: 130417 - RNA, 1701 nt, Artificial Sequence
  derived and/or modified sequence opt3 from hemagglutinin__InfluenzaA__AFF57160
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucugaauccuauauaaaugacaagggcaaggagguacugguucuuuggggcauccaccaccccucaacgagcgcugaucaacagaguuuguaccagaacgaggacgccuacguguucgucgggucuucccgcuauagcaaaaaguuuaaaccugaaauugcgauccgaccaaaggugcgugauagagagggaaggaugaauuacuauuggacucugguggaacccggugacaaaauuaccuucgaggcaacaggcaaccuagucguuccucgguacgccuuugcuauggaacgcaacgccgggucgggaaucauaauuucugauacuccagugcaugacugcaauaccacaugucagaccccgaagggcgcaaucaacacgucccuccccuuccaaaauauucacccuaucacuaucgguaaaugcccaaaguauguaaagucaacaaaacugagacuugcuaccgggcugaggaacgugcccaguauucagagccggggauuguuuggcgccauagcgggcuucaucgaagggggauggacugguauggucgacggcugguacggguaucaucaccagaaugagcagggauccggcuacgccgcagaucucaagucuacacaaaacgcuauugacgaaaucaccaauaaagugaacagcguuauagagaagaugaauacgcaguuuaccgccguggguaaagaguucaaccaccuggaaaagcgcauugaaaauuuaaacaagaaagucgaugacggguuccuggauaucuggacauacaaugcugagcuccuugugcuguuggagaacgaacgaacucuagacuaucaugauucaaauguaaagaaccuguacgagaaaguuagaagucagcucaagaacaaugccaaagaaaucggcaacggauguuuugaguucuaucacaagugcgacaauaccuguauggaauccgugaagaacggcacauacgauuauccuaaauacagcgaggaggcaaagcugaauagggaagagauugacggggucaaacuugaaucuacucggaucuaucagauucuggccauauacucaaccguggcuaguagcuugguccucgugguuucccugggagcgaucucuuuuuggaugugcucgaacgguagcuuacaaugccguauuuguaucuga

SEQ ID NO: 130418 - RNA, 1701 nt, Artificial Sequence
  derived and/or modified sequence opt3 from hemagglutinin__InfluenzaA__AFF57164
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugagaaacuauguaagcucagagggguggcuccccugcaucuuggaaaaugcaacauagccgguuggauccugggcaauccugaaugugagucuuugucaacagcaaguagcugguccuacauuguugaaaccucuucgucagacaacgggacuugcuauccaggagauuuuaucgacuacgaggagcucagggaacagcugagcaguguguccucuuucgagcgguuugaaauuuucccgaagacaagcuccuggcccaaucacgauucaaacaagggcgucaccgccgcuuguccucaugccggugcaaaaaguuuuuauaagaaucugaucuggcucgugaaaaaggggaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggaucuucccgcuauagcaagaaauuuaagccugagauugcaauccgaccaaaagugcgugauagagaagggaggaugaauuacuauuggacucugguggagcccggagacaagauuaccuucgaagccacagguaaccuagucguuccucgguacgcuuuugccauggagcgcaacgcaggcucggggaucauaauuucugauacuccagugcaugacugcaauaccacaugucagaccccgaaaggagcuaucaacacgucccuccccuuccaaaauauucacccuaucacuaucggcaagugcccaaaguauguaaaaucaacaaagcugagacuugccaccggucugaggaacgugcccaguauucagagccggggguuguuuggagcgauagccggcuucaucgaaggcggguggacuggaauggucgacgguugguacggcuaucaucaccagaaugagcagggguccggauacgcagcugaucucaaaucuacacaaaacgccauugacgagaucaccaauaaggugaacagcguuauagaaaagaugaauacgcaguuuaccgcugugggcaaggaguucaaccaccuggaaaagcgcauugagaauuuaaacaaaaaggucgaugacgguuuccuggauaucuggacauacaaugccgaacuccuugugcuguuggagaacgagcgaacucuagacuaucaugauucaaauguuaaaaaccuguacgaaaagguaagaagucagcucaaaaacaaugcaaaggagaucgggaacggcuguuuugaguucuaucacaagugcgacaauaccuguauggaauccgugaaaaacggaacauacgauuauccuaaguacagcgaagaggccaaacugaauagggaggaaauugacggcgucaaacuugagucuacucggaucuaucagauucuggcuauauacucaaccguggcgaguagcuugguccucgugguuucccugggggcaaucucuuuuuggaugugcucgaacggcagcuuacaaugccguauuuguaucuga

SEQ ID NO: 130419 - RNA, 1701 nt, Artificial Sequence; identical to SEQ ID NO: 130418
  derived and/or modified sequence opt3 from hemagglutinin__InfluenzaA__AFF57168

SEQ ID NO: 130420 - RNA, 1701 nt, Artificial Sequence
  derived and/or modified sequence opt3 from hemagglutinin__InfluenzaA__AFF57172
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgaggacgccuacguguucgucgggucuucccgcuauagcaagaaauuuaagccugagauugcgauccgaccaaaagugcgugauagagaaggaaggaugaauuacuauuggacucugguggagcccggugacaagauuaccuucgaagcaacaggcaaccuagucguuccucgguacgccuuugcuauggagcgcaacgccgggucgggaaucauaauuucugauacuccagugcaugacugcaauaccacaugucagaccccgaaaggcgcaaucaacacgucccuccccuuccaaaauauucacccuaucacuaucgguaagugcccaaaguauguaaaaucaacaaagcugagacuugcuaccgggcugaggaacgugcccaguauucagagccggggauuguuuggcgccauagcgggcuucaucgaagggggauggacugguauggucgacggcugguacggguaucaucaccagaaugagcagggauccggcuacgccgcagaucucaaaucuacacaaaacgcuauugacgagaucaccaauaaggugaacagcguuauagaaaagaugaauacgcaguuuaccgccguggguaaggaguucaaccaccuggaaaagcgcauugagaauuuaaacaaaaaggucgaugacggguuccuggauaucuggacauacaaugcugaacuccuugugcuguuggagaacgagcgaacucuagacuaucaugauucaaauguuaaaaaccuguacgaaaagguaagaagucagcucaaaaacaaugccaaggagaucggcaacggauguuuugaguucuaucacaagugcgacaauaccuguauggaguccgugaaaaacggcacauacgauuauccuaaguacagcgaagaggcaaaacugaauagggaggaaauugacggggucaaacuugagucuacucggaucuaucagauucuggccauauacucaaccguggcuaguagcuugguccucgugguuucccugggagcgaucucuuuuuggaugugcucgaacgguagcuuacaaugccguauuuguaucuga

SEQ ID NO: 130421 - RNA, 1701 nt, Artificial Sequence
  derived and/or modified sequence opt3 from hemagglutinin__InfluenzaA__AFF57176
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaaggaaaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggaucuucccgcuauagcaagaaauuuaagccugagauugcaauccgaccaaaagugcgugauagagaagggaggaugaauuacuauuggacucugguggagcccggagacaagauuaccuucgaagccacagguaaccuagucguuccucgguacgcuuuugccauggagcgcaacgcaggcucggggaucauaauuucugauacuccagugcaugacugcaauaccacaugucagaccccgaaaggagcuaucaacacgucccuccccuuccaaaauauucacccuaucacuaucggcaagugcccaaaguauguaaaaucaacaaagcugagacuugccaccggucugaggaacgugcccaguauucagagccggggguuguuuggagcgauagccggcuucaucgaaggcggguggacuggaauggucgacgguugguacggcuaucaucaccagaaugagcagggguccggauacgcagcugaucucaaaucuacacaaaacgccauugacgagaucaccaauaaggugaacagcguuauagaaaagaugaauacgcaguuuaccgcugugggcaaggaguucaaccaccuggaaaagcgcauugagaauuuaaacaaaaaggucgaugacgguuuccuggauaucuggacauacaaugccgaacuccuugugcuguuggagaacgagcgaacucuagacuaucaugauucaaauguuaaaaaccuguacgaaaagguaagaagucagcucaaaaacaaugcaaaggagaucgggaacggcuguuuugaguucuaucacaagugcgacaauaccuguauggaguccgugaaaaacggaacauacgauuauccuaaguacagcgaagaggccaaacugaauagggaggaaauugacggcgucaaacuugagucuacucggaucuaucagauucuggcuauauacucaaccguggcgaguagcuugguccucgugguuucccugggggcaaucucuuuuuggaugugcucgaacggcagcuuacaaugccguauuuguaucuga

SEQ ID NO: 130422 - RNA, 1701 nt, Artificial Sequence
  derived and/or modified sequence opt3 from hemagglutinin__InfluenzaA__AFF57184
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaaggaaaacagcuaccaaaaauuaucuaaguccuauauaaaugacaagggaaaagagguacugguucuuuggggcauccaccacccaucaacgagcgcugaucagcagaguuuguaccagaacgccgacgcguacguguucgucggaucuucccgcuauagcaagaaauuuaagcccgagauugcaauccgaccuaaagugcgugauagagaagggaggaugaauuacuauuggacucugguggagccaggagacaagauuaccuucgaagccacagguaaccuagucguuccccgguacgcuuuugccauggagcgcaacgcaggcucggggaucauaauuucugauacuccugugcaugacugcaauaccacaugucaaaccccaaaaggagcuaucaacacgucccucccguuccagaauauucaccccaucacuaucggcaagugcccuaaguauguaaaaucaacaaagcugagacuugccaccggucugaggaacgugccaaguauucagagccggggguuguuuggagcgauagccggcuucaucgaaggcggguggacuggaauggucgacgguugguacggcuaucaucaccagaaugagcaaggguccggauacgcagcugaucucaaaucuacacagaacgccauugacgagaucaccaauaaggugaacagcguuauagaaaagaugaauacgcaguuuaccgcugugggcaaggaguucaaccaccuggaaaagcgcauugagaauuuaaacaaaaaggucgaugacgguuuccuggauaucuggacauacaaugccgaacuccuugugcuguuggagaacgagcgaacucuagacuaucaugauucaaauguuaaaaaccuguacgaaaagguaagaagucagcucaaaaacaaugcaaaggagaucgggaacggcuguuuugaguucuaucacaagugcgacaauaccuguauggaguccgugaaaaacggaacauacgauuaucccaaguacagcgaagaggccaaacugaauagggaggaaauugacggcgucaaacuugagucuacucggaucuaucaaauucuggcuauauacucaaccguggcgaguagcuugguccucgugguuucccugggggcaaucucuuuuuggaugugcucgaacggcagcuuacagugccguauuuguaucuga

SEQ ID NO: 130423 - RNA, 1701 nt, Artificial Sequence; identical to SEQ ID NO: 130415
  derived and/or modified sequence opt3 from hemagglutinin__InfluenzaA__AFF57188

SEQ ID NO: 130424 - RNA, 1707 nt, Artificial Sequence
  derived and/or modified sequence opt3 from hemagglutinin__InfluenzaA__AFF60787
auggagaagaucgugcuucucuucgccauugucagccuuguuaaauccgaccagauaugcaucggcuaccacgcuaacaauucuaccgaacaaguggauacaauuauggagaagaacguaacugugacgcaugcacaggacauccuggagaaaacccacaaugggaaguugugugauuuagacggagucaaaccccugauucuaagagauugcucaguggccgguuggcuccugggcaacccuaugugugacgaguuuaucaauguuccagaauggaguuauauaguggagaaggcgaacccggucaaugaucuuugcuaccccggggacuucaacgauuaugaggaacugaagcauuugcucagcaggaucaaucacuuugagaaaauucagaucauuccuaaguccucuuggucgucacaugaagcuagccugggagugaguuccgccuguccauaccagggcaaaucuagcuucuuucggaacguaguuuggcugaucaagaaaaauuccacauaucccacuauaaagcgcucauacaacaauaccaaccaagaggaccucuuagugcugugggguauucaccacccuaaugaugcagccgagcagacaaagcuguaucagaacccaaccacuuacaucagugucgggacaagcaccuugaaccagcgacuggugccccguauugcuacgagaucugaagugaauggacaauccggcaggauggaguucuuuuggacuauccuaaaaccuaacgacgcaaucaauuucgaaucaaacggcaauuuuauugccccagaguacgcuuauaagauagucaaaaagggggauagcaccaucaugaaaagugaacucgaguacggaaacugcaauacaaagugucagacuccgaugggugccauuaacucuuccaugcccuuccauaauauccacccucugaccauaggcgagugcccaaaauauguuaagagcaaccggcuugugcuggcgacaggguugcgcaauucgccccagagagaaaggcggcgcaagaaacgaggacucuuuggcgcaauugccgguuucaucgaagggggauggcagggcaugguagacggcugguacggguaucaucacucuaacgaacaaggauccgguuacgcugccgacaaggagucaacccagaaagcaaucgauggcgugacgaauaaggucaacaguauuaucgacaaaaugaauacucaguuugaagcuguggggagagaguucaacaaccuggagaggcggauugaaaauuuaaacaagaagauggaggauggauuccuggacguuuggacauauaaugccgaacuccuugugcugauggagaacgaacguaccuuggauuuucacgacagcaaugucaaaaaccuauacgauaaggugcgccugcaacucagagacaaugcgaaagagcugggcaacgguuguuucgaguuuuaccauaagugcgauaaugaauguauggaguccguaaggaacgggacuuaugacuacccucaguauucugaagaggcccggcuuaaacgagaggaaauaagcggcguuaagcuggagucaaucggaauuuaccagaucuugaguaucuauuccacaguggcaagcucucucgcucuggccauuauggucgcuggcuuaucacuguggaugugcaguaaugggagccuacagugccgcauauguaucuga

SEQ ID NO: 130425 - RNA, 1701 nt, Artificial Sequence
  derived and/or modified sequence opt3 from hemagglutinin__InfluenzaA__AFG29042
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccuuuucuucggacaacggaacuugcuauccaggcgauuucaucgacuacgaggagcucagggagcagcugucaagcgugaguuccuuugaacgguucgagauuuuuccgaagacaucuagcuggcccaaucacgauuccaacaagggugucaccgccgcuuguccucaugcaggggccaaaucauucuauaagaaucugaucuggcucgugaaaaagggaaacaguuacccaaaauuaagcaagucuuauauaaaugacaagggcaaagaaguacugguucuuuggggcauccaccaccccuccacgucagcugaucaacagagcuuguaccagaacgccgacgcguacguguuugucgggaccagucgcuauucuaagaaauucaagccugagauugcaauccgaccaaaagugcgugaucaggagggaagaaugaauuacuauuggacucugauugaacccggugacaagaucacauuugaggccacuggcaaccuaguggucccuagguacgcuuucgccauggaacggaacgcaggguccggaauaauuaucagcgauaccccaguucaugacugcaauacaaccugucaaacgccgaaaggcgcuauuaacacuucgcuccccuuucagaauauccacccuaucacaauugguaagugcccaaaguaugugaaaucuaccaagcugcgccuugccacugggcugagaaacguacccuccauacagucaaggggauuguucggcgcgaucgccggcuuuauugaagggggauggacagguaugguggacggcugguacggguaucaucaccagaaugaacaaggaaguggcuacgcagcugaucucaaaagcacccagaacgccaucgacgagauaacgaauaaggucaacuccgugauugagaaaaugaauacccaguucacagcuguugguaaggaguucaaccaccuggaaaagcggaucgaaaauuuaaacaaaaagguggaugacggguuucuggauaucuggacuuacaaugccgagcuccuuguccuguuggaaaacgagcgcacccuagacuaucaugauucuaaugugaaaaaccuguacgagaagguacgaagccagcucaaaaacaaugcaaaggaaauuggcaacggauguuucgaguuuuaucacaagugcgacaauacauguauggaaucaguuaaaaacggcacuuacgauuauccuaaguacagugaggaagccaaacugaauagagaggagaucgacggggugaaacuugaauccaccaggauuuaucaaauacuggcuaucuacagcacagucgcgucuucauuggugcucgucgugagucugggagcaauuagcuucuggaugugcuccaacgguucuuuacagugccggaucuguaucuga

SEQ ID NO: 130426 - RNA, 1701 nt, Artificial Sequence
  derived and/or modified sequence opt3 from hemagglutinin__InfluenzaA__AFG29044
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaaacucugacaauggaacuugcuauccgggcgauuuuaucgacuacgaagaacucagggagcagcugucgucagugagcaguuucgaacgguuugagauuuuccccaagacauccucuuggccuaaccacgauagcaauaagggugucaccgccgcuuguccacaugcaggggccaaauccuuuuauaagaaccugaucuggcucgugaaaaagggaaauucauaccccaaauuaaguaagagcuauauaaacgacaagggcaaagaaguacugguucuuuggggcauccaccacccuccaacgucuacugaucaacaguccuuguaccagaaugcugacgccuacguguucgucgggaccucacgcuauagcaagaaauuuaagcccgagauugcgauccgaccuaaagugcguggacaggaggguagaaugaacuacuauuggacacugguggaaccaggcgauaagauuacuuucgaggcaaccgggaaccuagucguuccgagguacgccuuugcuauggaacggaaugccggaaguggcaucauaauuucugacacacccgugcaugauugcaacaccacgugucaaacuccuaaaggugcaaucaauacaucccucccauuccagaacauucaccccaucaccaucgggaagugcccuaaguauguaaaaagcacuaagcugcgccuugcuacaggacugagaaaugugccaucgauucagucuaggggcuuguuuggcgccauagcgggguucaucgagggagguuggaccggcauggucgacgggugguacggauaucaucaccagaacgaacaaggcuccgguuacgccgcagaccucaaaucaacgcagaaugcuauugauaagaucaccaacaaagugaauaguguuauagagaagaugaacacacaguuuacugccguggggaaggaguucaaucaccuggaaaaacggauugagaacuuaaauaagaaagucgacgauggcuuccuggacaucuggaccuacaacgcugaacuccuugugcuguuggagaaugaacgcacacuagauuaucaugacagcaacguaaagaaccuguacgagaaaguucgaucccagcucaagaauaacgccaaggagaucggaaauggcuguuuugaguucuaucacaaaugcgauaacacuuguauggagucugugaagaaugggaccuacgacuaucccaaauacagcgaagaggcaaagcugaacagagaagagauugauggagucaaacuugagucaacaaggaucuaucaaauucuggccauauacaguaccguggcuuccagcuugguccucgugguuucucugggugcgaucucauuuuggaugugcaguaauggcagcuuacagugccggauuuguaucuga

SEQ ID NO: 130427 - RNA, 1701 nt, Artificial Sequence; identical to SEQ ID NO: 124685
  derived and/or modified sequence opt3 from hemagglutinin__InfluenzaA__AFG31060

SEQ ID NO: 130428 - RNA, 1701 nt, Artificial Sequence; identical to SEQ ID NO: 127240
  derived and/or modified sequence opt3 from hemagglutinin__InfluenzaA__AFG31070

SEQ ID NO: 130429 - RNA, 1701 nt, Artificial Sequence; identical to SEQ ID NO: 124672
  derived and/or modified sequence opt3 from hemagglutinin__InfluenzaA__AFG31080

SEQ ID NO: 130430 - RNA, 1701 nt, Artificial Sequence
  derived and/or modified sequence opt3 from hemagglutinin__InfluenzaA__AFG31100
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgaucugaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggaccagucgcuauucuaagaaauuuaagccugagauugcaauccgaccaaaagugcgugaucaggagggaagaaugaauuacuauuggacucuaguggaacccggugacaagauuacauucgaggccacuggcaaccucgucguuccuagguacgcuuuugccauggaacggaacgcaggguccggaaucauaauuagcgauaccccagugcaugacugcaauacaaccugucaaacgccgaaaggcgcuaucaacacuucgcugcccuuccagaauauucacccuaucacaaucgguaagugcccaaaguauguaaaaucuaccaaacuucgccuggccacuggguugagaaacgugcccuccauucagucaaggggacucuuuggcgcgauagccggcuucaucgaagggggauggacagguauggucgacggcugguacggguaucaucaccagaaugaacaaggaaguggcuacgcagcugaucugaaaagcacccagaacgccauugacgagaucacgaauaaggugaacuccguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauucuaauguaaagaaccucuacgagaagguucgaagccagcugaaaaacaaugcaaaggaaaucggcaacggauguuuugaguucuaucacaagugcgacaauacauguauggaaucagugaaaaacggcacuuacgauuauccuaaguacagugaggaagccaaacuuaauagagaggagauugacggggucaagcuggaauccaccaggaucuaucaaauuuuggcuauauacagcacaguggcgucuucacucguccugaucgugaguuuaggagcaauuagcuuuuggaugugcuccaacgguucucugcagugccggaucuguaucuga

SEQ ID NO: 130431 - RNA, 1701 nt, Artificial Sequence; identical to SEQ ID NO: 124685
  derived and/or modified sequence opt3 from hemagglutinin__InfluenzaA__AFG31110

SEQ ID NO: 130432 - RNA, 1701 nt, Artificial Sequence; identical to SEQ ID NO: 124927
  derived and/or modified sequence opt3 from hemagglutinin__InfluenzaA__AFG31120

SEQ ID NO: 130433 - RNA, 1701 nt, Artificial Sequence; identical to SEQ ID NO: 124927
  derived and/or modified sequence opt3 from hemagglutinin__InfluenzaA__AFG31130

SEQ ID NO: 130434 - RNA, 1701 nt, Artificial Sequence; identical to SEQ ID NO: 124927
  derived and/or modified sequence opt3 from hemagglutinin__InfluenzaA__AFG31140

SEQ ID NO: 130435 - RNA, 1701 nt, Artificial Sequence; identical to SEQ ID NO: 125787
  derived and/or modified sequence opt3 from hemagglutinin__InfluenzaA__AFG31150

SEQ ID NO: 130436 - RNA, 1701 nt, Artificial Sequence; identical to SEQ ID NO: 125787
  derived and/or modified sequence opt3 from hemagglutinin__InfluenzaA__AFG31160

SEQ ID NO: 130437 - RNA, 1701 nt, Artificial Sequence; identical to SEQ ID NO: 124685
  derived and/or modified sequence opt3 from hemagglutinin__InfluenzaA__AFG31170

SEQ ID NO: 130438 - RNA, 1701 nt, Artificial Sequence; identical to SEQ ID NO: 124685
  derived and/or modified sequence opt3 from hemagglutinin__InfluenzaA__AFG31180

SEQ ID NO: 130439 - RNA, 1701 nt, Artificial Sequence; identical to SEQ ID NO: 124685
  derived and/or modified sequence opt3 from hemagglutinin__InfluenzaA__AFG31190

SEQ ID NO: 130440 - RNA, 1701 nt, Artificial Sequence; identical to SEQ ID NO: 124685
  derived and/or modified sequence opt3 from hemagglutinin__InfluenzaA__AFG31200

SEQ ID NO: 130441 - RNA, 1701 nt, Artificial Sequence; identical to SEQ ID NO: 124685
  derived and/or modified sequence opt3 from hemagglutinin__InfluenzaA__AFG31210

SEQ ID NO: 130442 - RNA, 1701 nt, Artificial Sequence; identical to SEQ ID NO: 124685
  derived and/or modified sequence opt3 from hemagglutinin__InfluenzaA__AFG31220

SEQ ID NO: 130443 - RNA, 1701 nt, Artificial Sequence; identical to SEQ ID NO: 127240
  derived and/or modified sequence opt3 from hemagglutinin__InfluenzaA__AFG31230

SEQ ID NO: 130444 - RNA, 1701 nt, Artificial Sequence; identical to SEQ ID NO: 124685
  derived and/or modified sequence opt3 from hemagglutinin__InfluenzaA__AFG31240

SEQ ID NO: 130445 - RNA, 1701 nt, Artificial Sequence; identical to SEQ ID NO: 124685
  derived and/or modified sequence opt3 from hemagglutinin__InfluenzaA__AFG31250

SEQ ID NO: 130446 - RNA, 1701 nt, Artificial Sequence; identical to SEQ ID NO: 124685
  derived and/or modified sequence opt3 from hemagglutinin__InfluenzaA__AFG31260

SEQ ID NO: 130447 - RNA, 1701 nt, Artificial Sequence; identical to SEQ ID NO: 124685
  derived and/or modified sequence opt3 from hemagglutinin__InfluenzaA__AFG31270

SEQ ID NO: 130448 - RNA, 1701 nt, Artificial Sequence; identical to SEQ ID NO: 124685
  derived and/or modified sequence opt3 from hemagglutinin__InfluenzaA__AFG31280

SEQ ID NO: 130449 - RNA, 1701 nt, Artificial Sequence; identical to SEQ ID NO: 124685
  derived and/or modified sequence opt3 from hemagglutinin__InfluenzaA__AFG31290

SEQ ID NO: 130450 - RNA, 1701 nt, Artificial Sequence
  derived and/or modified sequence opt3 from hemagglutinin__InfluenzaA__AFG31300
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauuaacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaccaucagaacgaacaaggaagcggcuacgcagcugaucucaaauccacccagaaugccauugacgagaucacgaacaagguaaauucuguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucacgauagcaacgugaaaaaccuguacgagaagguucgaucacagcucaaaaauaacgcaaaggaaaucggcaauggauguuuugaguucuaucauaagugcgacaacacauguauggaaagugugaaaaauggcacuuacgauuauccuaaguacuccgaggaagccaaacugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 130451 - RNA, 1701 nt, Artificial Sequence; identical to SEQ ID NO: 127240
  derived and/or modified sequence opt3 from hemagglutinin__InfluenzaA__AFG31310

SEQ ID NO: 130452 - RNA, 1701 nt, Artificial Sequence; identical to SEQ ID NO: 124685
  derived and/or modified sequence opt3 from hemagglutinin__InfluenzaA__AFG31323

SEQ ID NO: 130453 - RNA, 1701 nt, Artificial Sequence; identical to SEQ ID NO: 124685
  derived and/or modified sequence opt3 from hemagglutinin__InfluenzaA__AFG31333

SEQ ID NO: 130454 - RNA, 1701 nt, Artificial Sequence; identical to SEQ ID NO: 124685
  derived and/or modified sequence opt3 from hemagglutinin__InfluenzaA__AFG31343

SEQ ID NO: 130455 - RNA, 1701 nt, Artificial Sequence; identical to SEQ ID NO: 124685
  derived and/or modified sequence opt3 from hemagglutinin__InfluenzaA__AFG31353

SEQ ID NO: 130456 - RNA, 1701 nt, Artificial Sequence; identical to SEQ ID NO: 124685
  derived and/or modified sequence opt3 from hemagglutinin__InfluenzaA__AFG31363

SEQ ID NO: 130457 - RNA, 1701 nt, Artificial Sequence; identical to SEQ ID NO: 124685
  derived and/or modified sequence opt3 from hemagglutinin__InfluenzaA__AFG31376

SEQ ID NO: 130458 - RNA, 1701 nt, Artificial Sequence; identical to SEQ ID NO: 124685
  derived and/or modified sequence opt3 from hemagglutinin__InfluenzaA__AFG31386

SEQ ID NO: 130459 - RNA, 1701 nt, Artificial Sequence; identical to SEQ ID NO: 124685
  derived and/or modified sequence opt3 from hemagglutinin__InfluenzaA__AFG31396

SEQ ID NO: 130460 - RNA, 1701 nt, Artificial Sequence; identical to SEQ ID NO: 124685
  derived and/or modified sequence opt3 from hemagglutinin__InfluenzaA__AFG31406

SEQ ID NO: 130461 - RNA, 1701 nt, Artificial Sequence; identical to SEQ ID NO: 124685
  derived and/or modified sequence opt3 from hemagglutinin__InfluenzaA__AFG31416

SEQ ID NO: 130462 - RNA, 1701 nt, Artificial Sequence; identical to SEQ ID NO: 124685
  derived and/or modified sequence opt3 from hemagglutinin__InfluenzaA__AFG31426

SEQ ID NO: 130463 - RNA, 1701 nt, Artificial Sequence; identical to SEQ ID NO: 124685
  derived and/or modified sequence opt3 from hemagglutinin__InfluenzaA__AFG31436

SEQ ID NO: 130464 - RNA, 1701 nt, Artificial Sequence; identical to SEQ ID NO: 124685
  derived and/or modified sequence opt3 from hemagglutinin__InfluenzaA__AFG31446

SEQ ID NO: 130465 - RNA, 1701 nt, Artificial Sequence; identical to SEQ ID NO: 124685
  derived and/or modified sequence opt3 from hemagglutinin__InfluenzaA__AFG31456

SEQ ID NO: 130466 - RNA, 1701 nt, Artificial Sequence; identical to SEQ ID NO: 124685
  derived and/or modified sequence opt3 from hemagglutinin__InfluenzaA__AFG31466

SEQ ID NO: 130467 - RNA, 1701 nt, Artificial Sequence; identical to SEQ ID NO: 125787
  derived and/or modified sequence opt3 from hemagglutinin__InfluenzaA__AFG31486

SEQ ID NO: 130468 - RNA, 1701 nt, Artificial Sequence; identical to SEQ ID NO: 124685
  derived and/or modified sequence opt3 from hemagglutinin__InfluenzaA__AFG31496

SEQ ID NO: 130469 - RNA, 1701 nt, Artificial Sequence; identical to SEQ ID NO: 124685
  derived and/or modified sequence opt3 from hemagglutinin__InfluenzaA__AFG31506

SEQ ID NO: 130470 - RNA, 1701 nt, Artificial Sequence; identical to SEQ ID NO: 124685
  derived and/or modified sequence opt3 from hemagglutinin__InfluenzaA__AFG31516

SEQ ID NO: 130471 - RNA, 1701 nt, Artificial Sequence; identical to SEQ ID NO: 124776
  derived and/or modified sequence opt3 from hemagglutinin__InfluenzaA__AFG31526

SEQ ID NO: 130472 - RNA, 1701 nt, Artificial Sequence; identical to SEQ ID NO: 124685
  derived and/or modified sequence opt3 from hemagglutinin__InfluenzaA__AFG31536

SEQ ID NO: 130473 - RNA, 1701 nt, Artificial Sequence; identical to SEQ ID NO: 127240
  derived and/or modified sequence opt3 from hemagglutinin__InfluenzaA__AFG31546

SEQ ID NO: 130474 - RNA, 1701 nt, Artificial Sequence; identical to SEQ ID NO: 127240
  derived and/or modified sequence opt3 from hemagglutinin__InfluenzaA__AFG31556

SEQ ID NO: 130475 - RNA, 1701 nt, Artificial Sequence; identical to SEQ ID NO: 124685
  derived and/or modified sequence opt3 from hemagglutinin__InfluenzaA__AFG31566

SEQ ID NO: 130476 - RNA, 1701 nt, Artificial Sequence; identical to SEQ ID NO: 124927
  derived and/or modified sequence opt3 from hemagglutinin__InfluenzaA__AFG31586

SEQ ID NO: 130477 - RNA, 1701 nt, Artificial Sequence; identical to SEQ ID NO: 124927
  derived and/or modified sequence opt3 from hemagglutinin__InfluenzaA__AFG31596

SEQ ID NO: 130478 - RNA, 1701 nt, Artificial Sequence; identical to SEQ ID NO: 124927
  derived and/or modified sequence opt3 from hemagglutinin__InfluenzaA__AFG31606

SEQ ID NO: 130479 - RNA, 1701 nt, Artificial Sequence; identical to SEQ ID NO: 124927
  derived and/or modified sequence opt3 from hemagglutinin__InfluenzaA__AFG31616

SEQ ID NO: 130480 - RNA, 1701 nt, Artificial Sequence; identical to SEQ ID NO: 124927
  derived and/or modified sequence opt3 from hemagglutinin__InfluenzaA__AFG31626

SEQ ID NO: 130481 - RNA, 1701 nt, Artificial Sequence; identical to SEQ ID NO: 124685
  derived and/or modified sequence opt3 from hemagglutinin__InfluenzaA__AFG31636

SEQ ID NO: 130482 - RNA, 1701 nt, Artificial Sequence; identical to SEQ ID NO: 124685
  derived and/or modified sequence opt3 from hemagglutinin__InfluenzaA__AFG31646

SEQ ID NO: 130483 - RNA, 1701 nt, Artificial Sequence; identical to SEQ ID NO: 125849
  derived and/or modified sequence opt3 from hemagglutinin__InfluenzaA__AFG31656

SEQ ID NO: 130484 - RNA, 1701 nt, Artificial Sequence; identical to SEQ ID NO: 125849
  derived and/or modified sequence opt3 from hemagglutinin__InfluenzaA__AFG31666

SEQ ID NO: 130485 - RNA, 1701 nt, Artificial Sequence
  derived and/or modified sequence opt3 from hemagglutinin__InfluenzaA__AFG71865
augaagaccaucauugcccugagcuacauauucugccucgcucuuggccaggaccugcccgggaacgauaauuccacagcaacuuuguguuuaggacaccaugccgugccuaacgguacgcuggucaaaaccaucacaaaugaccaaauugagguuacuaacgcgaccgaacuugugcagucuucaaguacaggcaagaucugcaauaacccacacaggauucucgaugggaucgacuguacccugauagaugcucuacugggagacccgcauugcgauguauuucagaaugagacuugggacuuguucguggaaagaagcaaagccuuuuccaacuguuaucccuacgaugucccugacuaugcaucucuccggucgcugguggccucaagcggcacacuggaguucaucaccgaagguuuuacguggacugggguuacccagaauggaggcaguaacgcuugcaagcgcggcccagggauuggauucuuuucccgacucaauugguuaacaaaaucugguagcacuuaccccgugcugaacgucaccaugccuaauaacgauaauuucgacaaacuuuauaucuggggcgugcaccauccauccacaaaccaagagcagaccucauuguacguacaggcaagugggcguguuacggugagcacuagaaggucucagcaaacaauuauccccaacauaggaucccggccuuggguccgcggccugucaagcagaauuaguaucuauuggaccauugugaagccaggugaugugcuagucaucaauucuaacgggaaucucaucgccccgaggggauacuuuaagaugcggacuggcaaguccagcauuaugcgcucggacgcucccauagacacauguaucucugagugcauuaccccuaacggcuccaucccaaaugauaaacccuuccagaacguuaauaagauaacguacggggccuguccuaaauaugugaagcagaacacccugaaacuugcgacaggaaugcgaaauguaccagaaaagcagacuagaggucuguuuggcgcaauugccggguucaucgagaacggaugggaaggcaugaucgacgguugguacggguuuaggcaccaaaauucagagggcaccggacaggcugccgauuugaagaguacacaggcagcuauugaccaaaucaacggcaaacucaaucgggugauugagaagacuaacgaaaaauuccaccagauagagaaggaguucagcgaagucgaagggcguauccaggaucuggagaaauauguggaggacaccaagauugauuuaugguccuacaaugccgaacugcucguugcgcuugagaaccagcauacaaucgaccugaccgauucugaaaugaacaaguuguuugagaaaacucgcagacaacuaagggaaaaugccgaggacaugggaaacgguugcuucaagaucuaucacaaaugugauaaugcaugcauugagagcauacggaacggcacguacgaccaugacguguaucgagaugaagcucugaauaaccgcuuucagaucaagggggucgagcucaaaucaggauacaaggacuggauucuguggaucaguuucgccauuuccugcuuucuucugugugugguauugcucggcuucaucaugugggcuugccagagagguaauauaagguguaacaucugcauuuga

SEQ ID NO: 130486 - RNA, 1701 nt, Artificial Sequence; identical to SEQ ID NO: 123572
  derived and/or modified sequence opt3 from hemagglutinin__InfluenzaA__AFG71876

SEQ ID NO: 130487 - RNA, 1701 nt, Artificial Sequence
  derived and/or modified sequence opt3 from hemagglutinin__InfluenzaA__AFG71898
augaagaccaucauugcccugagcuaccucuucugccuugcuuuuggccaggaccugcccgggaacgauaauuccacagcaacuuuguguuuaggacaccaugccgugccuaacgguacgcuggucaaaaccauaacagacgaucaaaucgagguuacuaaugcgaccgaacuugugcagucuucaaguacaggcaagauuugcaacaauccacacagaauccucgacgggauugauuguacccugaucgacgcucuacugggagauccgcauugcgacguauuccagaacgagacuugggauuuguuuguggaaaggagcaaagccuucuccaauuguuaucccuacgacgucccugauuaugcaucucuccggucgcugguggccucaagcggcacacuggaguuuaccacggaagguuucacuuggaccgggguuacacagaacggaggcaguaaugcuugcaagcgcggcccaggguccggauuuuucucucgacucaacugguuaacuaaaagcgguuccaccuaccccgugcugaaugucacaaugucaaacaaugacaacuuugauaaacuuuauauauggggcgugcaccauccuaguaccaaucaagagcagacgagcuuguacguacaggcaucugggcguguuacuguguccacaagaaggucacagcaaaccaucauuccaaacaucggaagccggcccuggguccgcggccugaguucuagaauuuccaucuauuggacuauagugaagccuggugacgugcuagucauuaacagcaaugggaaccucaucgccccaaggggauacuucaagaugcggacaggcaagucgucuauuaugcgcuccgacgcuccgaucgauaccuguguuucagagugcaucacgcccaauggcaguauuccuaacgacaaaccauuucagaaugugaacaagauaaccuacggggccugucccaaauauguaaagcagaauacacugaaacuugcgacuggaaugcgaaacgugccugaaaagcagaccagaggucuguucggcgcaaucgccggguuuauugagaauggaugggaaggcaugaucgaugguugguacggguucaggcaccaaaacagcgagggcacaggacaggcugccgacuugaaguccacucaggcagcuauagaucaaauuaauggcaaacucaaccgggucaucgagaagaccaaugaaaaauuccaccagaucgagaaggaauuuucugagguggaagggcguauucaggaccuggagaaauauguugaggauacaaagaucgacuuauggagcuacaacgccgaacugcucguggcgcuugagaaucagcauaccauugaucugacugacucagaaaugaacaaguuguucgagaaaacgcgcagacaacuaagggaaaacgccgaggauaugggaaaugguugcuuuaagauauaucacaaaugugacaacgcaugcaucgagaguauucggaauggcacauacgaccaugaugucuaucgagacgaagcucugaacaaucgcuuccagaucaaggggguggagcucaaauccggauacaaggauuggauccuguggauuagcuuugccauaucuugcuuccuucuguguguaguuuugcucggcuuuaucaugugggcuugccagagagguaacauuagguguaauaucugcauuuga

SEQ ID NO: 130488 - RNA, 1701 nt, Artificial Sequence
  derived and/or modified sequence opt3 from hemagglutinin__InfluenzaA__AFG71920
augaagaccaucauugcccugagcuacauauucugccucgcucuuggccaggaccugcccgggaacgauaauuccacagcaacuuuguguuuaggacaccaugccgugccuaacgguacgcuggucaaaaccaucacaaaugaccaaauugagguuacuaacgcgaccgaacuugugcagucuucaaguacaggcaagaucugcaauaacccacacaggauucucgaugggaucaauuguacccugauagacgcucuacugggagauccgcauugcgacguauuucaggaugagacuugggacuuguucguggaaagaagcaaagccuuuuccaacuguuaucccuacgaugucccugacuaugcaucucuccggucgcugaucgccucaagcggcacacuggaguucauuaccgaagguuuuacguggacuggggugacccagaauggaggcaguaacgcuugcaagcgcggcccaggguccggauucuuuucucgacucaauugguuaacaaaaagcgguuccacuuaccccguucugaacgugaccaugccuaauaacgauaauuucgacaaguuguauaucuggggcguccaccauccaucaacaaaccaagagcagaccaguuuguacgugcaggcaagcgggcguguaacgguuucuacuagaaggucccagcaaacaauuauccccaacauaggaucacggccuugggugcgcggccugagcaguagaauuucuaucuauuggaccauugucaagccaggugaugugcuagugaucaauuccaacgggaaucucaucgccccgaggggauacuuuaaaaugcggacuggcaagagcucgauuaugcgcucugacgcucccauagacacauguaucuccgagugcauuaccccuaacggcucaaucccaaaugauaaacccuuccagaacgucaauaagauaacguacggggccuguccuaaauauguuaagcagaacacccugaaacuugcgacaggaaugcgaaaugugccagaaaagcagacuagaggucuguuuggcgcaauugccggguucaucgagaacggaugggaaggcaugaucgacgguugguacggguuuaggcaccaaaauagugagggcaccggacaggcugccgaucuuaagagcacacaggcagcuauugaccaaaucaacggcaaacucaaucggguaauugagaagacuaacgaaaaauuccaccagauagagaaggaguucuccgaaguggaagggcguauccaggaucuggagaaauaugucgaggacaccaagauugauuuauggucuuacaaugccgaacugcucguggcgcuugagaaccagcauacaaucgaccugaccgauagcgaaaugaacaaguuguuugagaaaacucgcagacaacuaagggaaaaugccgaggacaugggaaacgguugcuucaagaucuaucacaaaugugauaaugcaugcauugagucaauacggaacggcacguacgaccaugacguuuaucgagaugaagcucugaauaaccgcuuucagaucaaggggguggagcucaaaaguggauacaaggacuggauucuguggaucuccuucgccauuagcugcuuucuucugugugucguguugcucggcuucaucaugugggcuugccagagagguaauauaagguguaacaucugcauuuga

SEQ ID NO: 130489 - RNA, 1701 nt, Artificial Sequence
  derived and/or modified sequence opt3 from hemagglutinin__InfluenzaA__AFG71931
augaagaccaucauugcccugagcuacauauucugccucgugaucggccaggaccuucccgggaacgaaaauuccacagcuacucuguguuugggacaccaugcagucccuaacgguacguuaguuaaaaccauuacaaaugaucaaaucgaagugacuaacgccaccgagcugguacagucuucaaguacaggcaagauuugcaauaacccacacagaauccuagacgggauagauuguacccucaucgacgcgcugcuuggagauccgcauugcgacggcuuucagaaugaaacuugggaucuguucguggagaggagcaaggcuuuuuccaacuguuaucccuacgacgucccugauuaugccucuuugcggucgcucguggcaucaagcgguacacuggaguucauuaccgagggguuuacguggacuggaguuacccagaauggcggcaguaacgccugcaaacgcgggccaggaaucgguuucuuuucccgacugaauuggcucacaaaaucuggcagcacuuaccccguguuaaacgucaccaugccuaauaacgacaauuucgauaagcuguauauuuggggagugcaccauccauccacaaaccaagagcagaccucacuuuacguacaggcuagugggcguguuacggugagcacuagaaggucucagcaaacaaucauacccaacauuggcucccggccuuggguccgcgguuugucaagcagaaucaguauuuauuggaccaucgugaagccaggggacgugcuggucaucaauucuaacggaaaucuaauugcaccgaggggcuacuuuaaaaugcggacuggcaaguccagcauaaugcgcucggaugcccccaucgacacauguauuucugaaugcaucaccccuaacggguccauaccaaaugacaaacccuuccagaacguuaauaagauuacguacggagcuuguccuaaauaugugaagcagaacacccucaagcuggccacagguaugcgaaauguaccagagaaacagacuagaggccuuuuuggggcgaucgcaggauucaucgaaaacggcugggaggguaugauugaugggugguacggcuuuaggcaccaaaauucagagggaaccggccaggccgcugaccugaagaguacacaggccgcaaucgaucaaauuaacgggaaauugaaucgggugauagaaaagacuaacgagaaauuccaccagaucgaaaaggaguucagcgaagucgagggacguauucaggaccucgagaaauauguggaagauaccaagaucgaccugugguccuacaaugcugaguuacugguugcccucgaaaaccagcauacaaucgaucuuaccgacucugagaugaacaagcuguuugagaaaacucgcagacaauugagggaaaaugcggaggauauggguaacggcugcuucaagauuuaucacaaaugugacaaugccugcauagaaagcauccggaacgggacguacgaucaugacguguaucgagacgaggcacuaaauaaccgcuuucagauuaagggagucgaacugaaaucaggcuacaaggauuggauccucuggauuaguuucgcuaucuccugcuuucugcuuugugugguacuguuggguuucauaaugugggccugccagagagggaauaucagguguaacauuugcaucuga

SEQ ID NO: 130490 - RNA, 1701 nt, Artificial Sequence
  derived and/or modified sequence opt3 from hemagglutinin__InfluenzaA__AFG71942
augaagaccaucauugcccugagcuacauauucuaucucgcucuuucccaggaccugcccggcaacgauaauucuaaagcaacauugugcuuagggcaccaugccgugccuaacggaacucuggucaagacgaucaccgacgaucaaacagagguuacuaaugcgaccgaacuugugcagucaaguagcacagguaaaauuuguaacaauccacacagaauccucgacggcauggauugcacccugauugacgcucuacugggggauccgcauugugacguauuucagaacgagacuugggauuuguucguggaaagguccaaggccuuuucuaauugcuaccccuaugacgucccugauuacgcaucgcuccggucacugguggccagcaguggaacacuggaguucaucaccgaaggcuuuacguggacugagguuacccagaacgguggguccauagcuuguaaacgcggaccagacucuggcuucuuuagccgacucaauugguuaacaaaguccggccguacuuaucccgugcugaacgucaccaugccuaauaacgauaauuucgacaaacuuuacaucuggggagugcaccauccaucaacagaccaagagcagaccaacuuguauguacagacgagugggagaguuacugugagcacaaggcggucucagcaaaccauuauccccaauauugguucccgcccuugggucagaggccugucaagcaggaucaguauauacuggacuauugugaaaccaggggaugugcuagucaucaacucuaacggaaaucucauugcaccgcggggcuacuuuaagaugcgcacagguaaauccagcaucaugcgaucggacgcccccaucgauaccugcauuucugaauguauaacgccuaacggguccaucccaaaugacaagcccuuccagaacguuaauaaaauuaccuauggagcuugcccuaaguacgugaagcagaacacacugaaacuugccacuggcaugagaaauguaccagagaagcagaccaggggccuguuuggggcgaucgcaggauucauagaaaacgguugggagggcaugauugaugggugguauggauuucggcaccaaaauucagagggcacaggucaggccgcugacuugaaaaguacucaggccgcaaucgaucaaaucaacgggaagcucaaucguauuaucgaaaagaccaacgagaaguuccaccagauugaaaaagaguucagcgaaguggagggccgcauacaggaccuggagaaguacgucgaagauacaaagaucgacuuaugguccuauaaugcugagcugcucguggcccuugaaaaccagcauaccauugaucugacugacucugagaugaauaaauuguuugaaaagacgagaaggcaacuacgggagaacgcggaggacaugggaaacggcuguuucaaaaucuaccacaagugcgauaaugccuguaucgaaagcauucgaaacgggacauaugaccaugauguuuaccgcgacgaggcacugaauaacagauuucagauaaaaggaguggaacucaagucagguuacaaggauuggauccuguggauuaguuucgcuaucuccugcuuucuucugugcgucguguugcucggcuucauuaugugggccugucagagggggaauauccggugcaacauauguaucuga

SEQ ID NO: 130491 - RNA, 1701 nt, Artificial Sequence
  derived and/or modified sequence opt3 from hemagglutinin__InfluenzaA__AFG71953
augaagaccaucauugcccugagcuacauauucugccucgugcuuggccaggaccugcccgggaacgauaaauccacagcuacuuuguguuuaggacaccaugcagucccuaaugguacgcugguuaagaccaucacaaacgaccaaauugaggugacuaaugccaccgaacugguacagucuucaaguacaggcaaaaucugcaacaauccacacaggauucucgaugggaucgacuguacccugauagaugcgcuucugggagacccgcauugcgauggcuuucagaacgagacuugggacuuguucguggaaagaagcaaggcuuuuuccaauuguuaucccuacgaugucccugacuaugccucucuccggucgcugguggcaucaagcgguacacuggaguucaucaccgaaggguuuacguggacuggaguuacccagaacggcggcaguaaugccugcaaacgcgggccaggauccgguuucuuuucucgacucaacugguuaacaaagagcggcuccacuuaccccgugcugaaugucaccaugccuaacaaugauaacuucgacaaacuuuauauuuggggagugcaccauccaucaacaaaucaagagcagaccaguuuguacguacaggcuagcgggcguguuacggugucuacuaagagaucccagcaaacaaucauucccaacaucggcucaaggccuuggguccgggguccaagcagucgcauaucuauuuauuggaccacugugaagccgggggauauccugauuaucaacuccaauggaaaccuaaucgcacccagaggcuacuuuaaaaugaggacaggcaagagcucgauuaugcggucugacgccccuauaggggcuuguaucuccgagugcauuaccccaaauggaucaauccccaacgacaaaccuuuccagaaugugaacaagauaacguacggugccuguccaaaguaugucaaacagaauacccucaagcuggcgacaggcaugcgcaacguucccgaaaaacagacucgagggcuuuuuggagcaauugccggcuucaucgagaaugguugggaagggaugaucgauggcugguacggauuuagacaccaaaacagugagggcaccgggcaggcugccgaccuaaagagcacacaggcagcuauugaucaaaucaauggaaaauugaacagggugauugagaagacuaaugaaaaauuccaccagauagagaaggaguucuccgaaguagaaggucggauccaggaccucgagaaguauguggaggauaccaaaauugaccuguggucuuacaacgccgaauuacuggucgcgcucgagaaucagcauacaaucgaucuuaccgacagcgaaaugaacaagcuguuugagaaaacucgucgccaauugagagaaaacgccgaggauaugggcaaugggugcuucaagaucuaucacaaaugugacaacgcaugcauuggaucaauaaggaauggcacguacgaucaugacguguaucgggacgaggcucuaaacaaucgauuucagaucaaggguguugaacugaagaguggguacaaagauuggauucucuggaucuccuucgccauuagcugcuuucugcuuugugugguccuguugggcgugaucaugugggcuugccagaagggaaacauacgcuguaauaucugcauuuga

SEQ ID NO: 130492 - RNA, 1701 nt, Artificial Sequence; identical to SEQ ID NO: 122321
  derived and/or modified sequence opt3 from hemagglutinin__InfluenzaA__AFG71975

SEQ ID NO: 130493 - RNA, 1701 nt, Artificial Sequence
  derived and/or modified sequence opt3 from hemagglutinin__InfluenzaA__AFG71996
augaagaccaucauugcccugagcuacauauucugccucgugcuuggccagaacuuucccgggaaugacaacuccacagcuacucuguguuugggacaccaugcagucccuaaugguacguuaguuaaaaccaucacaaacgaucaaauugaggugacuaaugccaccgaacugguacagucuucaaguacaggcaagaucugcaacaauccacacaggauucuagacgggaucgauuguacccucauagacgcgcugcuuggagauccgcauugcgacggcuuccagaacgagacuugggaucuguuuguggaaagaagcaaggcuuucuccaauuguuaucccuacgacgucccugauuaugccucuuugcggucgcucguggcaucaagcgguacacuggaguuuaucaacgaaggguucaccuggacgggaguuacucagaauggcggcaguaacgccugcaaacgcgggccagacauuggauuuuucucccgacugaauuggcucuacaaaucugguaacaccuaucccguguuaaaugucagcaugccuaacaacgauaauuuugacaagcuguacaucuggggcgugcaccauccauccacagaucaagagcagacuucacuuuauguacaggcuagugggcguguuaccgugagcacaaagagaucucagcaaaccauuauccccaacauaggauccaggccuuggguccggggcuugucaagccgcauuaguaucuacuggacgauugugaaaccaggugacauccuggugaucaauucuaacgggaaucuaauugcaccgagaggauacuucaagaugaggacuggcaaauccagcauaaugcggucggacgccucuaucggcacauguauuuccgagugcaucacccccaacgggucaauaccuaaugauaagccauuucagaacgucaauaaaauuacuuauggagcuugucccaaguacguuaagcagaacacacucaaacuggccaccgguaugcgcaaugugccugaaaagcagacgcgaggcaucuucggggcgaucgcaggauuuauugagaacggcugggaagguaugaucgacgggugguauggcuucagacaccaaaauagugagggaaccggccaggccgcugaucuuaaaagcacacaggccgcaauugaccaaauaaacgggaagcugaauaggaucauugagaaaacuaacgaaaaguuccaccagaucgagaaagaauuuuccgagguagaaggacggauccaggauuuggagaaguacguggaggacaccaagauugaucucuggucuuauaacgcugaacuguuagucgcccuggagaaucagcauacaauagaccucacugauagcgaaaugaacaaacuuuucgagaagacccgucgccaacugagagaaaaugcggaggacauggguaacggcugcuuuaaaaucuaccacaagugugauaaugccugcauugggucaaucaggaacggaacauaugaccaugacguguaccgggaugaggcauugaauaaccgauuccagauuaaaggcguugaacuaaagagugguuacaaggacuggauccuguggauauccuuugcuaucagcugcuuccuccugugugugguccuucugggguuuauuaugugggccugccagaaaggcaauauccgcuguaacauuugcaucuga

SEQ ID NO: 130494 - RNA, 1701 nt, Artificial Sequence
  derived and/or modified sequence opt3 from hemagglutinin__InfluenzaA__AFG72007
augaagaccaucauugcccugagcuacauauucugccucgugcuuggcagagacuuucccaggaacgauaauuccacagcuacucuguguuuggggcaccaugcagucccuaacggaacguuaguuaaaaccaucacaaaugaccagauugaggugacuaacgccaccgaacugguacaaucuucaaguacagguaagaucugcaauaacccacaccggauucuagauggcauggacuguacccucaucgaugcgcugcuuggggacccgcauugcgauggacugcagaauggcacuugggacuuguucguggagcgcagcaaggcuuuuuccaacuguuaucccuacgaugucccugacuaugccucucuccgaucgcugguggcaucaagcgguacacuggaguucauaaaugaaggguuuaccuggacgggaguuacucagaacggcggcaguaaugccugcaagcgugggccagauuccggauucuuuucuagacucaacugguuauacaaaagcgguaauaccuaucccgugcugaacgucacaaugccuaauaacgacaacuucgauaaacuuuacaucuggggcgugcaccauccauccacugaccaggaccaaaccucauuguauguacaggcuagugggaggguuacagugagcaccaagcggucucagcagacggucauucccaauaucggaccucgcccaugggugagaggccuguccucaaggauuagcaucuacuggacuauagugaaaccgggugauauucuacucaucaacaguaaugggaaccugauugcaccccggggauacuuuaagaugcgcacaggcaaaucuuccaucaugcgaagcgacgccccuaucggcaccuguauuucggaaugcauaacuccaaaugggucuauccccaacgauaagccuuuccaaaaugucaacaaaauuacauauggagcuuguccaaaguacguuaagcagaauacccuuaaacuggccacggguaugagaaacgugcccgagaagcagaccaggggcaucuuuggggcgauagcaggauucauugagaauggcugggaagguaugaucgacgggugguauggcuuucggcaccagaacuccgagggaacaggccaagccgcugauuugaaaucaacucaggccgcaaucgaccagauuaaugggaagcucaaccguguaaucgagaaaaccaaugaaaaguuccaccaaauugagaaagaguucagugaaguggaaggacgcauacaggaucuggagaaguacgucgaagacacaaagaucgauuuauggagcuauaacgcugagcugcucguggcccuugagaaccagcauacuauugaccugaccgauuccgaaaugaauaaauuguuugagaagacaagaaggcagcuacgggaaaacgcggaggacauggguaauggcugcuucaaaaucuaccaccgaugugacaacgccugcaucgggucuauucgcaauggaaccuaugaucaugacguuuacagagaugaagcacugaacaauagguuucaaauaaagggcguggagcucaaaagcgguuacaaggacuggauccuguggauuucauucgcuaucaguugcuuucuucugugugucguguugcucggguucauuaugugggccugccagaagggcaacauccgguguaauauaugcaucuga

SEQ ID NO: 130495 - RNA, 1701 nt, Artificial Sequence
  derived and/or modified sequence opt3 from hemagglutinin__InfluenzaA__AFG72029
augaagaccaucauugcccugagcuacauauucugccucguguuuggccagaaccuucccgggaaugacaacuccacagcuacucuguguuugggacaccaugcagucccuaaugguacguuaguuaaaaccaucacaaacgaucaaauugaggugacuaaugccaccgaacugguacagucuucaaguacaggcagaaucugcgacagcccacacaggauucuagaugggaagaacuguacccucaucgacgcgcugcuuggagauccgcauugcgacggcuuccagaaugagaaaugggaucuguuuguggaacgguccaaggcuuucucuaacuguuaucccuacgacgucccugauuaugccucguugcgcucacucauagcaagcagugguacucuggaguuuaucaaugaaggguucaacuggacaggagugacccaguccggcggcucuuacgccugcaaacgagggagcgacaauuccuuuuucucacgucugaacuggcucuaugagagugagagcaaguacccaguuuuaaaugugacgaugcccaacaauggaaacuuugauaagcuguauauuugggguguccaccauccuucuacugacaaagaacaaaccaaccuuuacgugagagcuuccggcaggguaacaguuucaacuaagcggagccagcagaccaucauuccaaauaucgggagucgccccugggugagaggauugucuuccaggauaagcauuuacuggacaaucgucaaaccuggcgauauucugcuaaucaacucgaaugguaaccucaucgcaccacggggguauuucaagauucgcaccggaaaaucuuccauaaugcgaucagacgccccgaucggcacguguaguagcgagugcauuacucccaauggcuccaucccuaacgacaagccauuucagaaugugaacaagauaacauacggggcuugucccaaauaugugaagcaaaauacccugaaacuugccacuggaaugagaaacgucccugaaaagcagacaagggguauuuucggcgcgaucgcaggguuuaucgagaauggaugggagggcaugguugaugguugguacggguuccggcaccagaacucugaaggcaccggacaggccgcugaccugaaaagcacgcaagccgcaauugaucagaucaauggcaaguugaaccgugugauugagaaaaccaaugaaaaguuccaccagauagagaaggaauuuucagagguagaggggcgcauccaagaccucgaaaaauauguggaggauacaaagauugaccuguggaguuacaacgcugaauuacuggucgcccucgagaaccagcauacuaucgaucuuaccgacuccgaaaugaauaaacuguucgagaagacaagaaggcaguugcgggagaacgcggaagauaugggaaaugguugcuuuaaaaucuaucacaagugugacaacgccugcauuggcagcauacgaaaugggacuuacgaucaugacguguaccgcgacgaggcacuaaacaauagauuccagaucaagggaguugaacugaaaucuggcuauaaggauuggauucucuggaucucauuugcuauuaguugcuuccugcuuugugugguccuguuggguuuuaucaugugggccugccaaaaagggaacauaagguguaauaucugcauuuga

SEQ ID NO: 130496 - RNA, 1701 nt, Artificial Sequence
  derived and/or modified sequence opt3 from hemagglutinin__InfluenzaA__AFG72040
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucguggacgcucugcuuggggauccgcauugcgacggauuccagaaugagaaaugggaucuguuugucgaacgguccaaggccuucucuaacuguuaucccuacgacgugccugauuaugcaucguugcgcucacucguugccagcaguggcacucuggaguuuaucaaugaauccuucaacuggacaggugugacccagucugggggaagcuacgcuugcaaacgaggcuccgacaauucauuuuucagucgucugaacuggcucuaugagagcgagucuaaguacccagucuuaaaugugacgaugcccaacaauggcaacuuugauaagcuguauauauggggaguacaccauccuuccacugacaaagaacaaaccaaccuuuacguuagagcaucagggagggugacagucagcacuaagcggagucagcagaccaucauuccaaauaucgguucucgccccugggugagaggcuuguccagcaggauuucgaucuacuggacaauagugaaaccuggggauauucugcuaaucaacucuaauggaaaccucauugccccacggggcuauuucaagauccgcaccgguaaauccucaaucaugcgaagugacgcuccgauugggacguguagcuccgagugcauaacucccaauggaucuaucccuaacgacaagccauuucagaaugucaacaagauuacauacggcgccugucccaaauauguuaagcaaaauacccugaaacuugcgacuggcaugagaaacgugccugaaaagcagacaagggggaucuucggagcaauagccgguuuuauugagaauggcugggaggggaugguagauggaugguacggcuuccggcaccagaacagcgaagguaccgggcaggcugccgaccugaaaucaacgcaagcagcuaucgaucagaucaauggcaaguugaaccgugugauugagaaaaccaaugaaaaguuccaccagaucgagaaggaauuuagugaggucgagggacgcauucaagaccucgaaaaauauguggagaacacaaagauagaucugugguccuacaacgccgaauuacugguugcgcucgagaaucagcauacuaucgaccuuaccgauagcgaaaugaacaaacuguucgagaagacaagaaggcaguugcgggagaaugccgaagacaugggcaacgggugcuuuaaaauuuaucacaagugugauaaugcaugcaucggaucuauccgaaacgguacuuacgaccaugauguguaccgcgacgaggcucuaaauaacagauuccagauuaagggcgucgaacugaaaucaggguauaaggacuggauacucuggaucaguuuugccauuagcugcuuccugcuuugugugguacuguugggauuuaucaugugggcuugccaaaaaggcaauauuagguguaacaucugcauauga

SEQ ID NO: 130497 - RNA, 1701 nt, Artificial Sequence
  derived and/or modified sequence opt3 from hemagglutinin__InfluenzaA__AFG72051
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucguggacgcucugcuuggggauccgcauugcgacggauuccagaaugagaaaugggaucuguuugucgaacgguccaaggccuucucuaacuguuaucccuacgacgugccugauuaugcaucguugcgcucacucguugccagcaguggcacucuggaguuuaucaaugaauccuucaacuggacaggugugacccagucugggggaagcuacgcuugcaaacgaggcuccgacaauucauuuuucagucgucugaacuggcucuaugagagcgagucuaaguacccagucuuaaaugugacgaugcccaacaauggcaacuuugauaagcuguauauauggggaguacaccauccuuccacugacaaagaacaaaccaaccuuuacguuagagcaucagggagggugacagucagcacuaagcggaaucagcagaccgugaucccaaacauugguagucgccccugggugagaggcuugucuuccaggaucagcauuuacuggacaaucgucaaaccuggggauauacugcuaauuaauucgaacggaaaucucaucgccccacggggcuauuucaagauucacaacgguaaaucuuccaucaugcgcucagacgcuccgaucgggaccuguaguagcgagugcauuacgcccaauggauccauaccuaacgacaagccauuucagaauguuaacaagaucacuuacggcgccugucccaaauaugugaagcaaaauacacugaaacuugcgaccggcaugcgaaacguaccugaaaagcagacuagagggauuuucggagcaaucgccgguuuuauagagaauggcugggaggggaugguggauggaugguacggcuucaggcaccggaacucugaagguacagggcaggcugccgaccugaaaagcacccaggcagcuauugaucaaaucaauggcaaguugaaccgugucaucgagaaaacgaacgaaaaguuccaucagauugagaaggaauuuucagagguggagggacgcauccaggaccucgaaaaauauguugaggauaccaagauugaccuguggaguuacaaugccgaauuacugguggcgcucgagaaccaacacacaauagaucuuacugacuccgaaaugaauaaacuguucgagaagaccagaaggcaguugcgggagaacgccgaagauaugggcaaugggugcuuuaaaaucuaucauaagugugacaacgcaugcauuggaagcauccgaaaugguacauacgaucacgacgucuaccgcgacgaggcucuaaacaauagauuccagaucaagggcguggaacugaaaucuggguauaaggauuggauucucuggauaucauuugccaucaguugcuuccugcuuuguguaguucuguugggauuuauuaugugggcuugccagaaaggcaacaucagguguaauauuugcaucuga

SEQ ID NO: 130498 - RNA, 1701 nt, Artificial Sequence
  derived and/or modified sequence opt3 from hemagglutinin__InfluenzaA__AFG72085
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggaucgguguuacacaguccgggggaucuugcgcuuguaagcgaggcagcgugaacuccuucuuuucacgucugaauuggcuccacgagagugagcaaaaguauccagcauuaaacgucaccaugcccaauaacggcaaauucgauaagcuguacauuuggggagugcaucacccuagcacggacagagaacagacuaaucuuuauguaagggccucugggcggguuaccguguccacaaaacgcucacagcagacugucaucccaaacauugguagcagacccugggugaggggcuugaguucucggaucuccauauacuggaccauugugaagccuggggauauccugcuaauuaacagcaucggaaaucucaucgcuccacgcggcuacuuuaaaauucgaacagguaagucgucuauaaugagauccgacgccccgaucgggaccugcucaagugaguguauuacgcccaacggaagcaucccuaaugacaagccauuccaaaacgucaauaaaauaacuuauggcgcgugccccagguacguuaagcagaacacacugaaacuugcaaccggcaugcggaaugugccugaaaagcagacucgugggauuuuuggagccaucgcugguuucaucgagaacggcugggaggggaugguagauggaugguauggcuuucgccaccaaaauuccgaagguacagggcaggccgcagaccugaaaucuacccaggcugccauugaucagaucaacggcaaguugaauagacucauugagaaaacgaacgaaaaguuccaucaaauagagaaggaguucagcgaaguggagggaaggauccaggaccuggaaaaauacgucgaggauaccaagauugacuuauggucauauaaugcggaacugcucguggcccuugagaaccagcacacaaucgaucugacugacagugaaaugaauaaauuguuugagaagacccggaaacagcuacgagagaacgcagaagauaugggcaacggguguuucaagaucuaccauaagugcgacaaugcuugcauuggauccauacgcaacgguacauaugaucacgacguuuacagagacgaggcccugaauaacagguuucaaaucaaaggcguggaacucaagagcggguacaaagauuggauucuguggaucucuuucgcuauuucauguuuucuucugugcgucguguugcucggauucaucaugugggccugucagaagggcaauauacggugcaacaucuguauuuga

SEQ ID NO: 130499 - RNA, 1701 nt, Artificial Sequence
  derived and/or modified sequence opt3 from hemagglutinin__InfluenzaA__AFG72107
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucauagccagcaguggcacucuggaguuuaucaacgaagaguucaauuggacaggugugacccagaacgggggauccuacgcuugcaagcgaggcucuguuaauagcuuuuucucccgucugaacuggcuccacgagucagaauauaaguacccagcauuaaaugugacgaugcccaacaauggcagauuugacaaacuguauauuuggggaguccaucacccuaguacugauagggagcaaaccaaccuuuacgugcgggccagcgggcgcguaacaguuucuacuaagagaucccagcagaccgugaucccaaacauuggucccaggccuuggguccggggcuugucaagccgcaucaguauauacuggacaauugugaaaccaggggacauccugcuaauuaauucuaccggaaaccucaucgcuccgcgaggcuauuucaagauccacacggguaaauccagcauuaugagaucggaugcccccauagggacuuguucuuccgaaugcaucacaccuaauggaucaauuccaaacgacaagcccuuucagaaugugaacaagaucaccuacggcgcguguccuagguaugucaaacaaaauacucugaagcuggcaacaggcaugcggaacguuccagagaaacagacccgugggauauucggagccauugcugguuuuaucgagaauggcugggaagggaugguggacggaugguacggcuuccgccaucagaacagugaggguacggggcaggccgcagaucuuaagagcacccaagcugccaucgaccagauuaauggcaaauugaacagacucaucgaaaagacaaaugagaaauuccaccagauugaaaaggaguuuuccgagguagaaggaaggauacaagaucuggagaaguauguggaagacacuaaaaucgauuuauggucuuacaacgcggagcugcucgucgcccuugaaaaucagcauaccauugaccugacagauagcgagaugaacaaguuguucgagaaaacucggaagcagcuacgagaaaacgcagaggacaugggcaaugggugcuuuaaaaucuaucacaagugugauaacgcuugcaucggaucaauucgcaaugguaccuacgaccacgauguguacagagacgaagccguuaacaauagguuccagauaaagggcguggagcugaaaaguggguauaaggacuggauccucuggauuuccuuugcuaucagcugcuuccugcuuugugucauucuguugggauuuaucaugugggccugccaaaaaggcaacauacgguguaauaucugcauuuga

SEQ ID NO: 130500 - RNA, 1701 nt, Artificial Sequence
  derived and/or modified sequence opt3 from hemagglutinin__InfluenzaA__AFG72118
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacaaaauucuucaacagguagaaucugcaacaguccacacaggauucuagacggcaaaaauuguacccucaucgaugcucugcuuggggacccgcauugcgauggauuccagaacaaggagugggaccuguuuguggaacggagcaaagccuauuccaauuguuaccccuaugaugucccugacuacgcaucuuugcgcucgcucguggccucaagcggcacucuggaguucauaaacgaagauuuuaauuggacagguguugcucagagugggggauccuaugcaugcaagcgaggcucugugaacagcuucuuuucccgucugaauuggcuccacgagucagaguacaaguauccagccuuaaacgucaccaugcccaauaacggcaaauucgacaagcuguacaucuggggagugcaucacccuaguacggauagagaacagacuaaccuuuacguaagggcuagcgggcggguuaccgugucuacaaaacgcucccagcagacugucauuccaaauaucgguucaagacccugggugaggggcuugagcagucggauuucuaucuauuggaccauagugaagccuggggacauucugcuaaucaacuccacaggaaaucucauugccccacgcggcuacuuuaaaauccgaaccgguaagagcucgaucaugagaucugaugcgccgauugggacguguuccucagagugcauaacucccaacggaaguaucccuaaugacaagccauuccagaacgucaauaggauuacauauggcgcauguccccgguacguuaaacaaaacacccugaaacuugccacuggcaugcguaaugugccugaacgccagacaagagggaucuuuggagcuauagccgguuucauugagaacggcugggaggggaugguagacggaugguauggcuuuaggcaccagaauagcgaagguaccgggcaggcagcugaucugaaguccacgcaagccgcgaucgaccagaucaacggcaaguugaaucggcucauugagaaaaccaacgaaaaguuccaucagaucgagaaagaguucucugaaguggagggacgcauucaagaucuggaaaaguacgucgaggacacaaagauagauuuauggagcuauaaugccgaacugcucguggcacuugagaaccagcacacuaucgaccugaccgauucagaaaugaacaaauuguuugagaagacacgaaaacagcuaagagagaaugcugaagacaugggcaacgggugcuucaagauuuaccauaaaugugauaaugccugcaucggaaguaucaggaacgguacuuacaaucacgacguuuaucgggaugaggcucugaacaaucgcuuucagauuaagggcguggaacucaaguccggguacaaagacuggauacuguggaucagcuucgccauuucuugcuuucuucugugugucguguugcucggauucaucaugugggcaugccaaaagggcaacauuagauguaauaucugcauauga

SEQ ID NO: 130501 - RNA, 1701 nt, Artificial Sequence
  derived and/or modified sequence opt3 from hemagglutinin__InfluenzaA__AFG72129
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaucuuuacguaagggcuucugggcggguuaccguguccacaaaacgcucacagcagacugucauuccaaacaucgguagcagacccugggugaggggcuugaguucugggauuuccaucuauuggaccauagugaagccuggagauauucugcuaaucaacagcacaggcaaucucauugccccacgggguuacuuuaaaauccgcaccgggaagucgucuaucaugcgauccgacgcgccgauuggaacguguucaagugagugcauaacucccaacggcagcaucccuaaugacaagccauuccagaacgucaauagaauuacauauggcgcaugucccagguacguuaaacaaaacacccugaaacuugccacugggaugcggaaugugccugaaaagcagacacguggaaucuuuggugcuauagccggcuucauugagaacgggugggagggaaugguagauggcugguaugguuuucgccaccaaaauuccgaagggaccggccaggcagcugaccugaagucuacgcaggccgcgaucaaccagaucaauggaaaauugaacagacucauugagaagaccaaugaaaaauuccaucagaucgagaaggaguucagcgaaguggagggcaggauucaagaucuggaaaaguacgucgaggacacaaaaauagauuuauggucauauaacgccgaacugcucguggcacuugagaaucagcacacuaucgaccugaccgauagugaaaugaacaaguuguuugagaaaacacggaagcagcuacgagagaacgcugaagacauggggaauggaugcuucaaaauuuaccauaagugugauaacgccugcaucgguuccauccgcaauggcacuuacgaccacgauguuuauagagacgaggcucugaacaauagguuucagauuaaggggguggaacucaaaagcggauacaaggacuggauacuguggaucucuuucgccauuucaugcuuucuucugugugucguguugcucggcuucaucaugugggcaugccaaaaagguaacauucgguguaauaucugcauauga

SEQ ID NO: 130502 - RNA, 1701 nt, Artificial Sequence
  derived and/or modified sequence opt3 from hemagglutinin__InfluenzaA__AFG72140
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaucuuuacguaagggcuuuggggcggguuaccgugucuacaaaacgcucccagcagacugucauuccaaacaucgguucaagacccugggugaggggccugagcagucggauuucuaucuauuggaccauagugaagccuggggauauucuacucaucaacuccacaggaaaucugauugccccacgcggcuacuuuaaaauccgaaccgguaagagcucgaucaugagaucugacgcgccgauugggacguguuccucagagugcauaacucccaacggaaguaucccuaauaacaagccauuccagaaugucaacaggauuacauauggcgcauguccccgguacguuaaacaaaauacccuuaagcuggccacuggcaugcguaacgugccugaaaaacagacacgcgggaucuuuggagcuauagccgguuucauugagaauggcugggaggggaugguagacggaugguauggcuuuagacaccagaacagcgaagguaccgggcaggcagcugauuugaaguccacgcaagccgcgaucgaccagaucaauggcaaacucaacaggcugauugagaagaccaaugaaaaauuccaucagaucgagaaggaguucucugaaguggagggacggauucaagauuuagaaaaguacgucgaggacacaaaaauagaucuguggagcuauaacgccgaacuccuuguggcacuggagaaucagcacacuaucgacuugaccgauucagaaaugaacaagcuauuugagaaaacacgaaagcagcugcgcgagaacgcugaagacaugggcaaugggugcuucaaaauuuaccauaagugugauaacgccugcaucggaaguaucagaaaugguacuuacgaccacgauguuuauagggacgaggcucucaacaaucgguuucagauuaagggcguggaacugaaauccggguacaaggacuggauacuuuggaucagcuucgccauuucuugcuuucuguugugugucgugcuccugggauucaucaugugggcaugccaaaaaggcaacauucgcuguaauaucugcauauga

SEQ ID NO: 130503 - RNA, 1701 nt, Artificial Sequence
  derived and/or modified sequence opt3 from hemagglutinin__InfluenzaA__AFG72151
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagacuucaauuggaccgguguugcucaguccggggagucuuaugcaugcaagcgaggaagcgugaaguccuuuuucucacgucucaacugguuacacgagagugauuacaaauauccagcccugaaugucacgaugcccaacaauggcaaguuugacaaacuuuacauauggggcgugcaucacccuagcacugauagagaacaaaccucuuuguacguaagggcuuccgggcggguuacagugucaacuaagcgcagccagcagaccgucaucccaaacauuggaaguagacccugggugaggggucugucuucccggaucagcauuuauuggacaaucgugaaaccuggcgacauacuacucauuaauucgaccgggaaccugaucgccccacgcggauacuucaagauucgaacgggcaagucuuccaucaugagaucagacgcgccgaucgguacuuguaguagcgagugcauuacacccaacggguccauaccuaaugauaaaccauuucagaacgucaauaggaucaccuauggagcauguccccgguacguuaagcaaaacacucuuaaacuggccacaggcaugcguaaugugccugaaaagcagacccgcggcauuuucggggcuaucgccggauuuauagagaacgguugggagggcaugguagacgggugguauggauucagacaccaaaauucugaaggcacgggucaggcagcugauuugaaaagcacccaggccgcgauugaccagaucaacgggaagcucaauaggcugaucgagaaaacaaacgaaaaguuucaucagauugagaaggaguucucagaaguggagggccggauccaagauuuagaaaaauacgucgaggacacuaagauugaucuguggaguuauaaugccgaacuccuuguggcacuggagaaccagcacaccauagacuugacagauuccgaaaugaauaaacuauucgagaagacucgaaaacagcugcgcgagaacgcugaagacaugggaaauggcugcuuuaagaucuaccauaagugugauaacgccugcauugggagcaucagaaacggaaccuacgaccacgacguuuauagggaugaggcucucaauaaccgguuccagaucaaagguguggaacugaagucuggcuacaaagacuggauucuuuggauaucauuugccaucaguugcuuccuguugugugucgugcuccugggguuuauuaugugggcaugccaaaagggaaauauccgcuguaacauuugcaucuga

SEQ ID NO: 130504 - RNA, 1701 nt, Artificial Sequence
  derived and/or modified sequence opt3 from hemagglutinin__InfluenzaA__AFG72184
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacgauuuucagaacaaggagugggacuuguucguggaacgguccaaagccuauucuaauuguuaccccuaugaugucccugacuacgcaucgcuccgcucacugguggccagcaguggaacucuggaguuuauaaacgaagauuucaauuggacaggcguugcucaguccggugagucuuaugcaugcaagcgagggagcgugaaguccuuuuucucacgucucaacugguuacacgagagugaauacaaauauccagcccugaaugucaccaugcccaacaaugacaaguuugauaaacuuuacaucuggggagugcaucacccuagcacggagagagaacaaacuucuuuguacauuagggcuuccggccggguaaccguuucaacaaagcgcagccagcagacugugaucccaaacauuggcaguagacccugggucagggggcugucuucccggaucagcauauauuggaccauugugaaaccuggagacauccuacucauuaauucgacagguaaccugaucgccccacgcggcuacuucaagauccgaaccgggaagucuuccauuaugagaucagacgcgccgauaggaacguguaguagcgagugcaucacucccaacggcuccauuccuaaugauaaaccauuucagaacgugaauaggaucacauauggugcauguccccgguacgucaagcaaaacacccuuaaacuggccacugggaugcguaauguuccugagaagcagacacgcggaauauucggcgcuauugccggcuuuaucgaaaacgggugggagggaaugguggacgguugguauggcuucagacaccaaaauucugaagggaccggacaggcagcugauuugaaaagcacgcaggccgcgaucgaccagauuaacggcaagcucaauaggcugaucgagaaaaccaacgaaaaguuucaucagauugagaaggaguucucagaaguagagggucggauacaagauuuagaaaaauacguggaggacacaaagaucgaucuguggaguuauaaugccgaacuccuugucgcacuggagaaccagcacacuauugacuugaccgauuccgagaugaauaaacuauucgaaaagacacgaaaacagcugcgcgagaacgcugaagacauggggaauggcugcuuuaagaucuaccauaagugugauaacgccugcaucggaagcauuagaaacggcacuuacgaccacgacguguauagggaugaggcucucaauaaccgguuccagauaaaagggguugaacugaagucuggauacaaagacuggauccuuuggauuucauuugccaucaguugcuuccuguugugugugguccuccuggguuuuauuaugugggcaugccaaaagggcaauauccgcuguaacauaugcaucuga

SEQ ID NO: 130505 - RNA, 1701 nt, Artificial Sequence; identical to SEQ ID NO: 130503
  derived and/or modified sequence opt3 from hemagglutinin__InfluenzaA__AFG72195

SEQ ID NO: 130506 - RNA, 1701 nt, Artificial Sequence
  derived and/or modified sequence opt3 from hemagglutinin__InfluenzaA__AFG72206
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguaaaaucugcgacagcccacacaggauucucgauggcaagaauuguacccugaucgacgcucuacugggggauccgcauugcgacggauuucagaacaaagagugggauuuguucguggaaagauccaaggccuauucuaauuguuaccccuaugacgucccugauuacgcaucgcuccggucacugguggccagcaguggcacucuggaguuuauaaacgaagacuucaauuggacagguguugcucaguccggggagucuuaugcaugcaagcgcggaagcgugaaauccuuuuucucacgacucaacugguuacacgagagugauuacaaguauccagcccugaaugucaccaugcccaacaauggcaaauuugacaaguuguacaucuggggcgugcaucacccuagcacggaucgugaacaaacuucuuuguacauuagagcuuccgggaggguaaccguuucaacaaaacggagccagcagacugugaucccaaacauuggaagucgccccugggucagaggucugucuuccaggaucagcauauauuggaccauugugaagccuggcgacauccuacucauuaauucgacagggaaccugaucgccccacggggauacuucaagauccgcaccggcaaaucuuccauuaugcgaucagacgcgccgauagguacguguaguagcgagugcaucacucccaacggguccauuccuaaugauaagccauuucagaacgugaauagaaucacauauggagcaugucccagguacgucaaacaaaacacccuuaagcuggccacuggcaugcggaauguuccugaaaaacagacacguggcauauucggggcuauugccggauuuaucgagaacgguugggagggcaugguggacgggugguauggauuccgccaccaaaauucugaaggcaccggucaggcagcugaucuuaagagcacgcaggccgcgaucgaccagauuaacgggaaacucaauagacugaucgagaagaccaacgaaaaguuucaucagauugagaaagaguucucagaaguagagggcaggauacaagauuuagaaaaguacguggaggacacaaaaaucgaucuguggaguuauaaugccgaacuccuugucgcacuggagaaccagcacacuauugacuugaccgauuccgaaaugaauaagcuauucgagaaaacacggaagcagcugcgagagaacgcugaagacaugggaaauggcugcuuuaagaucuaccauaaaugugauaacgccugcaucgggagcauucgcaacggaacuuacgaccacgacguguauagagaugaggcucucaauaacagguuccagauaaaggguguugaacugaaaucuggcuacaaggacuggauccuuuggauuucauuugccaucaguugcuuccuguugugugugguccuccugggguuuauuaugugggcaugccaaaaaggaaauauccgguguaacauaugcaucuga

SEQ ID NO: 130507 - RNA, 1701 nt, Artificial Sequence
  derived and/or modified sequence opt3 from hemagglutinin__InfluenzaA__AFG72217
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauaacggcaaguuugacaaauuguacaucuggggagugcaucacccuucaacggauagugaccaaacuagccuguacguaagagcuucugggaggguuaccguguccacaaagcggucacagcagacugucaccccaaauauugguagccgccccugggugagaggccuaaguucuaggaucuccauuuauuggacaaucgugaaaccuggggacauacuccugauuagcucgaccggaaaccuuaucgccccacggggcuacuucaagauucgcaacgguaagucuuccaucaugcgaucagaugcgccgaucgggaauuguaguagcgagugcauuacgcccaacggauccauaccuaaugacaaaccauuucagaacgucaauagaaucacuuauggcgcaugucccagguacguuaagcaaaacacacugaaauuggccaccggcaugcggaaugugccugaaaagcagacucgugggauuuucggagcuaucgccgguuuuauagagaacggcugggaagggaugguagauggaugguauggcuuccgccaccaaaauucugaggguacagggcaggcagcugacauuaaaagcacccaggccgcgaucgaucagaucaacggcaagcucaauagacugauugagaaaacgaacgaaaaguuucaucagaucgagaaggaguucucagaaguggaaggaaggauucaagacuuagagaaauacgucgaggauaccaagauagaccuguggaguuauaaugccgaacuccuuguggcacuggagaaccagcacacaaucgauuugacugacuccgaaaugaauaaacuauucgagaagacccggaaacagcugcgagaaaacgcugaggauaugggcaacgggugcuuuaagauuuaccauaagugugacaaugccugcaucggaagcauccgcaacgguacauacgaccacgauguuuauagagacgaggcucucaauaacagguuccagauuaaaggcguggaacugaagucuggguacaaagaucuuauacuguggaucucauuugccauuaguugcuucuugcucugugucgugcuguuaggauuuaucaugugggcaugccaaaagggcaauauucgguguaacaucugcauauga

SEQ ID NO: 130508 - RNA, 1701 nt, Artificial Sequence
  derived and/or modified sequence opt3 from hemagglutinin__InfluenzaA__AFG72228
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagacuucaauuggaccgguguugcucaguccggggagucuuaugcaugcaagcgaggaagcgugaaguccuuuuucucacgucucaacugguuacacgagagugauuacaaauauccagaacugaaugucacgaugcccaacaauggcaaguuugacaaacuuuacauauggggcgugcaucacccuagcacugauagagagcaaaccucuuuguacguaagggccuccgggcggguuacagugucaacuaagcgcagccagcagaccgucaucccaaacauuggaaguagacccugggugaggggucugucuucccggaucagcauuuauuggacaaucgugaaaccuggcgacauacuacucauuaauucgaccgggaaccugaucgcuccacgcggauacuucaagauucgaacgggcaagucuuccaucaugagaucagacgccccgaucgguacuuguaguagcgaaugcauuacacccaacggguccauaccuaaugauaaaccauuucagaacgucaauaggaucaccuauggagcguguccccgguacguuaagcaaaacacucuuaaacuggcaacaggcaugcguaaugugccugagaagcagacccgcggcauuuucggggccaucgcuggauuuauagagaacgguugggaaggcaugguagacgggugguauggauucagacaccaaaauucugagggcacgggucaggccgcagauuugaaaagcacccaggcugccauugaccagaucaacgggaagcucaauaggcugaucgagaaaacaaacgaaaaguuucaucagauugaaaaggaguucucagagguggaaggccggauccaagauuuagagaaauacgucgaagacacuaagauugaucuguggaguuauaaugcggagcuccuuguggcccuggaaaaccagcacaccauagacuugacagauuccgagaugaauaaacuauucgagaagacucgaaaacagcugcgcgaaaacgcagaggacaugggaaauggcugcuuuaagaucuaccauaagugugauaacgcuugcauugggagcaucagaaacggaaccuacgaccacgacguuuauagggaugaagcccucaauaaccgguuccagaucaaagguguggagcugaagucuggcuacaaagacuggauucuuuggauaucauuugcuaucaguugcuuccuguugugugucgugcuccugggguuuauuaugugggccugccaaaagggaaauauccgcuguaacauuugcaucuga

SEQ ID NO: 130509 - RNA, 1701 nt, Artificial Sequence
  derived and/or modified sequence opt3 from hemagglutinin__InfluenzaA__AFG72239
augaagaccaucauugcccugagcuacauacucugccuugugcuggcucagaaauugcccggcuccgacaacucuacagcaacuuuaugucuggggcaccaugccgucccuaauggaacgcuaguuaagaccaucacaaacgaucaaauugaggugacuaaugcgaccgaacucguacagucaaguacaaccgguagaaucugcgacagcccacacaggauucuggauggcaaaaacuguacucuuaucgacgcucuguugggggauccgcauugcgacggauuccagaauaaggagugggaucucuuuguggaacgguccaaagccuauucuaacuguuaccccuaugacgucccugauuacgcaucgcugcgcucacugguggccagcaguggcacacucgaguucaccaaugaagacuuuaacuggacggguguugcucaguccggggagucuuaugcaugcaagcgaggaagcgugaaguccuucuuuucacguuuaaauuggcugcacgagagugauuacaaauauccagcccuuaacgucacuaugcccaauaacggcaaguucgacaaauuguacauauggggcgugcaucacccuagcaccgauagagaacaaacaucucuguacguaagggcuuccgggcggguuacugugucaaccaagcgcagccagcagacagucaucccaaauauuggaaguagacccugggugaggggucuaucuucccggaucagcauuuauuggaccaucgugaaaccuggcgacauacuccugauuaacucgacggggaaucuuaucgccccacgcggauacuuuaagauucgaacuggcaagucuuccaucaugagaucagacgcgccgaucgguacauguaguagcgagugcauuacccccaacggguccauaccuaacgauaaaccauuccagaaugucaacaggaucacuuauggagcauguccccgguacguuaagcaaaauacacugaaauuggccaccggcaugcguaacgugccugaaaagcagacgcgcggcauuuuuggggcuaucgccggauucauagagaaugguugggagggcaugguagacgggugguauggauuuagacaccagaacucugaaggcaccggucaggcagcugaucucaaaagcacacaagccgcgauugaccagaucaaugggaagcugaacagguuaaucgagaaaacuaaugaaaaguuccaucagauugagaaggaauuuucagagguggagggccggauccaagaucuggaaaaauacgucgaggacaccaagauugaucucuggaguuauaacgccgaacuucugguggcauuggagaaucagcacacaauagaccuaacugauuccgaaaugaacaaacuguucgagaagacccgaaaacagcuccgcgagaaugcugaagacaugggaaacggcugcuucaagaucuaccauaagugugauaaugccugcauugggagcaucagaaacggaacauacgaccacgacguuuauagggaugaggcucugaacaaucgguuucagaucaaagguguggaacuuaagucuggcuacaaagacuggauucuguggauaucauucgccaucaguugcuuuuugcucugugucgugcuguuaggguucauuaugugggcaugccaaaagggaaacauccgcuguaauauuugcaucuga

SEQ ID NO: 130510 - RNA, 1701 nt, Artificial Sequence; identical to SEQ ID NO: 130503
  derived and/or modified sequence opt3 from hemagglutinin__InfluenzaA__AFG72272

SEQ ID NO: 130511 - RNA, 1701 nt, Artificial Sequence
  derived and/or modified sequence opt3 from hemagglutinin__InfluenzaA__AFG72316
augaagaccaucauugcccugagccacauacucugccuuguguucgcucagaaacugcccggcaacgacaauuccacagcaacuuuguguuuagggcaucacgccgucccuaacggaacgcugguuaagaccaucacaaaugaucaaauugaggugacuaacgcgaccgaacuuguacagucuucaaguacagguagaaucugcgacagcccacauaggauucucgauggcaaaaauuguacccugaucgacgcucuacugggggauccgcacugcgacggauuucagaacaaggagugggauuuguucguggaacgguccaaagccuacucuaauuguuaucccuacgacgucccugauuaugcaucgcuccgcucacugguggccagcaguggcacucuggaguuuauaaacgaagacuucaauuggacagguguugcucaggaugggggauccuacgcaugcaagcgaggcucugugaacagcuuuuucucccgucucaauugguuacauaagcuggaguauaaauacccagcccuuaacgucaccaugcccaauaacggcaaguuugacaaauuguauaucuggggagugcaccacccuucaacggauagugaccaaacuagccuguacguaagagcuucugggaggguuaccguguccacaaagcggucacagcagacugucaccccaaauauugguagccgccccugggugagaggccuaaguucuaggaucuccauuuacuggacaaucgugaaaccuggggacauacuccugauuaacagcaccggaaaccuuaucgccccacggggcuauuucaagauucgcaaugguaagucgucuaucaugcgauccgaugucccgaucgggaacuguucaagugagugcauuacgcccaauggaagcauaccuaacgacaaaccauuucagaauguuaacagaaucacuuacggcgcgugucccagguaugugaagcaaaauacacugaaauuggcaaccggcaugcggaacguaccugaaaagcagacucgugggauuuucggagccaucgcugguuuuauagagaauggcugggaagggaugguggauggaugguacggcuuccgccaucagaacuccgaggguacagggcaggccgcagaccucaaaucuacccaagcugccauugaucagaucaauggcaagcugaacagauuaaucgagaaaacgaaugaaaaguuucaccagauugagaaggaguucagcgaagucgaaggaaggauccaagaccuggagaaauauguggaggauaccaagauugaccucuggucauacaacgcggaacuucugguugccuuggagaaucagcauacaauagaucuaacugacagugaaaugaacaaacuguucgagaagacccggaaacagcuccgagaaaacgcagaggauaugggcaaugggugcuuuaagaucuaucacaagugugacaacgcuugcauuggauccauccgcaaugguacauacgaccacgauguguacagagacgaggcccugaacaauagguuccagaucaaaggcgucgaacuuaagagcggguauaaagauuggauucuguggauaucuuuugcuaucucaugcuucuugcucugugugguacuguuaggauuuauuaugugggccugccaaaagggcaacauccgguguaauauuugcaucuga

SEQ ID NO: 130512 - RNA, 1701 nt, Artificial Sequence
  derived and/or modified sequence opt3 from hemagglutinin__InfluenzaA__AFG72339
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgugucgcuccgcucacugguugcaagcaguggcacucuggaguuuauaaacgaagacuucaauuggacagguguggcccaggaugggggauccuauaccugcaagcgaggcucugucaacagcuuuuucucccgucucaauugguuacacaagucagaguacaaauauccagcucugaacgugacgaugcccaauaacggcaaguuugacaaacuuuacaucuggggaguacaucacccuaguacugauagcgaccaaaccucuuuguacguuagagcauccgggagggugacagucucaacuaagcggagccagcagaccgugacaccaaauauugguagucgccccugggugagaggccugucuuccaggaucagcauuuauuggaccaucgucaaaccuggggacauacuacucauuaacucgacgggaaaccugaucgccccacggggcuacuucaagauucgcaaugguaagucuuccaucaugcgaucagaugcuccgaucgggacuuguaguagcgagugcauuacacccaacggauccauaccuaaugacaaaccauuucagaacguuaauagaaucaccuauggcgccugucccagguacgugaagcaaaacacucuuaaacuggcgacaggcaugcggaauguaccugaaaagcagacccgugggauuuucggagcaaucgccgguuuuauagagaacggcugggaagggaugguggauggaugguauggcuuccgccaccaaaauucugaggguacggggcaggcugccgacuugaaaagcacccaggcagcuauugaucagaucaacggcaagcucaauagacugaucgagaaaacaaacgaaaaguuucaucagauugagaaggaguucucagaagucgaaggaaggauccaagacuuagagaaauacguggaggauacuaagauugaccuguggaguuauaaugccgaacuccuuguugcgcuggagaaccagcacaccauagauuugacagacuccgaaaugaauaaacuauucgagaagacucggaaacagcugcgagaaaacgccgaggauaugggcaacgggugcuuuaagaucuaccauaagugugacaaugcaugcauuggaagcauccgcaacgguaccuacgaccacgauguguauagagacgaggcucucaauaacagguuccagaucaaaggcgucgaacugaagucuggguacaaagauuggauucuuuggauaucauuugccaucaguugcuuccuguugugugugguacuccugggauuuauuaugugggcuugccaaaagggcaauauccgguguaacauuugcaucuga

SEQ ID NO: 130513 - RNA, 1701 nt, Artificial Sequence
  derived and/or modified sequence opt3 from hemagglutinin__InfluenzaA__AFG72350
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgugucgcuccgcucacugguugcaagcaguggcacucuggaguuuauaaacgaagacuucaauuggacagguguggcccaggaugggcgauccuaugcuugcaagcguggaucugucaacagcuuuuucuccagacucaauugguuacacaagucagaguacaaauauccagcacugaacgugaccaugcccaauaacggcaaguuugacaaacuuuacaucuggggcguacaucacccuaguacggauagcgaccaaacuucuuuguacguuagggccuccgggcgggugaccgucucaacaaagcgcagccagcagacugugaccccaaauauuggaaguagacccugggugaggggucugucuucccggaucagcauuuauuggacaaucgucaaaccuggcgacauacuacucauuaacucgaccgggaaccugaucgcuccacgcggauacuucaagauucgaaauggcaagucuuccaucaugagaucagaugccccgaucgguauuuguaguagcgagugcauaacgcccaacggguccaucccuaaugacaaaccauuucagaacguuaauaggauuacuuauggagcguguccccgguacgugaagcaaaacacacuuaaacuggcaaccggcaugcguaauguaccugaaaagcagacucgcggcaucuucggggccauagcuggauuuauugagaacgguugggaaggcaugguggaugggugguauggauucagacaccaaaauucugagggcacaggucaggccgcagacuugaaaagcacccaggcugccaucgaucagaucaacgggaagcucaauaggcugauugagaaaacgaacgaaaaguuucaucagaucgagaaggaguucucagaagucgaaggccggauucaagacuuagagaaauacguggaggauaccaagauagaccuguggaguuauaaugcggaacuccuuguugcccuggagaaccagcacacaaucgauuugacugacuccgaaaugaauaaacuauucgagaagacccgaaaacagcugcgcgaaaacgcagaggauaugggaaacggcugcuuuaagauuuaccauaagugugacaaugcuugcaucgggagcaucagaaacggaacauacgaccacgauguguauagggacgaggcccucaauaaccgguuccagauuaaaggugucgaacugaagucuggcuacaaagauuggauacuuuggaucucauuugcuauuaguugcuuccuguugugugugguacuccugggguuuaucaugugggccugccaaaagggaaauauucgcuguaacaucugcauauga

SEQ ID NO: 130514 - RNA, 1701 nt, Artificial Sequence
  derived and/or modified sequence opt3 from hemagglutinin__InfluenzaA__AFG72372
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuauaccugcaagcgaggaucugugaacagcuuuuucucccgucucaauugguuacacaaacuggaguacaaguauccagcacuuaacgucacgaugcccaauaacggcaaauuugacaaguuguacaucuggggcgugcaucacccuucaacugauagugaccaaaccagccuguacguaagagccucugggaggguuacaguguccacuaaacggucacagcagaccgucauuccaaauaucggaagccgccccugggugagaggucuaaguucuaggauuuccaucuauuggacaauagugaagccuggcgacauucuccugaucaacagcaccgggaaccuuauugcuccacggggauacuucaagauccgcaauggcaaaucgucuaucaugcgauccgaugccccgauugguaacuguucaagugagugcauaacgcccaaugggagcaucccuaacgacaagccauuucagaaugucaacagaauuacuuauggagcgugucccagguacguuaaacaaaauacacugaaguuggcaaccggcaugcggaacgugccugaaaaacagacucguggcaucuucggggccauagcuggauuuauugagaaugguugggaaggcaugguagaugggugguauggauuccgccaccagaacuccgagggcacaggucaggccgcagaccucaagucuacccaagcugccaucgaucagaucaaugggaaacugaacagauuaauugagaagacgaaugaaaaguuucaucagaucgagaaagaguucagcgaaguggaaggcaggauucaagaccuggagaaguacgucgaggauaccaaaauagaccucuggucauauaacgcggaacuucugguggccuuggagaaucagcacacaaucgaucuaacugacagugaaaugaacaagcuguucgagcggacccgaaaacagcuccgcgaaaacgcagaggauaugggaaauggcugcuuuaagauuuaccauaagugugacaacgcuugcaucggguccaucagaaauggaacauacgaccacgauguuuauagggacgaggcccugaacaaucgguuccagauuaaagguguggaacuuaagagcggcuacaaagauuggauacuguggaucucuuuugcuauuucaugcuucuugcucugugucgugcuguuaggguuuaucaugugggccugccaaaagggaaacauucgcuguaauaucugcauauga

SEQ ID NO: 130515 - RNA, 1701 nt, Artificial Sequence; identical to SEQ ID NO: 123040
  derived and/or modified sequence opt3 from hemagglutinin__InfluenzaA__AFG72383

SEQ ID NO: 130516 - RNA, 1701 nt, Artificial Sequence
  derived and/or modified sequence opt3 from hemagglutinin__InfluenzaA__AFG72394
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcuuugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguggccacaaaacggucccagcagacugucauuccaaauaucggauuccgccccugggugagaggucagucaagcggcauuaguaucuauuggaccauagugaagccuggggacauucuacucaucaacucuacaggaaaccugauugcgccaaggggcuacuuuaagauccggaaugguaaauccagcaucaugcgcucggaugcaccgauugggaacuguucuuccgagugcauaacccccaauggaucaaucccuaacgacaagccauuccaaaaugucaaccgaauuacguauggcgccugucccagauacguuaaacagaauacucuuaagcuggcuacaggcaugaggaacgugccugaaaaacagacccgggggaucuuuggagccauagcagguuucauugagaauggcugggaagggaugguagauggaugguauggcuuucgucaccagaacagugaggguacugggcaagcugccgaccuuaagagcacacaggcggccaucgaucagaucaauggcaaacucaaccgccugauugagaagaccaaugaaaaguuccaucaaaucgagaaagaguucuccgaaguggaaggaaggauucaggacuuagagaaguacgucgaggauacgaaaauagaccuguggucuuauaacgcaggccuccuuguggcucuggaaaaucagcacaccaucgauuugacagacagcgagaugaacaagcuauuugaaagaacucggaaacagcugcgagagaacgccgaagauauggggaauggaugcuucaagauuuaccauaagugugacaacgcuugcaucgguucaauccgcaauggcaccuacgaccacgauguuuauagagacgaggcccucaacaauagguuucaaauuaaagggguggagcugaagaguggauacaaagauuggauacuuuggaucuccuucgcaauuagcugcuuucuguugugugucgugcuccugggcuucaucaugugggccugccagaaggguaacauucgguguaauaucugcauauga

SEQ ID NO: 130517 - RNA, 1701 nt, Artificial Sequence
  derived and/or modified sequence opt3 from hemagglutinin__InfluenzaA__AFG72405
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgaacugcgacggauuucagaauaaggagugggauuuguucguggaacgguccaaagccuauucuaacuguuaccccuaugacgucccugauuacgcaucgcuccgcucacugguggccagcaguggcacucuggaguuuacaaaugaagacuucaacuggaccgguguugcucaggaugggggauccuaugcaugcaagcgaggcucugugaaguccuuuuucucccgucucaauugguuacauaaacuggaguacaaguauccagcccuuaacgucacgaugcccaauaacggcaaauuugacaaguuguacauauggggagugcaccauccuucaacugauagugaccaaaccagccuguacguaagagcuucugggaggguuacaguguccacuaaacggucacagcagaccgucacaccaaauaucgguagccgccccugggugagaggccuaaguucuaggauuuccaucuauuggaccauugugaagccuggggacauccuccugauaaacagcacgggaaaccuuauugccccacggggcuacuucaagauccgcaaugguaaaucgucuauuaugcgauccgaugcgccgaucgggacuuguucaagugagugcaucacacccaacggaagcauuccuaaugacaagccauuucagaacgucaauagaauaaccuauggcgcaugucccagguacguuaaacaaaacacucugaaguuggccacaggcaugcggaaugugccugaaaaacagacccgugggaucuucggagcuauugccgguuuuaucgagaacggcugggaagggaugguagauggaugguauggcuuccgccaccagaauagcgaggguacggggcaggcagcugaccucaagucuacccaagccgcgauaaaccagauuaauggcaaacugaacagauuaaucgagaagacaaaugaaaaguuucaccagaucgagaaagaguucagcgaaguggaaggaaggauucaagaucuggagaaguacgucgaggacacuaaaaucgaucucuggucauauaacgccgaacuucugguggcauuggagaaucagcauaccauugaccuaacagauagugaaaugaacaagcuguucgagaaaacucggaagcagcuccgagaaaacgcugaggacaugggcaaugggugcuuuaagauauaccacaaaugugauaacgccugcaucggauccauucgcaaugguaccuacgaccaugacguuuauagagaugaggcucugaacaauagguuccagaucaagggcguggaacuuaaaagcggguacaaggacuggauccuguggauuucuuuugccauaucaugcuucuugcucugugucgugcuguuaggauuuaucaugugggcaugccaaaaaggcaacauucgguguaauaucugcauuuga

SEQ ID NO: 130518 - RNA, 1701 nt, Artificial Sequence
  derived and/or modified sequence opt3 from hemagglutinin__InfluenzaA__AFG72449
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcuauagcccacacaggauucucgacggcaauaacuguacccugaucgaugcucuacugggggacccgcauugcgauggauuucagaauaaagagugggacuuguucguggaacgguccaaggccuacucuaacuguuaucccuacgaugucccugacuaugcaucgcuccgcucacugguggccagcaguggcacucuggaguuuauaaaugaagauuucaacuggacagguguugcucaggacgggaaauccuacgcaugcaagcgaggaucugugaagggcuuuuucagccgucucaauugguuacacaaacuggaguauaaguacccagcccuuaacgucaccaugcccaauaacggcaaauuugauaaguuguacaucuggggagugcaucacccuuccacggacucagaucaaacuucccuguauguaagagcuagcggggguguuaccgugucuacaaaaaggucccagcagacugucauuccaucaaucggcagccggcccugggugcgcgggcuaaguucuagaauuuccaucuacuggaccauagugaagccuggagacauucuccugaucaauagcacaggcaaccuuauugccccaagggguuauuucaagauccggaacgggaaaucgucuaucaugcgcuccgacgcgccgauuggaaauuguucaagugagugcauaacccccaacggcagcaucccuaaugauaagccauuucagaacgucaaucgaauuacguacggcgcaugucccagauauguuaaacaaaacacucugaaguuggccacagggaugaggaaugugccugaaaaacagacccggggaaucuucggugcuauagccggcuuuauugagaacgggugggaaggaaugguagacggcugguacgguuuccgucaccagaauagugaggggacuggccaggcagcugaucucaagucuacacaagccgcgaucgaccagaucaacggaaaacugaaucgcuuaauugagaagaccaacgaaaaguuucaucagaucgagaaagaguucagcgaaguggaaggcaggauucaagaucuggagaaguaugucgaggacacgaaaauagaucucuggucauacaaugccgaacuucugguggcauuggagaaccagcacaccaucgaccuaacagauagugaaaugaauaagcuguucgagagaacucggaaacagcuccgagaaaacgcugaggacauggggaacggaugcuuuaagauuuaccauaagugugauaaugccugcaucgguuccauccgcaacggcaccuaugaccacgacguuuacagagaugaggcucugaauaacagguuccagauuaaagggguggaacuuaagagcggauauaaagacuggauacuguggaucucuuuugccauuucaugcuucuugcucugugucgugcuguuaggcuuuaucaugugggcaugccaaaaggguaauauucgguguaacaucugcauauga

SEQ ID NO: 130519 - RNA, 1701 nt, Artificial Sequence; identical to SEQ ID NO: 123069
  derived and/or modified sequence opt3 from hemagglutinin__InfluenzaA__AFG72460

SEQ ID NO: 130520 - RNA, 1701 nt, Artificial Sequence
  derived and/or modified sequence opt3 from hemagglutinin__InfluenzaA__AFG72504
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaaauccuuuuucagccgucucaacugguuacacaagcuggaguacaaauauccagcccuuaaugucaccaugcccaacaauggcaaguuugacaaauuguacaucuggggcgugcaucacccuucaacggauagugaccaaacuagccuguacguaagagcuucugggaggguuaccguguccacaaagcggucacagcagacugucauuccaaacaucggauuccgccccugggugagaggucuaagcaguaggauuucuaucuauuggaccauagugaagccuggcgacauucuccugaucaauuccacagggaaccuuauugccccacggggauacuuuaaaauccgcaacggcaagagcucgaucauucgaucugaugcgccgauagguaauuguuccucagagugcaucacccccaacgggaguauuccuaaugacaaaccauuccagaacgucaauagaaucacguauggagcaugucccagguacguuaagcaaaacacucugaaauuggccacaggcaugcggaaugugccugaaaagcagacccguggcauauuuggggcuauugccggauucaucgagaacgguugggaaggcaugguagaugggugguauggauuucgccaccagaauagcgagggcacuggucaggcagcugaccucaaauccacacaagccgcgaucgaucagauuaacgggaagcugaauagauuaaucgagaagaccaacgaaaaauuccaucagauugagaaggaguucucugaaguggaaggcaggauacaagaccuggagaaauacgucgaggauacgaagaucgaccucuggagcuauaaugccggacuucugguggcauuggaaaaccagcacaccauugaucuaacagacucagagaugaauaaacuguuugaacggacucgaaagcagcuccgcgagaacgcugaagauaugggcaacgggugcuucaagaucuaccauaaaugugacaaugccugcaucggaaguauuagaaacgguaccuacgaccacgauguuuauagggacgaggcucugaauaaccgguuucagauaaagggcguggagcuuaaauccggguacaaggauuggauccuguggauuagcuucgccaucucuugcuuuuugcucugugucgugcuguuaggauucauuaugugggcaugccaaaaaggcaauauccgcuguaacauaugcaucuga

SEQ ID NO: 130521 - RNA, 1701 nt, Artificial Sequence
  derived and/or modified sequence opt3 from hemagglutinin__InfluenzaA__AFG72515
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuauaaacgaaaauuucaacuggacagguguugcucaggacgggaagaguuaugcaugcaagcgaggauccgugaauaguuucuucagccgucucaacugguuacacaaacuggaguacaaguaucccgcccuuaaugucaccaugccuaacaauggcaaauuugauaaguuguacaucuggggcgugcaucacccauccacggacucagaucaaacuucucuguacguaagagcuagcgggaggguuaccgugucuacaaaacggucccagcagacugucauucccgacaucggauaucgcccuugggugagaggucuaucaagcaggauuaguaucuacuggaccauagugaagccaggcgacauucuccugaucaacucuacagggaaccuuauugccccgcggggauauuucaagauccgcaauggcaaauccagcaucaugcgaucggaugcgcccauugguaacuguucuuccgagugcauaaccccuaaugggucaaucccaaacgacaagcccuuucagaaugucaacagaauuacguacggagcauguccuagguauguuaaacaaaauacucugaaguuggccacaggcaugcggaacgugccagaaaaacagacccguggcaucuucggggcuauagccggauuuauugagaaugguugggaaggcaugguagaugggugguacggauuccgccaccagaacagugagggcacuggucaggcagcugaccucaagagcacacaagccgcgaucgaucagaucaaugggaaacugaacagauuaguggagaagaccaaugaaaaguuucaucagauugagaaagaauuuuccgaggucgaaggcaggauccaagaccuggagaaguauguggaggauacgaaaauugaccucuggucuuacaacgccgaacuucugguugcauuggagaaucagcacaccauagaucuaacagacagcgaaaugaacaagcuguucgagcggacucgaaaacagcuccgcgaaaacgcugaggauaugggaaauggcugcuuuaagaucuaccauaagugugacaacgccugcauugggucaaucagaaauggaaccuaugaccacgauguguacagggacgaggcucugaacaaucgguuccagaucaaaggugucgaacuuaagaguggcuauaaagauuggauucuguggauauccuuugccaucagcugcuucuugcucugugugguacuguuaggguuuauuaugugggcaugccaaaagggaaacauccgcuguaauauuugcaucuga

SEQ ID NO: 130522 - RNA, 1701 nt, Artificial Sequence
  derived and/or modified sequence opt3 from hemagglutinin__InfluenzaA__AFG72526
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuucguguuaccccuaugacgucccugauuacgcaucacuccgcagccugguggccaguuccggcacucuggaguuuauaaaugaagacuucaacuggacagguguugcucaggaugggaagucuuaugcaugcaagcgaggaagcgucaauuccuuuuucucacgucucaacugguuacacaaacuggaguacaaguauccagcccuuaaugugaccaugcccaacaauggcaaauuugacaaguuguacaucuggggcgugcaucacccuaguacggauagcgaccaaacuucucuguacguaagagcuuccgggaggguuauugugucaaccaaacggagccagcagacagucaucccaaacauuggaagucgccccugggugagaggucuaucuuccaggaucagcauauauuggacuauugugaagccuggcgacauccuccugauuaauucgaccgggaaccuuaucgccccacggggauacuucaagauccgcacaggcaaaucuuccauuaugcgaucagaugcgccgauagguaacuguaguagcgagugcaucacccccaauggguccauuccuaacgacaagccauuucagaaugucaacagaaucacguauggagcaugucccagguacguuaaacaaaauacucugaaguuggccacaggcaugcggaacgugccugaaaaacagacccguggcauauucggggcuauugccggauuuaucgagaaugguugggaaggcaugguagaugggugguauggauuccgccaccagaacucugagggcacuggucaggcagcugaccucaagagcacacaaaccgccaucaaucagauuaacgggaaacugaauagauuaaucgagaagacgaacgaaaaguuucaucagauugagaaagaguucucagaaguggaaggcaggauacaagaucuggagaaguacgucgaggacaccaaaaucgaucucuggaguuauaaugcggaacuucugguggccuuggagaaccagcacacaauugaccuaacugauuccgaaaugaauaagcuguucgagcggacccgaaaacagcuccgcgaaaacgcagaggacaugggaaacggcugcuuuaagaucuaccauaagugugauaaugcuugcaucgggagcauuagaaacggaacauacgaccacgacguuuauagggaugaggcccugaauaaccgguuccagauaaaagguguggaacuuaagucuggcuacaaagacuggauccuguggauuucauuugcuaucaguugcuucuugcucugugucgugcuguuaggguuuauuaugugggccugccaaaagggaaauauccgcuguaacauaugcaucuga

SEQ ID NO: 130523 - RNA, 1701 nt, Artificial Sequence
  derived and/or modified sequence opt3 from hemagglutinin__InfluenzaA__AFG72581
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggggaguuaccguguccacaaaaaggucacagcagacugucauuccaaauaucgguuaucggcccugggugcgcggccuaagcaguagaauuucuaucuacuggaccauagugaagccuggggacauucuccugaucaacuccacaggaaaccuuauugccccaaggggcuauuucaagauccggaaugguaaaagcucgaucaugcgcucugaugcgccgauugggaacuguuccucagagugcauaacccccaauggaaguaucagcaacgacaagccuuuucagaaugucaaccgaauuacguacggcgcauguccaagauauguuaaacaaaauacucugaaguuggccacaggcaugaggaacgugcccgaaaaacagacccgggggaucuucggagcuauagccgguuuuauugagaauggcugggaagggaugguagauggaugguacggcuuccgucaccagaacuccgaggguacugggcaggcagcugaccucaagucuacacaagccgcgaucgaucagaucaauggcaaacugaaccgcuuaauugagaagaccaaugaaaaguuucaucagaucgagaaagaguucagcgaaguggaaggaaggauucaagaccuggagaaguaugucgaggauacgaaaauagaccucuggucauacaacgccgaacuucugguggcauuggagaaucagcacaccaucgaucuaacagacagugaaaugaacaagcuguucgagagaacucggaaacagcuccgagaaaacgcugaggauaugggcaaugggugcuuuaagauuuaccauaagugugacaacgccugcaucggauccauccgcaaugguaccuaugaccacgauguuuacagagacgaggcucugaacaauagguuccagauuaaaggcguggaacuuaagagcggguauaaagauuggauacuguggaucucuuuugccauuucaugcuucuugcucugugucgugcuguuaggauuuaucaugugggcaugccaaaagggcaacauucgguguaauaucugcauauga

SEQ ID NO: 130524 - RNA, 1701 nt, Artificial Sequence
  derived and/or modified sequence opt3 from hemagglutinin__InfluenzaA__AFG72603
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugguaauuguaaaucagagugcauaacgcccaacgggaguaucccuaaugacaagccauuucaaaacgucaaucgaauuacuuauggagcaugucccagauacguuaaacagaacacacuuaagcuggccaccggcaugaggaaugugccugaaaaacagacucggggcaucuucggggcuauagccggauuuauugagaacgguugggaaggcaugguagaugggugguauggauuccgucaccagaauagcgagggcacaggucaagcagcugacuugaaguccacccaggccgcgacggaucagaucaacgggaagcucaaucgccugaucgagaaaaccaacgaaaaguuucaucaaauugagaaagaguucucugaaguggaaggcagaauccaggacuuagagaaguacgucgaggauacaaaaauugaccuguggagcuauaaugccgaacuccuuguggcacuggagaaccagcacacuauagauuugaccgacucagaaaugaauaagcuauucgagaggacacggaagcagcugcgagaaaacgcugaggauaugggaaacggcugcuuuaaaaucuaccauaagugugacaaugccugcauugggaguauccgcaacggaacuuacgaccacgauguuuauagagacgaggcucucaauaacagguuccaaaucaaagguguggaacugaaguccggcuacaaagauuggauucuuuggaucagcuuugccauaucuugcuuccuguugugugucgugcuccugggguuuauuaugugggcaugccagaagggaaauauccgguguaacauuugcaucuga

SEQ ID NO: 130525 - RNA, 1701 nt, Artificial Sequence
  derived and/or modified sequence opt3 from hemagglutinin__InfluenzaA__AFG72614
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuauucuugcaagcgaggcagcgugaaguccuuuuucucacgucucaacugguuacacaaacuggaguacaaguauccagcacuuaaugucgccaugcccaacaaugauaaauuugacaaguuguacauauggggcgugcaucacccuaguacugauagcgaccaaaccucucuguacguacaggcuuccgggagaguuacagugucaacuaaaaggagccagcagaccgucaucccaaacauuggaagucggcccugggugcgcggugugucuuccagaaucagcauuuauuggacaaucgucaagccuggcgacauacuacucauuaauucgaccgggaaccugaucgccccaaggggauacuucaagauucggucuggcaaauccucaaucaugcgcagugaugcgccgaucgguaacuguaauagcgagugcauuacgcccaacggguccauaccuaaugacaagccauuucaaaacguuaaucgaaucacuuauggagcaugucccagauacgugaaacagaacacacuuaagcuggccaccggcaugaggaauguaccugaaaaacagacucggggcauuuucggggcuaucgccggauuuauagagaacgguugggaaggcaugguggaugggugguauggauuccgucaccagaauagcgagggcacaggucaagcagcugacuugaagucuacccaggccgcgauuaaccagaucaaugggaaacucaaccgccugaucgagaagacgaaugaaaaguuucaucaaauugagaaagaguucucagaagucgaaggcagaauccaggauuuagagaaguacguggaggacaccaaaauugaucuguggaguuauaacgccgaacuccuuguugcacuggagaaucagcacacaauagacuugacugauuccgaaaugaacaagcuauucgagaggacccggaaacagcugcgagaaaacgcugaggacaugggaaauggcugcuuuaagaucuaccauaagugugauaacgccugcauugggagcauccgcaauggaacauacgaccacgacguguauagagaugaggcucucaacaauagguuccaaaucaaaggugucgaacugaagucuggcuacaaagacuggauucuuuggauaucauuugccaucaguugcuuccuguugugugugguacuccugggguuuauuaugugggcaugccagaagggaaacauccgguguaauauuugcaucuga

SEQ ID NO: 130526 - RNA, 1701 nt, Artificial Sequence
  derived and/or modified sequence opt3 from hemagglutinin__InfluenzaA__AFG72625
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugucaagagcuuuuucucccgucucaacugguuacacaaacuggaguacaaguauccagcccuuaaugugacuaugcccaacaaugauaaauuugacaaguuguacauauggggcgugcaucacccuucaaccgauagugaccaaacaagccuguacguacaggcuucugggagaguuacuguguccaccaaaaggucacagcagacagucaucccaaacauuggaagccggcccugggugcgcgguaucaguucuagaauuuccaucuauuggaccauagugaagccuggcgacauucuacucaucaagagcacggggaaucugauugccccaaggggauacuucaaaauccggucgggcaagucuuccaucaugcgcucagaugcgccgauugguaacuguaacagugagugcauaacucccaaugggagcaucccuaacgacaaaccauuucaaaaugucaaccgaauuacauauggagcaugucccagauacguuaagcagaauacccuuaaacuggccacuggcaugaggaacgugccugaaaagcagacacggggcaucuucggggcuauagccggauuuauugagaaugguugggaaggcaugguagaugggugguauggauuccgucaccagaacuccgagggcaccggucaagcagcugacuugaaaucuacgcaggccgcgaucaaucagaucaacgggaagcucaaucgccugauugagaagaccaacgaaaaauuucaucaaaucgagaaggaguucagcgaaguggaaggcaggauucaggauuuagagaaauacgucgaggacacaaagauagaucuguggucauauaaugccgaacuccuuguggcacuggagaaccagcacacuaucgacuugaccgauagugaaaugaauaaacuauucgagagaacacggaagcagcugcgagaaaacgcugaggacaugggaaacggcugcuuuaagauuuaccauaaaugugauaaugccugcaucggguccauccgcaacggaacuuacgaccacgacguuuauagagaugaggcucucaauaacagguuccaaauuaaggguguggaacugaaaagcggcuacaaggacuggauacuuuggaucucuuuugccauuucaugcuuccuguugugugucgugcuccugggguuuaucaugugggcaugccagaaaggaaauauucgguguaacaucugcauauga

SEQ ID NO: 130527 - RNA, 1701 nt, Artificial Sequence
  derived and/or modified sequence opt3 from hemagglutinin__InfluenzaA__AFG72636
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaaauccuuuuucagccgucucaacugguuacacaagcuggaguuuaaauacccagcccuuaaugucacgaugcccaacaaugauaaguucgacaaauuguauauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuacuggacaauagugaagccuggcgacauucuacucaucaauagcaccgggaaccugauugccccaaggggauauuuuaaaauccggaacggcaagucgucuaucaugcgcuccgaugcgccgauugacaauuguaacucagagugcauaacgcccaaugguaguaucccuaacgauaaaccauuccaaaaugucaaccgaauuacuuacggggcaugucccagauauguuaagcagaauacacuuaaacuggccaccggaaugaggaacgugccugaaaagcagacucggggcaucuuuggcgcuauagccggguucauugagaauggaugggaagguaugguagacggcugguacggguuucgucaccagaacagcgagggaacaggccaagcagcugauuugaaauccacccaggccgcgaucgaccagaucaaugguaagcucaaccgccugauugagaagacgaaugaaaaauuccaucaaaucgagaaggaguucucugaaguggaagggaggauucaggauuuagagaaauaugucgaggacaccaagauagaucuguggagcuacaacgccgaacuccuuguggcacuggagaaucagcacacaaucgacuugacugauucagaaaugaacaaacuauuugagagaacccggaagcagcugcgagaaaacgcugaggacaugggcaauggaugcuucaagauuuaucauaaaugugacaacgccugcaucggcaguauccgcaaugggacauacgaucacgacguuuacagagaugaggcucucaacaauagguuucaaauuaagggaguggaacugaaauccgguuauaaggacuggauacuuuggaucagcuucgccauuucuugcuuucuguugugugucgugcuccugggcuucaucaugugggcaugccagaaagggaacauucgguguaauaucugcauauga

SEQ ID NO: 130528 - RNA, 1701 nt, Artificial Sequence
  derived and/or modified sequence opt3 from hemagglutinin__InfluenzaA__AFG72658
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacacaggauucucgauggcaaaaauuguacccugaucgacgcccuucugggggauccgcauugcgacggauuucagaacaaggaaugggauuuguucguagaacgguccaaagcauauucuaauuguuaccccuaugacgugccugauuacgccucgcuccgcucacuggucgcuagcaguggcacucuggaguuuacaaacgaagguuucaauuggaccgggguggcacaggacggaaaguccuaugccugcaagcgaggcucuguuaacagcuuuuucucccgucucaauugguuacacaaacuggaguacaaguauccagcucuuaacgugacgaugcccaauaacgauaaauuugacaaguuguacauauggggcguccaucacccuucaacugauagugaccaaaccagccuguacgugcaggccucugggagaguaacaguuuccacuaaaaggucacagcagaccgugaucccaaauauuggaagccggcccuggguccgcgguaucaguucuagaauuuccaucuauuggacaauagugaagccuggcgacauucuacucaucaacagcaccgggaaccugauugcgccaaggggauacuucaagauccggaauggcaaaucgucuaucaugcgcuccgaugcaccgauugacaacuguaauucagagugcauaacgcccaacgguaguaucccuaaugauaagccauuucaaaacgugaaucgaauuacuuauggggccugucccagauacgucaaacagaacacacuuaagcuggcuaccggaaugaggaauguuccugaaaaacagacucggggcaucuucggcgccauagcaggguuuauugagaacggaugggaagguaugguggacggcugguauggguuccgucaccagaauagcgagggaacaggccaagcugccgauuugaaguccacccaggcggccaucgaccagaucaacgguaaacucaaucgccugauugagaagacgaacgaaaaguuucaucaaaucgagaaagaguucucugaaguagaagggaggauucaggauuuagagaaguacguggaggacaccaaaauagaucuguggagcuauaaugcagaacuccuugucgcucuggagaaccagcacacaaucgacuugacugauucagaaaugaacaagcuauucgagagaacccggaaacagcugcgagaaaaugccgaggacaugggcaacggaugcuuuaagauuuaccauaagugugacaaugcuugcaucggcaguauccgcaacgggacauacgaucacgacguguauagagaugaggcccucaauaacagguuccaaauuaaaggaguugaacugaaguccgguuacaaagacuggauacuuuggaucagcuuugcaauuucuugcuuccuguugugugugguccuccugggcuuuaucaugugggccugccagaaggggaauauucgguguaacaucugcauauga

SEQ ID NO: 130529 - RNA, 1701 nt, Artificial Sequence
  derived and/or modified sequence opt3 from hemagglutinin__InfluenzaA__AFG72680
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguaucauuugcgacagcccacacagaauccucgauggcaaaaauuguacccugauagacgcucuacugggggauccgcauugcgacggauuucagaacaaggagugggauuuguucguggaaagguccaaagccuauucuaauuguuaccccuaugacgucccugauuacgcaucgcuccggucacugguggccagcaguggcacucuggaguuuacaaacgaagguuucaauuggaccgggguugcucaggacggaacguccuaugcaugcaagcgcggcucugugaaguccuuuuucucccgacucaacugguuacacaaacuggaguacaaguauccagcccuuaaugucacuaugcccaacaaugauaaauuugacaaguuguacaucuggggcgugcaucacccuucaaccgauagugaccaaacaagccuguacguacaggcuucugggcguguuacuguguccaccagaaggucacagcagacagucauuccaaacaucggaagccggcccugggugcgcggugugaguucuagaauuuccaucuauuggaccauagucaaaccuggcgacauucuacucaucaauagcacggggaaccugauugccccaaggggauacuucaagauccggucgggcaagucuuccaucaugcgcucagaugcgccgauugguaacuguaauagugagugcauaacucccaacgggagcaucccuaaugacaaaccauuucaaaacguuaaucgaauuacauauggagcaugucccagauacgugaagcagaacacccuuaaacuggccacuggcaugaggaauguaccugaaaagcagacacggggcaucuucggggcuauagccggauuuauugagaacgguugggaaggcaugguggaugggugguauggauuccgucaccagaauagcgagggcaccggucaagcagcugacuugaaaucuacgcaggccgcgaucaaccagaucaaucgcaagcucaacagacugauugagaaaaccaaugaaaaguuucaucaaaucgagaaggaguucagcgaagucgaagggaggauucaggauuuagagaaauacguggaggacacaaagauagaucuguggucauauaacgccgaacuccuuguugcacuggagaaucagcacacuaucgacuugaccgauagugaaaugaacaaacuauucgagcggacacgaaagcagcugcgcgaaaacgcugaggacaugggcaauggaugcuuuaaaauuuaccauaagugugauaacgccugcaucggcuccaucagaaaugggacuuacgaccacgacguguauagggaugaggcucucaacaaucgguuccaaauuaagggagucgaacugaaaagcgguuacaaggacuggauacuuuggaucucuuuugccauuucaugcuuccuguugugugugguacuccugggcuuuaucaugugggcaugccagaaagggaacauucgcuguaauaucugcauauga

SEQ ID NO: 130530 - RNA, 1701 nt, Artificial Sequence
  derived and/or modified sequence opt3 from hemagglutinin__InfluenzaA__AFG72691
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacacaggauucucgauggcaaaaauuguacccugaucgacgcccuucugggggauccgcauugcgacggauuuaagaacaaagagugggauuuguucguggaacgguccacugcuuauucuaauuguuaccccuaugacgucccugauuacgcaucgcuccgcucacugguggccagcaguggcacacuggaguuuaccaacgaagguuucaauuggacggggguugcucaggacggaacuuccuaugcaugcaagcgaggcucugucaagagcuuuuucucccgucucaacugguuacacaaacuggaguacaaguauccagcccuuaaugugaccaugcccaacaaugauaaauuugacaaguuguacauauggggcgugcaucacccuucaacagauagugaccagacuagccuguacguacaggcuucugggagaguuaccguguccacaaaaaggucacagcagaccgucaucccaaacauuggaagccggcccugggugcgcggugugaguucuagaaucuccauuuauuggacgaucgucaagccuggcgacauacuacucauuaauagcacugggaaccugaucgccccaaggggauacuucaagauucggucgggcaaaucuuccaucaugcgcucagaugcgccgaucgacaacuguaauagugagugcauuacacccaacgguagcauaccuaaugggaagccauuucagaacguuaaucgaaucaccuauggagcaugucccagauacgugaaacaaaacacucuuaagcuggccacaggcaugaggaauguaccugaaaaacagacccggggcauuuucggggcuaucgccggauuuauagagaacgguugggaaggcaugguggaugggugguauggauuccgucaccaaaauuccgagggcacgggucaggcagcugacuugaagucuacccaagccgcgauuaaccagaucaaugggaaacucaaccgccugaucgagaagacaaaugaaaaguuucaucagauugagaaagaguucagcgaagucgaaggcagaauccaagauuuagagaaguacguggaggacacuaaaauugaucuguggucauauaacgccgaacuccuuguugcacuggagaaucagcacaccauagacuugacagauagugaaaugaacaagcuauucgagaggacucggaaacagcugcgagaaaacgcugaggacaugggaaauggcugcuuuaagaucuaccauaagugugauaacgccugcauuggguccauccgcaauggaaccuacgaccacgacguguauagagaugaggcucucaacaauagguuccagaucaaaggugucgaacuaaagagcggcuacaaagacuggauucuuuggauaucuuuugccaucucaugcuuccuguugugugugguacuccugggguuuauuaugugggcaugccaaaagggaaacauccgguguaauauuugcaucuga

SEQ ID NO: 130531 - RNA, 1701 nt, Artificial Sequence
  derived and/or modified sequence opt3 from hemagglutinin__InfluenzaA__AFG72713
augaagaucauuauagcccugagcuacauccucugccuuguguucgcucagaaacugcccggcaacgacaauuccaccgcaacauuguguuuagggcaccaugccgucccuaacggaacucugguuaagacgauuaccaaugaucaaaucgaggugacaaacgcgacugaauugguacagucuucaaguaccgguagaauuugcgacagcccacaccagauccucgauggcaaaaauuguacacugauagacgcccuucugggggauccgcauugcgacggauuuaagaacaaagagugggauuuguucguggaaagguccaccgcuuauucuaauuguuaccccuaugacgucccugauuacgcaucgcuccggucacugguggccagcaguggcacucuggaguuuacaaacgaagguuucaauuggaccgggguugcucaggacggaacguccuaugcaugcaagcgcggcucugucaagagcuuuuucucccgacucaacugguuacacaaacuggaguacaaguauccagcccuuaaugugacuaugcccaacaaugauaaauuugacaaguuguacaucuggggcgugcaucacccuucaaccgauagugaccaaacaagccuguacguacaggcuucugggcguguuacuguguccaccaaaagaucacagcagacagucauuccaaacaucggaagcaggcccugggugcgggguauuaguucucgcaucuccauauauuggaccauugugaagccuggcgacauccuacucauuagcucgacggggaaucugaucgccccaagaggauacuucaagaucaggucuggcaaauccucaauuauacggagugaugcgccgaucgacaacuguaacagcgagugcauuacucccaaugguuccaucccuaacgauaagccauuucaaaaugucaaccgcauaacauauggggcauguccccgauacguuaaacagaauacccuuaagcuggccacuggaaugagaaacgugccugaaaaacagacaaggggcauuuucggcgcuaucgccggguuuaucgagaauggaugggaagguaugguagacggcugguauggguuccggcaccagaacucugagggaaccggccaagcagcugaucuaaagagcacgcaggccgcgauuaaucagaucaacgguaaacucaaucgucugauugagaagaccaacgaaaaguuucaucaaauagagaaagaguucucagaaguggaagggcgcauccaggacuuagagaaguacgucgaggauacaaaaauugaccuguggaguuauaaugccgaacuccuuguggcacuggagaaccagcacacuaucgauuugaccgacuccgaaaugaauaagcuauucgagagaacaaggaaacagcugcgggaaaacgcugaggauaugggcaacggaugcuuuaagaucuaccauaagugugacaaugccugcauuggcagcauacgaaacgggacuuacgaccacgauguuuaucgcgacgaggcucucaauaacagauuccaaaucaaaggaguggaacugaagucugguuacaaagauuggauucuuuggaucucauuugccauuaguugcuuccuguugugugucgugcuccugggcuuuaucaugugggcaugccagaaggggaauauaagguguaacaucugcauuuga

SEQ ID NO: 130532 - RNA, 1701 nt, Artificial Sequence
  derived and/or modified sequence opt3 from hemagglutinin__InfluenzaA__AFG72724
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugugaaguccuuuuucucccgucucaacugguuacacaaacuggaguacaaguauccagcccuuaaugucacuaugcccaacaaugauaaauuugacaaguuguacauauggggcgugcaucacccuucaaccgauagugaccaaacaagccuguacguacaggcuucugggagaguuacuguguccaccaaaaggucacagcagacagucaucccaaacauuggaagccggcccugggugcgcggugugaguucuagaaucuccauuuauuggaccaucgucaagccuggcgacauacuacucauuaauagcacggggaaccugaucgccccaaggggauacuucaagauucggucgggcaaaucuuccaucaugcgcucagaugcgccgaucgacaacuguaauagugagugcauuacucccaacgguagcauaccuaaugauaagccauuucaaaacguuaaucgaaucacauauggggcaugucccagauacgugaaacagaacacccuuaagcuggccacuggaaugaggaauguaccugaaaaacagacacggggcauuuucggcgcuaucgccggguuuauagagaacggaugggaagguaugguggacggcugguauggguuccgucaccagaauagcgagggaaccggccaagcagcugauuugaagucuacgcaggccgcgauuaaccagaucaaugguaaacucaaccgccugaucgagaagaccaaugaaaaguuucaucaaauugagaaagaguucagcgaagucgaagggagaauccaggacuuagagaaguacguggaggauacaaaaauugaccuguggucauauaacgccgaacuccuuguugcacuggagaaucagcacacuauagauuugaccgacagugaaaugaacaagcuauucgagaggacacggaaacagcugcgagaaaacgcugaggauaugggcaauggaugcuuuaagaucuaccauaagugugacaacgugugcauuggcuccauccgcaaugggacuuacgaccacgaugucuauagagacgaggcccucaacaauagguuccaaaucaaaggaguggaacuuaagagcgguuacaaagauuggauucuuuggauaucuuuugcuaucucaugcuuccuguuguguguaguucuccugggcuuuauuaugugggccugccagaaggggaacauccgguguaauauuugcaucuga

SEQ ID NO: 130533 - RNA, 1701 nt, Artificial Sequence
  derived and/or modified sequence opt3 from hemagglutinin__InfluenzaA__AFG72735
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacacaggauucucgauggcaaaaauuguacccugaucgacgcccuucugggggauccgcauugcgacggauuuaagaacaaagagugggauuuguucguggaacgguccacugcuuauucuaauuguuaccccuaugacgucccugauuacgcaucgcuccgcucacugguggccagcaguggcacacuggaguuuaccaacgaagguuucaauuggacggggguugcucaggacggaacuuccuaugcaugcaagcgaggcucugucaagagcuuuuucucccgucucaacugguuacacaaacuggaguacaaguauccagcccuuaccgugacaaugcccaauaacgauaaauuugacaaguuguacauauggggcgugcaucacccuucaacugauagugaccagaccagcaucuacguacaggcuucugggagaguuacaguguccaccaaaaggucacaacagacggucauuccaaauaucggaagccggcccugggugcgcggugugaguucuagaauuuccaucuauuggacuauagucaagccuggcgacauucugcuaaucaacagcacagggaaucucauugccccaaggggauacuucaagauccggucgggcaaaucuuccaucaugcgcucagaugcgccgauugacaacuguaacagugagugcauaacccccaaugguagcaucccuaacgauaagccauuucagaauguuaaccgaauuacuuauggggcaugucccagauacgugaaacaaaauacacugaaacuugccaccggaaugaggaacguaccugaaaagcagacgcggggcaucuucggcgcuauagccggguuuauugagaauggaugggaagguaugguggacggcugguauggguuccgucaccagaacuccgagggaaccggccaggcagcugaucugaagucuacacaagccgcgaucaaucagaucaacgguaaauugaaucgccucauugagaagacuaacgaaaaguuucaucagaucgagaaagaguucagcgaagucgaagggaggauucaagaccuggagaaguacguggaggauaccaaaauagacaucuggucauauaaugccgaauuacugguugcacucgagaaccagcacacaauugaucuuacugacagugaaaugaauaagcuguucgagagaacccggaaacaguugcgagaaaacgcugaggauaugggcaacggaugcuuuaagaucuaccauaagugugacaaugccugcaucggcuccauucgcaacgggacauacgaccacgauguguauagagacgaggcucuaaauaacagguuccagauaaaaggagucgaacuaaagagcgguuacaaagauuggauccucuggauuucuuuugccaucucaugcuuccugcuuugugugguacuguugggcuuuauuaugugggcaugccaaaaggggaauauccgguguaacauaugcaucuga

SEQ ID NO: 130534 - RNA, 1701 nt, Artificial Sequence
  derived and/or modified sequence opt3 from hemagglutinin__InfluenzaA__AFG72757
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuuaugcaugcaaacgaagcuccaucaagucauuuuucagucgucugaacuggcuccaccaauuaaaguacaaauauccagcccugaaugugacgaugcccaacaaugacaaguuugauaaacuuuacauuuggggaguccaucacccuagcacugacucugaucagaccuccaucuacgcucaggccucaggcagagugacaguaagcacuaagaggagucagcaaaccguuauuccaaacaucggcucucggcccugggugcgcgggauauccagcagaauuucgauccacuggacaauugucaaaccuggagacaucuugcugaucaacucuaccgguaaucuaauugcgccaaggggcuauuucaagauacgguccgggaagucaaguaucaugcgcagcgacgcaccgauuggaaaauguaacuccgagugcaucacgcccaauggcucuauaccuaacgauaagccauuucagaaugugaaccgaauuacuuacggugccugucccagauaugugaaacagaauacacucaagcuggcuaccgggaugaggaacgucccugaaaaacagacucggggaaucuucggcgccaucgcaggcuuuauugagaaugggugggaaggaaugguugacgguugguacggcuuccgucaucaaaacagcgaggggacaggacaggcugccgaucuuaagucaacccaggcggccaucaaucaaauuaacggcaaacugaaucgcuugauagagaagacgaacgaaaaguuucaccagaucgagaaagaguucagugaaguggaagguaggauucaggaccucgagaaguauguagaggauaccaaaaucgaccugugguccuacaaugcagaauuacugguggcucucgagaaccagcauacaaucgaucuuacugacagcgaaaugaacaagcuguucgagagaacccggaaacaauugcgagaaaaugccgaggauauggggaacggcugcuuuaagauuuaucacaagugugacaaugcuugcauaggaucuauccgcaacggcacauacgaucacgacgucuacagagacgaggcccuaaauaacagguuccagauuaaagggguggaacugaagucaggauauaaagauuggauccucuggauuaguuuugcaaucagcugcuuccugcuuuguguugugcuguuggguuuuauaaugugggccugccagaagggcaauauccgguguaacauuugcaucuga

SEQ ID NO: 130535 - RNA, 1701 nt, Artificial Sequence
  derived and/or modified sequence opt3 from hemagglutinin__InfluenzaA__AFG72779
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucagaaugggaccucuagcgcaugcaaacgacguuccauaaagucauuuuucaguagacucaacugguuacaccaacugaaguauaaauacccagcccuuaaugugacgaugcccaacaaugacaaguuugauaaauuguauaucuggggaguccaucacccuagcacugacucugaucagaccucccuguacgcucaggccucaggcagggugacaguaagcacucggcgcagucagcaaaccguuauuccaaacaucggcucuagacccugggugaggggagucuccagcgggauuucgaucuacuggacaauagugaagccuggugacauucuacucaucaacucuaccggcaaucugauugcgccacggggguauuucaaaauccgcuccggaaagucaaguaucaugcgaagcgacgcaccgauuggcaaguguaacuccgagugcauaacgcccaaugguucuaucccuaacgauaaaccauuucagaaugugaacagaauuacuuacggggccugucccagguaugucaagcagaauacacuuaaacuggcuaccggaaugcggaacguuccugaaaagcagacucguggcaucuucggcgccauagcaggguuuauugagaauggaugggaagguaugguggacggcugguacggguuccgccaccaaaacagcgagggaacaggccaggcugccgauuugaaaucaacccaggcggccaucaaucaaaucaacgguaagcucaauagacugauugagaaaacgaacgaaaaguuucaucagaucgagaaggaguucagugaaguagaagggaggauucaggacuuagagaaauauguggaggauaccaagauagaccugugguccuacaaugcagaacuccuugucgcucuggagaaccagcacacaaucgauuugacugacagcgaaaugaacaaacuauucgagcggacccgaaagcaacugcgcgaaaaugccgaggauaugggcaacggaugcuuuaaaauuuaucauaagugugacaaugcuugcaucggcucuaucagaaacgggacauacgaucacgacguguacagggacgaggcccucaauaaccgguuccagauuaagggaguugaacugaaaucagguuauaaggauuggauacuuuggaucaguuuugcaauuagcugcuuccuguugugugugguccuccugggcuuuaucaugugggccugccagaaagggaauauucgcuguaacaucugcauauga

SEQ ID NO: 130536 - RNA, 1701 nt, Artificial Sequence
  derived and/or modified sequence opt3 from hemagglutinin__InfluenzaA__AFG72801
augaagaccaucauugcccugagcuacauacucugccuuguguucgcucagaaacugcccggcaacgacaauuccacagcaacuuuguguuuagggcaccaugccgucucuaacggaacgcugguuaagaccaucacaaaugaucaaauugaggugacuaacgcgaccgaacugguacagucaaguagcacagguagaaucugcgacuccccucaccagauucucgauggcgagaauuguacccugaucgacgcccuucugggggauccacauugcgacggauuucagaacaaagaaugggauuuguucguggagaggucuaaggcuuauucgaauuguuacccguaugacguccccgauuacgcaucacuccggagccugguggccaguuccggcacucuggaauuuaacaaugagucuuucaacuggacagguguugcucaaaaugggaccagcuccgcaugcaaacgccgaucaaacaaguccuuuuucagccgucucaauugguuacaccagcugaaguauaaauacccugcccuuaacgugacgaugccaaauaacgagaaguuugacaaauuguauauauggggaguccaucaccccucuacugauuccgaccagaucucaauuuacgcucagagcaguggcagagugaccguaucuacaaagaggucccaacagacuguuaucccuaacauuggcagcucgccaugggugcgcggggucucuucccggaucucaauauacuggaccauugugaaacccggagauauccugcuaauuaauaguacagguaaccucaucgccccuagaggcuauuucaagaucaggagcgggaaguccucuauuaugcggagcgacgcgccaauaggaaaauguaauucagaaugcaucaccccgaacggcaguauucccaaugacaagccuuuucagaacgugaaucgcaucacguacggugcauguccacgauaugucaaacagaacacucugaaacuugccacagggaugagaaauguucccgagaagcaaaccaggggaauauucggcgcuauugccggcuuuaucgaaaacgggugggagggaaugguggaugguugguacggcuuccggcaccagaauagugaggggacuggacaggcagcugaccuaaagagcacacaagccgcgaucaaccagauuaauggcaaauugaaccgucucaucgaaaagaccaaugagaaguuucaucagauugaaaaagaguucucugaaguagagggucgcauacaggaucuggagaaguauguggaagacacgaaaaucgauuuauggucauacaacgccgagcugcucgucgcacuugaaaaccaacacaccauugaccugacagauagugagaugaauaaguuguucgaaagaacuaaaaagcagcuaagggagaacgcugaggacauggggaauggcugcuuuaagaucuaucauaaaugugauaacgccugcaucggaagcauucggaauggcaccuacgaccacgauguguaccgagacgaagcucugaacaaucgcuuccagauaaaggggguugagcucaaauccggauauaaggacuggauccuguggauuucuuuugccaucucgugcuuccuucuguguguggucuugcucgguuuuauuaugugggcaugccagaaaggcaacaucagauguaauauaugcaucuga

SEQ ID NO: 130537 - RNA, 1701 nt, Artificial Sequence
  derived and/or modified sequence opt3 from hemagglutinin__InfluenzaA__AFG72812
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccaacaagucauuuuucagucgucucaauugguuacaccagcugaaguauaaauacccagcacuuaacgucacgaugcccaauaacgagaaguuugacaaauuguauauauggggagugcaucacccuggcacugauagcgaccagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugauauucuacucaucaauucgacaggcaaccugauugccccaaggggguauuucaagauccggucuggaaaguccucaaucaugcgcagugacgcgccgauuggcaaauguaauagcgaaugcauaacccccaacgguuccaucccuaaugacaagccauuucagaacgucaaucgaauuacguacggggcaugucccagauauguuaaacagaacacucuuaagcuggccacaggaaugaggaaugugccugagaaacaaacccggggcaucuucggcgcuauagccggguuuauugaaaacggaugggaggguaugauggauggcugguacggguuccgucaccuaaauucugagggaacuggccaggcagcugaccucaagagcacacaggccgcgaucaaccaaaucaaugguaaacugaaccgcuuaauugaaaagaccaaugagaaguuucaucagaucgaaaaagaguucucagaaguagaggggaggauucaggaucuggagaaguauguggaagacacgaaaauagaucucuggaguuacaacgccgagcuucuggucgcauuggaaaaccagcacaccaucgaccuaacagauuccgagaugaauaagcuguucgaaagaacuaaaaagcaacuccgggagaacgcugaggacaugggcaauggaugcuuuaagauuuaucauaaaugugauaacgccugcaucggcagcauccgaaaugggaccuacgaccacgauguguaccgcgacgaagcucugaacaauagauuccagauuaagggaguugagcuuaaaucugguuauaaggacuggauacuguggaucucauuugccauuaguugcuucuugcucuguaucgugcuguuaggcuuuauuaugugggcaugccagaaagggaacaucagguguaauauaugcaucuga

SEQ ID NO: 130538 - RNA, 1701 nt, Artificial Sequence
  derived and/or modified sequence opt3 from hemagglutinin__InfluenzaA__AFG72823
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcgucuugcacccuggcacagauagcgaccagauuucucuguacgcccaggcuuccgggcguaucacugugucaaccaagagaagccaacagacaguaauuccaaacaucggaaguaggccccggguucgcggugugucuuccagaauaagcauuuacuggaccaucgucaagccuggcgauauucuacucaucaauucgacggggaaccugaucgccccaaggggauauuucaagauucggucuggcaaauccucaauaaugcgcagugacgcgccgaucgguaaguguaauagcgagugcauuacucccaacggguccaucccuaaugacaaaccauuucagaacgugaaucgaauaacauacggagcaugucccagauauauuaagcagaacacccuuaaacuggccacuggcaugaggaaugugccugaaaagcaaacacggggcaucuucggggcuaucgccggauuuauugagaacgguugggaaggcauggucgaugggugguacggauuccgucaucaaaauucugagggcaccggucaggcagcugacuugaaaagcacgcaggccgcgaucaaccagauuaaugggaagcucaaccgccugauaggcaagaccaaugagaaauuucaccagaucgaaaaggaguucucagaaguugagggaaggauucaggauuuagaaaaauauguggaggacacaaagaucgaucuguggaguuacaacgccgagcuccuuguagcacuggaaaaccaacacacuaucgacuugaccgauuccgagaugaauaaacuauucgaaagaacaaagaagcagcugcgggagaacgcugaagacaugggcaaugggugcuuuaaaauuuaucauaagugugauaacgccugcauaggaagcauccgaaaugguacuuacgaccacgauguguaccgcgacgaggcucucaacaauagauuccagauuaaaggcgucgagcugaagucuggguauaaagacuggauccuuuggauuucauuugccaucaguugcuuccuguuguguguggcacuccugggauuuauaaugugggccugccagaagggcaacaucagguguaauauuugcaucuga

SEQ ID NO: 130539 - RNA, 1701 nt, Artificial Sequence
  derived and/or modified sequence opt3 from hemagglutinin__InfluenzaA__AFG72834
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccaacaagucauuuuucagucgucucaauugguuacaccagcugaaguauaaauacccagcacuuaacgucacgaugcccaauaacgagaaguuugacaaauuguauauauggggagugcaucacccuggcacugauagcgaccagaucucucuguacgcccaggcuuccggcagaguaaccguuucaacaaagaggagccaacagacugugauuccaaacaucgggagucggcccuggguccgcggagugucuuccagaauuagcaucuacuggaccauagugaaaccuggugauauucuacucaucaauucgacaggcaaccugauugccccaaggggguauuucaagauccagucuggaaaguccucaaucaugcggagugacgcgccgauuggcaaauguaauagcgaaugcauaacccccaacgguuccaucccuaaugacaagccauuucagaacgucaaucgcauuacguacggggcauguccccgauauguuaaacaaaacacucuuaagcuggccacaggaaugagaaaugugccugagaaacagaccaggggcaucuucggcgcuauagccggguuuauugaaaacggaugggaggguaugauggauggcugguacggguuccggcaccagaauagcgagggaacuggccaagcagcugacuugaagucuacacaggccgcgaucaaccagaucaaugguaaacucaaccgucugauugaaaagaccaaugagaaguuucaucagaucgaaaaagaguucucagaaguagaggggcgcauucaagauuuagagaaguauguggaagacacgaaaauagaucuguggaguuacaacgccgagcuccuugucgcacuggaaaaccagcacaccaucgacuugacagauuccgagaugaauaagcuauucgaaagaacuaaaaagcagcugagggagaacgcugaggacaugggcaauggaugcuuuaagauuuaucauaaaugugauaacgccugcaucggcagcauccggaaugggaccuacgaccacgauguguaccgagacgaagcucucaacaaucgcuuccagauuaagggaguugagcugaaaucugguuauaaggacuggauacuuuggaucucauuugccauuaguugcuuccuguuguguaucgugcuccugggcuuuauuaugugggcaugccaaaaagggaacaucagauguaauauaugcaucuga

SEQ ID NO: 130540 - RNA, 1701 nt, Artificial Sequence
  derived and/or modified sequence opt3 from hemagglutinin__InfluenzaA__AFG72845
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacaagcagaaucugcgacuccccacaccagauucucgauggugagaauuguacccugaucgacgcucuacugggcgauccgcauugcgacggguuucagaacaaagaaugggauuuguucguggagaggucuaaggccuauucgaauuguuaccccuaugacgucccugauuacgugucacuccggagccugguugcaaguuccggaacucuggaauuuaacaaugagucuuucaacuggacaggcguggcccaaaaugguaccagcuccgcuugcaaacgccgaucagacaagagcuuuuucagucgucucaacugguuacaccagcugagauauaaguacccagcacuuaaugucacgaugcccaacaaugagaaauuugauaaguuguauauauggggagugcaucacccugggacugacucugaucagaucucccuguacgcccaggcuucaggcaggguaaccauuagcacaaaacggagucaacagacuguuaucccaaacauuggcucucgccccugggugagaggggucuccagcaggaucucgauacacuggaccauugugaagccuggagacauccuacucauuaacucuacagguaaucugaucgccccacggggcuacuucaaaauccgcuccgggaagucaaguauuaugcgaagcgacgcgccgauaggaaaguguaacuccgaaugcaucacccccaauggcucuauuccuaacgauaaaccauuucagaaugugaacagaaucacguauggugcaugucccagguacgucaagcagaaaacucuuaagcuggccacagggaugcggaauguuccugagaaacaaacccguggaauauucggcgcuauugccggcuuuaucgaaaacgggugggagggaaugauggacgguugguauggcuuccgccaucagaauagcgaggggacuggacaggcagcugauuugaagucaacacaagccgcgaucaaccagauuaauggcaaacucaacagacugaucgaaaagaccaaugagaaguuucaccagauugaaaaagaguucagugaaguggaggguaggauacaggacuuagagaaguacguagaagauacgaaaaucgaccugugguccuauaacgccgagcuccuuguggcacuggaaaaucaacauaccauugauuugacagacagcgagaugaacaagcuauucgaacggacuaaaaagcagcugcgagagaacgcugaggauauggggaauggcugcuuuaagaucuaccacaaaugugacaacgccugcaucggaucuauucgcaauggcaccuaugaucacgacgucuacagagacgaagcucucaacaauagguuccagauaaaggggguggagcugaaaucaggauacaaggauuggauccuuuggauuaguuuugccaucagcugcuuccuguuguguauuguucuccuggguuuuaucaugugggcaugccagaaaggcaacauacgguguaauaucugcauuuga

SEQ ID NO: 130541 - RNA, 1701 nt, Artificial Sequence
  derived and/or modified sequence opt3 from hemagglutinin__InfluenzaA__AFG72856
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucaucgccagcagugguacucuggaguuuacaaacgaauccuucaauuggaccggggugacgcagaacggaacuucuagcgcuugcaagcggcgcuccaauaagucauuuuucagucgacugaacuggcucacccauuuaaaauauaaguacccagcacugaauguuacaaugcccaacaaugagaaauuugacaaacuuuauauuuggggcgugcaccauccuggcacugauagcgaccagaucucuuuguacgcccaggcuuccgggcguauuaccgucucaacaaagagaagccaacagaccgugaucccaaacauaggaaguaggccccggguacgcgauauuucuuccagaaucagcauuuacuggacgaucguuaagccuggugacauccugcuaauuaacucgacuggcaaucucauagccccaaggggguauuucaagauccggucuggaaaauccucaauuaugcgcagugacgcgccgaucggcaaguguaacagcgagugcauaacacccaaugguuccauuccuaacgauaaaccauuucagaaugugaaccgaaucaccuacggggcaugucccagauaugucaagcagaauacucugaaacuugccacaggaaugaggaacgugccugaaaagcaaacccggggcaucuucggcgcuauugccggguuuaucgagaauggaugggaagguaugguggacggcugguacggguuccgucaccagaacucugagggaacgggccaggcagcugaucugaaaagcacccaagccgcgauuaaucagauaaacgguaaguugaauaagcucaucgggaaaacaaacgagaaguuucaccagauugaaaaagaguucucagaagucgagggccgcauccaggaccuggaaaaguauguugaggauacuaaaaucgacuuauggaguuacaaugccgagcugcucguggcacuugaaaaccaacauaccauugaucugacagacuccgagaugaacaaguuguucgaaagaacuaagaaacagcuaagggagaaugcugaagauaugggaaacggcugcuuuaagauauaucacaaaugugacaaugccugcaucgggagcauucggaacggaaccuacgaucaugacguauaccgagacgaggcucugaauaaccgcuuccagaucaaggguguggagcucaaaucuggcuauaaggauuggauucuguggaucucauuugccauaaguugcuuccuucugugugucguguugcucggguuuaucaugugggcaugccagaagggaaauauuagauguaacaucugcauuuga

SEQ ID NO: 130542 - RNA, 1701 nt, Artificial Sequence
  derived and/or modified sequence opt3 from hemagglutinin__InfluenzaA__AFG72867
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccaacaagucauuuuucagucgucucaauugguuacaccagcugaagaacaaauauccagcacuuaaugucacgaugcccaacaacgagaaguuugacaaauuguacauauggggagugcaucacccuggcacugauagcgaccagaucucucuguaugcccaggcuuccggcagaguaaccguuucaacaaagaggagccaacagacugugauuccaaauaucgggagucggccccgcgucagagauauuucuuccaggaucagcauauacuggaccauugugaaaccuggagacauccuacucauuaacucgacagguaaucugaucgccccacggggcuacuucaagauccgcucugggaaguccucaauuaugcgaagugacgcgccgauaggaaaauguaacagcgaaugcaucacccccaauggcuccauuccuaacgauaagccauuucagaaugugaacagaaucacguauggugcaugucccagguacgucaaacagaauacucuuaagcuggccacagggaugcggaacguuccugagaaacaaacccguggaauauucggcgcuauugccggcuuuaucgaaaaugggugggagggaaugauggacgguugguauggcuuccgccaccagaacucugaggggacuggacaggcagcugaucuaaagagcacacaagccgcgaucaaucagauuaacggcaaacucaauagacugaucgaaaagaccaacgagaaguuucaucagauugaaaaagaguucucagaaguggaggguaggauacaggacuuagagaaguacguagaagauacgaaaaucgaccuguggaguuauaacgccgagcuccuuguggcacuggaaaaucaacacaccauugauuugacagacuccgagaugaacaagcuauucgaacggacuaaaaagcagcugcgagagaaugcugaggauauggggaacggcugcuuuaagaucuaccauaaaugugacaaugccugcaucggaagcauucgcaacggcaccuaugaucacgacgucuacagagacgaagcucucaauaacagguuccagauaaaggggguggagcugaaaucuggauacaaggauuggauccuuuggauuucauuugccaucaguugcuuccuguuguguauuguucuccuggguuuuaucaugugggcaugccagaaaggcaauauacgguguaacaucugcauuuga

SEQ ID NO: 130543 - RNA, 1701 nt, Artificial Sequence
  derived and/or modified sequence opt3 from hemagglutinin__InfluenzaA__AFG72922
augaagaccaucauugcccugagcuacauacucugccuuguguucgcucagaaacugcccggcgacgauaacuccacagcaacuuuguguuuagggcaccaugccgucccuaauggaacgaucguuaagaccauuacaaacgaccaaaucgaggugacuaaugcgaccgaacugguacagucuucaaguacaggugagauuugcgauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcuccugcauccggaagucaaauaacagcuuuuucagucgccugaauuggcucacucauuuaaaguuuaaauauccagcucugaacgugaccaugcccaauaacgagcaguucgauaaacuuuacauuuggggaguccaccauccuggcacagacaacgaucagaucuuuuuguaugcacaagccucuggccgaauuacuguguccaccaagcguucacagcagacaguaaucccaaauauagggagcagacccaggguucggaacauuccuagucgcaucucuauuuacuggaccaucgugaagccaggagacauccugcuaauuaauuccacggguaaccucauagcuccgagaggcuacuucaaaaucaggagcgggaagucgucuauuaugcgguccgacgcccccaucggaaaguguaauucagaaugcauaacuccuaacggcaguauuccaaaugauaaacccuuucagaacgucaaucgcaucacauauggugcguguccucgauacgugaagcaaaacacccugaaacuugcaacugggaugagaaaugugccagagaagcagacaaggggaaucuucggcgccauugcuggcuuuaucgaaaacgggugggagggaauggucgacgguugguauggcuuccggcaccagaauagcgaggggcguggacaagccgcagaucugaaauccacccaggcugccauugaccagauaaacggcaaguugaaucgccucaucgguaaaacgaacgaaaaguuccaccagauugagaaggaauuuucugagguugaagggagaauccaagaucuggagaaauacguggaggacaccaagaucgauuuauggagcuauaacgcggaacugcucguagcccuugagaaucagcauacaauugaccugacugauucagaaaugaacaaauuguucgagaagaccaaaaagcagcuaagggaaaaugcagaggacaugggcaacggaugcuuuaagauauaccacaaaugugauaaugcuugcaucggcaguauucggaacgggacauaugaccaugacguguaccgagaugaggcccugaauaaccgcuuccagaucaagggagucgaacucaaauccgguuacaaggacuggauucuguggaucagcuuugcuauaucuugcuuccuucuguguguggccuugcucggcuuuaucaugugggcaugccaaaaagggaauauuagauguaacaucugcauuuga

SEQ ID NO: 130544 - RNA, 1701 nt, Artificial Sequence
  derived and/or modified sequence opt3 from hemagglutinin__InfluenzaA__AFG72933
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcgugcggcgcuccaacaauucauuuuucagucgacugaacuggcucacucauuuaaaguuuaaguauccagcacugaaugucaccaugcccaacaacgagcaguucgacaaacuuuacaucuggggagugcaccauccuggcacagauaaugaccagaucuuuuuguaugcccaagcuagcggccguauuacuguaucuaccaagagaucccagcagacaguuauuccaaacaucgggucaaggccccgggugcgcaauauaccuagcagaauuaguaucuacuggaccauugucaaaccaggagauauccugcuaaucaacucuacggguaaucucauugccccgaggggcuacuucaagauacgguccgggaaaagcucgaucaugcgcucugacgcgcccauuggaaaguguaacuccgaaugcaucacuccuaauggcucaauaccaaacgacaagcccuuucagaaugugaaccgaauuacauauggugcauguccuagauacgugaaacaaaauacccugaagcuggccacugggaugaggaacgucccagagaaacagacacggggaaucuucggcgcuaucgccggcuuuauugaaaaugggugggagggaaugguugaugguugguauggcuuccgucaccagaacagugaggggcgcggacaagcagcugaccuuaagagcacccaggccgcgaucgaucagauuaauggcaaauugaacagacucauagguaagacgaacgaaaaauuccaccagaucgagaaggaauuuuccgagguggaagggaggauucaagaccuggagaaguacguagaggauaccaaaaucgacuuauggucuuauaaugccgaacugcucguggcacuugagaaccagcauacaaucgaucugacugacagcgaaaugaauaaguuguucgagaaaaccaagaaacagcuacgggaaaacgcugaggauaugggcaauggaugcuuuaagauuuaccacaagugugacaacgccugcauaggcucaauccgaaaugggacauaugaucaugacgucuaccgcgacgaggcucugaacaauagauuccagauuaaaggaguggaacucaagagugguuacaaagauuggauccuguggauuuccuuugccaucagcugcuuccuucuguguguugcauugcucggcuuuauaaugugggccugccaaaaggggaacaucagguguaauauuugcaucuga

SEQ ID NO: 130545 - RNA, 1701 nt, Artificial Sequence
  derived and/or modified sequence opt3 from hemagglutinin__InfluenzaA__AFG72955
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccaacaauucauuuuucagucgacugaacuggcucacucauuuacguuuuaaguauccagcacugaauguuaccaugcccaacaacgagcaguucgacaaguuguacaucuggggagugcaccauccuggcacagauaaugaccagauuuuucuuuaugcccaagcuagcggcagaaucacugucucuaccaaaaggucccagcagacagugauaccaaacauugggucacggccccgcguaagaaauaucccuagcaggauuaguaucuacuggaccaucguuaagccaggagauauucugcuaauaaacucuacggguaaucucaucgccccgcggggcuacuucaaaauucgcuccggaaagagcucgaucaugcgaucugacgcgcccauagggaaauguaacuccgaaugcauuacuccuaauggcucaaucccaaacgacaagcccuuucagaaugugaacagaaucacauauggugcauguccuagguacgucaagcaaaauacccugaaacuugccacugggaugcggaacgugccagagaagcagacacguggaauuuucggcgcuaucgccggcuuuauugaaaaugggugggagggaaugguggaugguugguauggcuuccgccaccagaacagugaggggagaggacaagcagcugaccugaaaagcacccaggccgcgauagaucagaucaauggcaaguugaacaggcucauugguaaaacgaacgaaaaguuccaccagaucgagaaagaauuuuccgaggucgaagggcggauccaagaccuggagaaguacguugaggauaccaagauugacuuauggucuuauaaugccgaacugcucguggcacuugagaaccagcauacaauagaucugacugacagcgaaaugaauaaauuguucgagaagaccaaaaagcagcuacgagaaaacgcugaggauaugggcaauggaugcuuuaaaaucuaccacaagugugacaacgccugcauuggcucaauccgcaaugggacauaugaucaugacguauacagagacgaggcucugaacaauagguuccagauuaagggaguggaacucaaaagugguuacaaggauuggauccuguggauauccuuugccaucagcugcuuccuucugugugucgcauugcucggcuuuauuaugugggccugccaaaaagggaacauccgguguaauauuugcaucuga

SEQ ID NO: 130546 - RNA, 1701 nt, Artificial Sequence; identical to SEQ ID NO: 123656
  derived and/or modified sequence opt3 from hemagglutinin__InfluenzaA__AFG98808

SEQ ID NO: 130547 - RNA, 1701 nt, Artificial Sequence; identical to SEQ ID NO: 123656
  derived and/or modified sequence opt3 from hemagglutinin__InfluenzaA__AFG98819

SEQ ID NO: 130548 - RNA, 1701 nt, Artificial Sequence
  derived and/or modified sequence opt3 from hemagglutinin__InfluenzaA__AFG98830
augaagaccaucauugcccugagcuacauauucugccucgugcuuggccaggaccugcccgggaacgauaaauccacagcuacuuuguguuuaggacaccaugcagucccuaaugguacgcugguuaagaccaucacaaacgaccaaauugaggugacuaaugccaccgaacuuguacagucuucaaguacaggcaaaaucugcaacaauccacacaggauucucgaugggaucgacuguacccugauagaugcgcuucugggagacccgcauugcgauggcuuucagaacgagacuugggacuuguucguggaaagaagcaaggcuuuuuccaauuguuaucccuacgaugucccugacuaugccucucuccggucgcugguggcaucaagcgguacacuggaguucaucaccgaaggguuuacguggacuggaguuacccagaacggcggcaguuccgccugcaaacgcgggccaggaucugguuucuuuagccgacucaauugguuaacaaaguccggcucaacuuaccccgugcugaacgucaccaugccuaauaacgauaauuucgacaagcuauauauuuggggagugcaccauccaaguacaaaccaagagcagaccagcuuguacguacaggcuucugggcguguuacgguguccacuagaaggucacagcaaacaaucauucccaauaucggcagccggccuuggguccgcggucugaguucuagaauauccauuuauuggaccaucgugaaaccaggggauauucuaaucaucaacagcaacggaaaucucauugcaccgaggggcuacuuuaagaugcggacuggcaaaucgucuauaaugcgcuccgacgcccccaucgacacauguauuucagagugcaucaccccuaacgggaguauaccaaaugauaagcccuuccagaacgugaauaaaauuacguacggagcuuguccuaaguaugucaagcagaacacccugaaacuugccacagguaugcgaaauguuccagaaaagcagacuagaggccuguuuggggcgaucgcaggauucaucgagaacggcugggaagguaugauugacgggugguacggcuuuaggcaccaaaauagcgagggaaccggccaggccgcugauuugaaauccacacaggccgcaaucgaccaaauuaacgggaagcucaaucgggugauagagaaaacuaacgaaaaguuccaccagaucgagaaagaguucucugaaguagaaggacguauucaggaucuggagaaguauguggaggacaccaagaucgauuuauggagcuacaaugcugaacugcucgucgcccuugagaaccagcauacaaucgaccugaccgauucagaaaugaauaaauuguuugagaagacucgcagacaacuaagggaaaacgcggaggacauggguaacggcugcuucaaaauuuaucacaagugugauaaugccugcauagggaguauccggaacggaacguacgaccaugacguguaucgagaugaggcacugaauaaccgcuuucagauuaaaggcguugaacucaaguccgguuacaaggacuggauccuguggauuagcuucgcuaucucuugcuuucuucuguguguggucuugcucggguucauaaugugggccugccagaaaggcaauaucagauguaacauuugcaucuga

SEQ ID NO: 130549 - RNA, 1701 nt, Artificial Sequence
  derived and/or modified sequence opt3 from hemagglutinin__InfluenzaA__AFG98841
augaagaccaucauugcccugagcuacauauucugccucgugcuuggccaggaccugcccgggaacgauaaauccacagcuacuuuguguuuaggacaccaugcagucccuaaugguacgcugguuaagaccaucacaaacgaccaaauugaggugacuaaugccaccgaacuuguacagucuucaaguacaggcaaaaucugcaacaauccacacaggauucucgaugggaucgacuguacccugauagaugcgcuucugggagacccgcauugcgauggcuuucagaacgagacuugggacuuguucguggaaagaagcaaggcuuuuuccaauuguuaucccuacgaugucccugacuaugccucucuccggucgcugguggcaucaagcgguacacuggaguucaucaccgaaggguuuacguggacuggaguuacccagaacggcggcaguaaugccugcaaacgcgggccaggauccgguuucuuuucucgacucaacugguuaacaaagagcggcuccacuuaccccgugcugaaugucaccaugccuaacaaugauaacuucgacaagcuauauauuuggggagugcaccauccaucaacaaaucaagagcagaccaguuuguacguacaggcuagcgggcguguuacggugucuacuagaaggucccagcaaacaaucauucccaacaucggcucacggccuuggguccgcggucugagcaguagaauaucuauuuauuggaccaucgugaaaccaggggauauucuaaucaucaacuccaauggaaaccucauugcaccgaggggcuacuuuaagaugcggacuggcaaaagcucgauaaugcgcucugacgcccccaucgggacauguauuuccgagugcaucaccccuaauggaucaauaccaaacgacaagcccuuccagaaugugaacaaaauuacguacggugcuuguccuaaguaugucaagcagaauacccugaaacuugccacaggcaugcgaaacguuccagaaaagcagacuagagggcuguuuggagcgaucgcaggcuucaucgagaaugguugggaagggaugauugauggcugguacggauuuaggcaccaaaacagugagggcaccgggcaggccgcugacuugaaaagcacacaggccgcaaucgaucaaauuaauggaaagcucaaccgggugauagagaaaacuaaugaaaaguuccaccagaucgagaaagaguucuccgaaguagaaggucguauucaggaccuggagaaguauguggaggauaccaagaucgacuuauggucuuacaacgcugaacugcucgucgcccuugagaaucagcauacaaucgaucugaccgacagcgaaaugaacaaauuguuugagaagacucgcagacaacuaagggaaaacgcggaggauaugggcaaugggugcuucaaaauuuaucacaagugugacaacgccugcauaggaucaauccggaauggcacguacgaucaugacguguaucgagacgaggcacugaacaaucgcuuucagauuaaagguguugaacucaagaguggguacaaggauuggauccuguggauuuccuucgcuaucagcugcuuucuucuguguguggucuugcucggcuucauaaugugggccugccagaaaggaaacaucagauguaauauuugcaucuga

SEQ ID NO: 130550 - RNA, 1701 nt, Artificial Sequence; identical to SEQ ID NO: 122321
  derived and/or modified sequence opt3 from hemagglutinin__InfluenzaA__AFG98852

SEQ ID NO: 130551 - RNA, 1701 nt, Artificial Sequence
  derived and/or modified sequence opt3 from hemagglutinin__InfluenzaA__AFG98863
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgagcuaguacagucuucaaguacaggcaagaucugcaauaacccacacaggauucucgaugggaucgacuguacccugauagaugcgcuucugggagacccgcauugcgauggcuuucagaaugaaacuugggacuuguucguggaaagaagcaaggcuuuuuccaacuguuaucccuacgaugucccugacuaugccucucuccggucgcugguggcaucaagcgguacacuggaguucaucaaugaaggguuuaccuggacgggaguuacucagaacggcggcaguuccgccugcaagcgcgggccagauucuggauucuuuagccgacucaauugguuauacaaauccgguucaaccuaucccgugcugaacgucacaaugccuaauaacgacaauuucgauaaacuuuacauuuggggcgugcaccauccaaguacuaaccaagagcagaccagcuuguauguacaggcuucugggcguguuacaguguccaccaagagaucacagcaaacgaucauucccaacaucggaagcaggccuuggguccggggccugaguucucgcauauccauuuacuggacuaucgugaaaccaggugacauucuagugaucaauagcaacgggaaucucaucgcaccgagaggauacuuuaagaugaggacaggcaaaucgucuauuaugcgguccgacgcccccauaggcaccuguaucucagagugcauuacuccuaacgggaguaucccaaaugauaagcccuuccagaacgucaauaaaauaacauauggagcuuguccuaaguacguuaagcagaacacccugaaacuugccacggguaugcgcaaugugccagaaaagcagacccgaggccuguuuggggcgauugcaggauucaucgagaacggcugggaagguaugaucgacgggugguauggcuuuagacaccaaaauagcgagggaacaggccaggccgcugauuugaaauccacucaggccgcaauugaccaaaucaacgggaagcucaauaggguaauugagaaaaccaacgaaaaguuccaccagauagagaaagaguucucugaaguggaaggacggauccaggaucuggagaaguacgucgaggacacaaagauugauuuauggagcuauaaugcugaacugcucguggcccuugagaaccagcauacuaucgaccugaccgauucagaaaugaacaaauuguuugagaagacacgucgccaacuaagagaaaaugcggaggacauggguaacggcugcuucaggaucuaccacaaaugugauaaugccugcauugggaguauacggaacggaaccuaugaccaugacguuuaccgagaugaggcacugaauaaccgcuuucagaucaagggcguggaacucaaauccgguuacaaggacuggauucuguggaucagcuucgcuauuucuugcuuucuucugugugucguguugcucggguucaucaugugggccugccagaagggcaauauaagauguaacaucugcauuuga

SEQ ID NO: 130552 - RNA, 1701 nt, Artificial Sequence
  derived and/or modified sequence opt3 from hemagglutinin__InfluenzaA__AFG98874
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggccagauaacggauuuuucucccgacugaauuggcucuacaaaucugguagcaccuaucccguguuaaacgucacaaugccuaauaacgacaacuuugauaagcuguacauuuggggcgugcaccauccauccacugaccaagagcagaccucacuuuauguacaggcuagugggcguguuacagugagcaccaagagaucucagcaaacgaucauucccaauaucggauccaggccuuggguccggggcuugucaagccgcauaaguauuuacuggacuaucgugaaaccaggugacauucuggugaucaacucuaaugggaaccuaaucgcaccgagaggauacuucaagaugaggacaggcaaauccagcauuaugcggucggaugcccccauaggcaccuguaucucugagugcauuacuccuaauggguccaucccaaacgacaagcccuuucagaaugucaacaaaauaacauauggagcuuguccuaaguacguuaagcagaauacccucaaacuggccacggguaugcgcaacgugccagaaaagcagacccgaggccuuuucggggcgauugcaggauuuaucgagaauggcugggaagguaugaucgaugggugguauggcuucagacaccaaaacucagagggaacaggccaggccgcugaccugaaaaguacucaggccgcaauugaucaaaucaaugggaaguugaacaggguaauugagaaaaccaaugaaaaguuccaccagauagagaaagaauuuagcgagguggaaggacggauccaggaccucgagaaguacgucgaggauacaaagauugaccugugguccuauaacgcugaauuacugguggcccucgagaaccagcauacuaucgaucuuaccgacucugaaaugaauaaacuguucgagaagacacgucgccaauugagagaaaacgcggaggauauggguaauggcugcuuuaaaaucuaccacaagugugacaacgccugcauugggagcauaaggaauggaaccuaugaccaugauguuuaccgggacgaggcacuaaacaaucgauuccagaucaaaggcguggaacugaagucagguuacaaggauuggauucucuggaucaguuuugcuauuuccugcuuccugcuuugugucgugcuguugggguuuaucaugugggccugccagaaaggcaacauacgcuguaauaucugcauuuga

SEQ ID NO: 130553 - RNA, 1701 nt, Artificial Sequence
  derived and/or modified sequence opt3 from hemagglutinin__InfluenzaA__AFG98885
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucgacuguacccucauagaugcgcugcuuggagacccgcauugcgauggcuuccagaaugagacuugggaccuguuuguggaaagaagcaaggcuuucuccaacuguuaucccuacgaugucccugacuaugccucuuugcggucgcucguggcaucaagcgguacacuggaguuuaucaaugaaggguucaccuggacgggaguuacucagaacggcggcaguaaugccugcaaacgcgggaccgauuccggauuuuucucucgacugaacuggcucuacaaaagcgguuccacauauccaguguuaaaugucacuaugcccaacaaugacaacuuugauaagcuguacauuuggggcgugcaccauccuucaaccgaccaagagcagacaagucuuuauguacaggcuagcgggcguguuaccgugucuacgaagagaucccagcaaacuaucauuccaaacaucggaucaaggcccuggguccggggcuugagcagucgcauaucuauuuacuggacaaucgugaaaccuggugacauucuggugaucaauuccaacgggaaucuaaucgcaccaagaggauacuucaagaugaggaccggcaaaagcucgauuaugcggucugaugccccgauaggcacuuguaucuccgagugcauuacacccaacgggucaaucccuaaugacaagccauuucagaacgucaauaaaauaaccuauggagcuugucccaaguacguuaagcagaacacgcucaaacuggccaccgguaugcgcaaugugccugaaaagcagacacgaggccuuuucggggcgauugcaggauuuaucgagaacggcugggaagguaugaucgaugggugguauggcuucagacaccaaaauagugagggaacuggccaggccgcugaccugaaaagcacccaggccgcaauugaucaaaucaacgggaaguugaauaggguaauugagaaaacaaacgaaaaguuccaccagauagagaaagaauuuuccgagguggaaggacggauccaggaccucgagaaguacgucgaggauacuaagauugaccuguggucuuauaaugcugaauuacugguggcccucgagaaccagcauaccaucgaucuuacagacagcgaaaugaacaaacuguucgagaagacccgucgccaauugagagaaaaugcggaggauauggguaacggcugcuuuaaaaucuaccacaagugugacaaugccugcauugggucaauaaggaacggaacuuaugaccaugauguuuaccgggacgaggcacuaaauaaccgauuccagaucaaaggcguggaacugaagagugguuacaaggauuggauucucuggaucuccuuugcuauuagcugcuuccugcuuugugucgugcuguugggguuuaucaugugggccugccagaaaggcaauauacgcuguaacaucugcauuuga

SEQ ID NO: 130554 - RNA, 1701 nt, Artificial Sequence
  derived and/or modified sequence opt3 from hemagglutinin__InfluenzaA__AFG98896
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucaauuguacccucauagacgcgcugcuuggagauccgcauugcgacggcuuccagaacgagacuugggaucuguuuguggaaagaagcaaggcuuucuccaauuguuaucccuacgacgucccugauuaugccucuuugcggucgcucguggcaucaagcgguacacuggaguuuaucaacgaaggguucaccuggacgggaguuacucagaauggcggcaguaacgccugcaaacgcgggccagacuccggauuuuucucucgacugaauuggcucuacaaaagcgguuccgcuuaucccguguuaaacgucaccaugccuaauaacgauaacuuugacaagcuguacauuuggggcgugcaccauccaucaacagaucaagagcagacuaaucuuuauguacagaccagugggcguguuacagugagcaccaagagaucucagcaaacgaucauucccaacaucggauccaggccuuggguccggggcuugucaagccgcauaaguauuuacuggacuaucgugaaaccaggugacauucuggugaucaauucuaacgggaaucuaaucgcaccgagaggauacuucaagaugaggacaggcaaauccagcauuaugcggucggacgcccccauaggcaccuguaucucugagugcauuacuccuaacggguccaucccaaaugauaagcccuuucagaacgucaauaaaauaacauauggagcuuguccuaaguacguuaagcagaacacccucaaacuggccacggguaugcgcaaugugccagaaaagcagacccgaggcauuuucggggcgaucgcaggauuuaucgagaacggcugggaagguaugauugacgggugguauggcuucagacaccaaaauucagagggaacaggccaggccgcugaucuuaaaaguacucaggccgcaaucgaccaaauuaacgggaagcugaauaggguaauagagaaaaccaacgaaaaguuccaccagaucgagaaagaauuuagcgagguggaaggacggauucaggauuuggagaaguacgucgaggacacaaagaucgaucucugguccuauaacgcugaacuguuaguggcccuggagaaucagcauacuaucgaccucaccgauucugaaaugaacaaacuuuucgagaagacacgucgccaacugagagaaaaugcggaggacauggguaacggcugcuuuaaaauuuaccacaagugugauaaugccugcauagggagcaucaggaacggaaccuaugaccaugacguuuaccgggaugaggcauugaauaaccgauuccagauuaaaggcguggaacuaaagucagguuacaaggacuggauccuguggauuaguuuugcuaucuccugcuuccuccugugugucgugcuucugggguuuauaaugugggccugccagaaaggcaauauccgcuguaacauuugcaucuga

SEQ ID NO: 130555 - RNA, 1701 nt, Artificial Sequence
  derived and/or modified sequence opt3 from hemagglutinin__InfluenzaA__AFG98907
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgaacugguacagucuucaaguacaggcaagaucugcaauaacccacacaggauucucgaugggaucaauuguacccugauagacgcgcuucugggagauccgcauugcgacggcuuucagaacgagaaaugggauuuguucguggaaagaagcaaggcuuuuuccaauuguuaucccuacgacgucccugauuaugccucucuccggucgcugguggcaucaagcgguacucuggaguucaucaacgaaggguuuaauuggacaggaguuacccagaacggcggcaguaaugccugcaaacgcgggccagacuguggauucuuuucccgacucaacugguuauacaagucugguagcacguaucccgugcugaaugucacuaugccuaacaacgauaauuucgacaaacuuuacauuuggggcgugcaccauccauccaccgaucaagagcagacaaacuuguauguacaggcuucagggcguguuacugugaguaccaagagaagccagcaaacaaucauucccaauaucggaucuaggccuuggguccggggccuguccucacgcauaagcauuuacuggaccaucgugaagccaggugacauucuagugaucaacaguaaugggaaccucaucgcaccgagaggauacuuuaaaaugaggacgggcaagucuuccauuaugcggagcgacgcccccauaggcacuugcaucucggaguguauuacaccuaaugggucuaucccaaacgauaaacccuuccagaaugucaacaagauaaccuauggagcuugcccuaaguacguuaaacagaauacucugaaacuugccacagguaugcgcaacgugccagaaaagcagacccgaggcauuuuuggggcgaucgcaggauucaucgagaauggcugggaagguaugauugacgggugguauggcuuuagacaccaaaacuccgagggaacgggccaggccgcugaucugaagucaacccaggccgcaaucgaccaaauuaaugggaaauugaacaggguaauagagaagacaaacgaaaaauuccaccagaucgagaaggaguucagugaaguggaaggacggauucaggaucucgagaaguacgucgaggacacuaaaaucgaucuguggagcuauaaugcugaauuacugguggcccucgagaaccagcauaccaucgaccuuacagauuccgaaaugaauaagcuguuugagaaaacucgucgccaauugagagaaaacgcggaggacauggguaauggcuguuucaagauuuaccacaaaugcgauaacgccugcauagggucuaucaggaauggaaccuauaaccaugacguuuaccgggacgaggcacuaaauaaccgauuucagauuaagggcguggaacuaaagagcgguuacaaagauuggauccucuggauuucauucgcuaucaguuguuuucugcuuugcgucgugcuguugggguucauaaugugggccugucagaagggcaauauccgcugcaacauuuguaucuga

SEQ ID NO: 130556 - RNA, 1701 nt, Artificial Sequence
  derived and/or modified sequence opt3 from hemagglutinin__InfluenzaA__AFG98918
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgaacugguacagucuucaaguacaggcaagaucugcaauaacccacacaggauucucgaugggaucaauuguacccugauagacgcgcuucugggagauccgcauugcgacggcuuucagaacgagaaaugggauuuguucguggaaagaagcaaggcuuuuuccaauuguuaucccuacgacgucccugauuaugccucucuccggucgcugguggcaucaagcgguacucuggaguucaucaacgaaggguuuaauuggacaggaguuacccagaacggcggcaguaaugccugcaaacgcgggccagaccgaggauucuuuucccgucucaacugguuauacaagucugguagcacguaucccgugcugaaugucacuaugccuaacaacgauaauuucgacaaacuuuacauuuggggcgugcaccauccauccaccgaucaagagcagacaaacuuguauguacaggcuucagggagaguuacugugaguaccaagaggagccagcaaacaaucauucccaauaucggaucucggccuuggguccgcggccuguccucaagaauaagcauuuacuggaccaucgugaagccaggugacauucuagugaucaacaguaaugggaaccucaucgcaccgaggggauacuuuaaaaugcggacgggcaagucuuccauuaugcgcagcgacgcccccauaggcacuuguaucucggagugcauuacaccuaaugggucuaucccaaacgauaaacccuuccagaaugucaacaagauaaccuauggagcuuguccuaaguacguuaaacagaauacucugaaacuugccacagguaugcgaaacgugccagaaaagcagaccagaggcauuuuuggggcgaucgcaggauucaucgagaauggcugggaagguaugauugacgggugguauggcuuuaggcaccaaaacuccgagggaacgggccaggccgcugaucugaagucaacccaggccgcaaucgaccaaauuaaugggaaauugaaccggguaauagagaagacaaacgaaaaauuccaccagaucgagaaggaguucagugaaguggaaggacguauucaggaucucgagaaguacgucgaggacacuaaaaucgaucuguggagcuauaaugcugaauuacugguggcccucgagaaccagcauaccaucgaccuuacagauuccgaaaugaauaagcuguuugagaaaacucgcagacaauugagggaaaacgcggaggacauggguaauggcugcuucaagauuuaccacaaaugugauaacgccugcauagggucuauccggaauggaaccuauaaccaugacguuuaccgagacgaggcacuaaauaaccgcuuucagauuaagggcguggaacuaaagagcgguuacaaagauuggauccucuggauuucauucgcuaucaguugcuuucugcuuugugucgugcuguugggguucauaaugugggccugccagaagggcaauaucagauguaacauuugcaucuga

SEQ ID NO: 130557 - RNA, 1701 nt, Artificial Sequence
  derived and/or modified sequence opt3 from hemagglutinin__InfluenzaA__AFG98929
augaagaccgugaucgcccugagcuacauuuucugccucguccuuggccaggaccugcccgggaacgauaauuccacagcuacuuuguguuuaggacaccaugcaguuccuaacgguacgcuggugaaaaccauaacaaaugaccaaaucgagguaacuaacgccaccgaacuggugcagucuucaaguacaggcaagauuugcaauaacccacacagaauccucgaugggauuaauuguacccugaucgacgcgcuucugggagauccgcauugcgacggcuuucagaacgagaaaugggauuuguucgucgaaaggagcaaggcuuuuuccaauuguuaucccuacgacgugccugauuaugccucucuccggucgcugguugcaucaagcgguacucuggaguucauaaacgaaggguuuaauuggacaggagugacccagaacggcggcaguaaugccugcaaacgcgggccagacaucggauucuuuucccgacucaacugguuauacaagucugguagcacguaucccguccugaaugugacuaugccuaacaacgauaauuucgacaaacuuuacauuuggggcguacaccauccauccaccgaucaagagcagacaaacuuguauguucaggcuucagggcgugugacugucaguaccaagagaagccagcaaacaaucauucccaauaucggaucuaggccuugggugcggggccuguccucacgcauaagcauuuacuggaccaucgugaagccaggugacauucuagucaucaacaguaaugggaaccucaucgcaccgagaggauacuuuaaaaugaggacgggcaagucuuccauuaugcggagcgacgcccccauaggcacuuguaucucggagugcauuacaccuaaugggucuaucccaaacgauaaacccuuccagaauguuaacaagauaaccuauggagcuuguccuaaguacgugaaacagaauacucugaaacuugccacagguaugcgcaacguaccagaaaagcagacccgaggcauuuuuggggcgaucgcaggauucaucgagaauggcugggaagguaugauugacgggugguauggcuuuagacaccaaaacuccgagggaacgggccaggccgcugaucugaagucaacccaggccgcaaucgaccaaauuaaugggaaauugaacagggugauagagaagacaaacgaaaaauuccaccagaucgagaaggaguucagugaagucgaaggacggauucaggaucucgagaaguacguggaggacacuaaaaucgaucuguggagcuauaaugcugaauuacugguugcccucgagaaccagcauaccaucgaccuuacagauuccgaaaugaauaagcuguuugagaaaacucgucgccaauugagagaaaacgcggaggacauggguaauggcugcuucaagauuuaccacaaaugugauaacgccugcauagggucuaucaggaauggaaccuauaaccaugacguguaccgggacgaggcacuaaauaaccgauuucagauuaagggcgucgaacuaaagagcgguuacaaagauuggauccucuggauuucauucgcuaucaguugcuuucugcuuugugugguacuguugggguucauaaugugggccugccagaagggcaauauccgcuguaacauuugcaucuga

SEQ ID NO: 130558 - RNA, 1701 nt, Artificial Sequence
  derived and/or modified sequence opt3 from hemagglutinin__InfluenzaA__AFG98940
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgagcuaguacagucuucaaguacaggcaagaucugcaauaacccacacaggauucucgaugggaucaauuguacccugauagacgcgcuucugggagauccgcauugcgacggcuuucagaacgaaaaaugggauuuguucguggaaagaagcaaggcuuuuuccaauuguuaucccuacgacgucccugauuaugccucucuccggucgcugguggcaucaagcgguacucuggaguucaucaacgaaggguuuaauuggacaggaguuacccagaacggcggcaguaaugccugcaaacgcgggccagacuccggauucuuuucucgacucaacugguuauacaagagcgguuccacguaucccgugcugaaugucacuaugccuaacaaggauaacuucgacaaacuuuacauuuggggcgugcaccauccaucaaccgaucaagagcagacaaauuuguauguacaggcuagugggcguguuacugugagcaccaagagaucucagcaaacaaucauucccaacaucggauccaggccuuggguccggggcaugucaagccgcauaaguauuuacuggaccaucgugaaaccaggugacauucuggugaucaauucuaacgggaaucuaaucgcaccgagaggauacuuuaagaugaggacgggccgguccagcauuaugcgcucggacgcccccauaggcacuuguaucucugagugcauuacaccuaacggguccaucccaaaugaucgacccuuccagaacgucaauaaaauaaccuauggagcuuguccuaaguacguuaagcagaacacucucaaacuggccacagguaugagaaaugugccagaaaagcagaccaggggcauuuuuggggcgaucgcaggauucaucgagaacggcugggaagguaugauugacgggugguauggcuuucggcaccaaaauucagagggaacgggccaggccgcugaucuuaaaaguacccaggccgcaaucgaccaaauuaacgggaagcugaaucguguaauagagaaaacaaacgaaaaguuccaccagaucgagaaagaguucagcgaaguggaaggacgcauucaggauuuggagaaguacgucgaggacacuaagaucgaucucugguccuauaacgcugaacuguuaguggcccuggagaaucagcauaccaucgaccucacagauucugaaaugaacaaacuuuuugagaagacuagaaggcaacugcgggaaaaugcggaggacauggguaacggcugcuucaaaauuuaccacaagugugauaaugccugcauagagagcauccgaaacgggaccuauaaucaugacguuuaccgcgacgaagcauugaacaauagauuucagauuaaaggaguggagcuaaagucaggcuacaaggauuggauccuguggauuaguuucgcuaucuccugcuuucuccugugugucgugcuucuggguuucauaaugugggccugccagaaagggaacaucagguguaauauuugcaucuga

SEQ ID NO: 130559 - RNA, 1701 nt, Artificial Sequence
  derived and/or modified sequence opt3 from hemagglutinin__InfluenzaA__AFG98962
augaagaccaucauugcccugagcuacauauucugccucgugcuugcucaggaccugcccggcaacgauaauuccacagcaacuuuguguuuagggcaccaugccgucccuaacggaacgcugguuaaaaccaucacaaaugaccaaauugaggugacuaacgcgaccgaacugguacagucuucaaguacagguaagaucugcaauaacccacacaggauucucgauggcaucaauuguacccugauagacgcccuucugggggauccgcauugcgacggauuucagaacgagaaaugggauuuguucguggaaagaagcaaggcuuuuuccaauuguuaucccuacgacgucccugauuaugcaucucuccggucgcugguggccucaagcggcacucuggaguucaucaacgaagguuuuaauuggacagggguuacccagaacggaggcaguaaugcuugcaaacgcggcccagacuccggguucuuuucucgacucaacugguuauacaagagcggauccacguaucccgugcugaaugucacuaugccuaacaacgauaauuucgacaaacuuuacauuuggggugugcaccauccaucaaccgaucaagagcagacaaacuuguauguacaggcaaguggccguguuacugugagcaccaagagaucucagcaaacaaucauucccaaugucggguccaggccuugggugcggggacugucaagccgcaucaguauauacuggaccauugugaagccaggcgacauccuagucauuaacucuaaugguaaccucaucgccccgagaggguacuuuaaaaugaggacgggaaaguccagcaucaugcggucggacgcucccauuggcacuuguucuuccgagugcauaacaccuaauggcucaaucccaaacgauaaacccuuccagaauguuaacaagauuaccuauggggccuguccuaaguacgugaaacagaauacucugaaacuugcgacaggaaugcgcaacguaccagaaaagcagacccgagguaucuuuggcgcaauagccggguucauugagaauggaugggaaggcaugaucgacgguugguauggguuuagacaccaaaacagugagggcacgggacaggcugccgaucuaaagagcacccaggcagcuaucgaccaaauuaauggcaaauugaacagggugaucgagaagacaaacgaaaaauuccaccagauugagaaggaguucuccgaagucgaagggcggauacaggaucucgagaaguacguggaggacacuaaaaucgaucuguggucuuauaaugccgaauuacugguugcgcucgagaaccagcauaccauugaccuuacagauagcgaaaugaauaagcuguuugagaaaacucgucgccaauugagagaaaacgccgaggacaugggaaaugguugcuucaagaucuaccacaaaugugauaacgcaugcaucggcucaauuaggaaugggaccuaugaccaugacguguaccgggaugaggcucuaaacaaucgauuucagauaaagggagucgaacugaagaguggcuacaaagacuggauccucuggauuuccuucgccaucagcugcuuucugcuuugugugguacuguuggguuucauuaugugggcuugccagaaggggaacauccgcuguaauauaugcaucuga

SEQ ID NO: 130560 - RNA, 1701 nt, Artificial Sequence
  derived and/or modified sequence opt3 from hemagglutinin__InfluenzaA__AFG98973
augaagaccaucauugcccugagcuacauauucugccucgugcuuggccaggacuuucccagaaacgauaauuccacagcuacucuguguuuggggcaccaugcagucccuaacggaacguuaguuaaaaccaucacaaaugaccaaauugaggugacuaacgccaaugaacugguacagucuucaaguaccgguaagaucugcaacaauccacacaggauucuagauggcauggacuguacacucaucgaugcgcugcuuggggacccgcauugcgauggacugcagaacgagaccugggacuuguucguggaacggagcaaggcuuuuuccaauuguuaucccuacgaugucccugacuaugccucucuccgcucgcugguggcaucaagcggcacucuggaguucauaaacgaagguuuuacauggaccgggguuacgcagaauggaggcaguaacgccugcaagcgaggcccagaucguggguucuuuuccagacucaauugguuauacaaaucuggaaacacuuaucccgugcugaaugucaccaugccuaacaacgacaauuucgauaaacuuuacaucuggggugugcaccauccaagcacagaccaagaccagacuuccuuguauguacaggcuucaggcaggguuaccgugaguacaaagcggagccagcaaaccgucauucccaacaucgggccucgcccaugggugagaggacugucuuccggcauuucaaucuacuggacgauagugaaaccgggugauauucuacucaucaauagcaacgggaaucugauugcacccaggggauacuuuaagaugcggacuggcaaaaguucuaucaugcgcuccgacgccccuaucggcacauguauuagcgagugcauaaccccaaacgggucgauccccaaugauaagccuuuccagaacgucaauaaaauuacuuauggagcuuguccaaaguacguuaagcagaacacacuuaaacuggccaccgguaugcgaaaugugcccgagaagcagacgagaggcaucuuuggggcgauagcaggauucauugaaaacggcugggaggguaugaucgacgggugguauggcuuuaggcaccaaaauucugaaggaaccggccaggccgcugauuugaaauccacacaggccgcaaucgaccaaauuaacgggaagcucaaucggguaaucgagaaaacuaacgagaaguuccaccagauugaaaaagaguucucagaaguggagggacguauacaggaucuggaaaaguacgucgaggacaccaagaucgauuuauggaguuauaacgcugagcugcucguggcccuugaaaaucagcauacaauugaccugacugauagcgagaugaacaaauuguuugaaaagacccgcagacaacuaagggagaaugcggaagacauggguaacggcugcuucaaaaucuaccaccggugugacaaugccugcaucggguccauucgaaacggaacauaugaucaugacguuuaccgcgaugaggcacugaauaacagauuucagauaaagggcguggagcucaaaucugguuacaaggacuggauccuguggauuagcuucgcuaucucaugcuuucuucugugugucguguugcucggguucauuaugugggccugccagaagggcaauaucagguguaacauaugcaucuga

SEQ ID NO: 130561 - RNA, 1701 nt, Artificial Sequence
  derived and/or modified sequence opt3 from hemagglutinin__InfluenzaA__AFG98984
augaagaccaucauugcccugagcuacauauucugccucgugcuuggccaggacuuucccagaaacgauaauuccacagcuacucuguguuuggggcaccaugcagucccuaacggaacguuaguuaaaaccaucacaaaugaccaaauugaggugacuaacgccaccgaacugguacagucuucaaguacagguaagaucugcaauaacccacacaggauucuagauggcauggacuguacccucaucgaugcgcugcuuggggacccgcauugcgauggacugcagaaugagacuugggacuuguucguggaacggagcaaggcuuuuuccaacuguuaucccuacgaugucccugacuaugccucucuccgcucgcugguggcaucaagcggcacacuggaguucauaaaugaagguuuuaccuggacggggguuacucagaacggaggcaguaaugccugcaagcgaggcccagaucguggguucuuuuccagacucaacugguuauacaaaucuggaaauaccuaucccgugcugaacgucacaaugccuaauaacgacaacuucgauaaacuuuacaucuggggugugcaccauccaagcacugaccaagaccagaccuccuuguauguacaggcuucaggcaggguuacagugaguaccaagcggagccagcaaacggucauucccaauaucgggccucgcccaugggugagaggacugucuuccggcauuucaaucuacuggacuauagugaaaccgggugauauucuacucaucaacagcaaugggaaccugauugcacccaggggauacuuuaagaugcggacaggcaaaaguucuaucaugcgcuccgacgccccuaucggcaccuguauuagcgagugcauaacuccaaaugggucgauccccaacgauaagccuuuccagaaugucaacaaaauuacauauggagcuuguccaaaguacguuaagcagaauacccuuaaacuggccacggguaugcgaaacgugcccgagaagcagaccagaggcaucuuuggggcgauagcaggauucauugaaaauggcugggaggguaugaucgacgggugguauggcuuuaggcaccaaaacucugaaggaacaggccaggccgcugauuugaaauccacucaggccgcaaucgaccaaauuaaugggaagcucaaccggguaaucgagaaaaccaaugagaaguuccaccagauugaaaaagaguucucagaaguggagggacguauacaggaucuggaaaaguacgucgaggacacaaagaucgauuuauggaguuauaacgcugagcugcucguggcccuugaaaaccagcauacuauugaccugaccgauagcgagaugaauaaauuguuugaaaagacacgcagacaacuaagggagaacgcggaagacauggguaauggcugcuucaaaaucuaccaccggugugacaacgccugcaucggguccauucgaaauggaaccuaugaucaugacguuuaccgcgaugaggcacugaacaauagauuucagauaaagggcguggagcucaaaucugguuacaaggacuggauccuguggauuagcuucgcuaucucaugcuuucuucugugugucguguugcucggguucauuaugugggccugccagaagggcaacaucagguguaauauaugcaucuga

SEQ ID NO: 130562 - RNA, 1704 nt, Artificial Sequence
  derived and/or modified sequence opt3 from hemagglutinin__InfluenzaA__AFG98995
augaagaccaucauugcccugagcuacauauucugccucguguuugcucaggaccuucccggcaacgauaauaacuccacagcaacucuguguuuggggcaccaugccgucccuaauggaacguuaguuaaaaccaucacaaacgaccaaauugaggugacuaaugcgaccgaacugguacagucuucaaguacagguaagaucugcaacaauccacacaggauucuagauggcaucaacuguacccucauagacgcucugcuuggggauccgcauugcgacggauuccagaaugagaaaugggaucuguuuguggaaagaagcaaggccuucuccaacuguuaucccuacgacgucccugauuaugcaucuuugcggucgcucguggccucaagcggcacucuggaguuuaucaaugaagguuucaacuggacagggguuacccagaauggaggcaguaacgcuugcaaacgcggcccagacauuggguuuuucucccgacugaauuggcucuacaagucuggaagcacguaucccgugcaaaacgucacuaugccuaacaaugauaacuccgacaaguuauacaucuggggugugcaccauccaucaaccgauaaagagcagacagaccuguauguacaggcaaguggcaagguuacugugagcaccaaacguucucagcaaacaauuauccccaaugucggguccagaccuugggugaggggacuuucaagccggauaaguauuuacuggaccaucgugaagccaggcgacauuuuggucaucaacucuaaugguaaccugaucgccccgcgcggguacuuuaaaaugagaacgggaaaguccagcauuaugaggucggaugcucccauaggcacuuguucuuccgagugcaucacaccuaauggcucaauuccaaacgacaagcccuuccagaauguuaacaaaaucaccuauggggccuguccuaaguacgugaaacagaauacucuaaagcucgcgacaggaaugcggaacguaccagaaaaacagacccgcgguauauuuggcgcaauugccggguucaucgagaauggaugggaaggcaugaucgaugguugguauggguuucgacaccaaaacagugagggcacgggacaggcugccgaccuuaagagcacccaggcagcuauugaucaaaucaauggcaaacugaacagagugauugagaagacaaacgaaaaguuccaccagauagagaaagaguucuccgaagucgaagggaggauccaggaccuggagaaguacguggaggauacuaaaauugacuuguggucuuauaaugccgaacuccugguugcguuagagaaccagcauaccaucgaucugacagacagcgaaaugaauaagcucuuugagaaaacucggcgucaacuucgcgaaaacgccgaggauaugggaaaugguugcuucaagaucuaccacaagugugacaacgcaugcauuggcucaauaagaaaugggaccuaugaccaugauguguacagggacgaggcucugaacaaucgguuucagaucaaaggagucgaauugaagaguggcuacaaagauuggauucuauggaucuccuucgccauuagcugcuuucugcucugugugguacugcuugguuucaucaugugggcuugccagaaggggaacauacgauguaauaucugcauuuga

SEQ ID NO: 130563 - RNA, 1701 nt, Artificial Sequence
  derived and/or modified sequence opt3 from hemagglutinin__InfluenzaA__AFG99006
augaagaccaucauugcccugagcuacauauucugccucgugcuuggccaggacuuucccagaaacgauaauuccacagcuacucuguguuuggggcaccaugcagucccuaacggaacguuaguuaaaaccaucacaaaugaccaaauugaggugacuaacgccaccgaacugguacagucuucaaguacagguaagaucugcaauaacccacacaggauucuagauggcauggacuguacccucaucgaugcgcugcuuggggacccgcauugcgauggacugcagaaugagacuugggacuuguucguggaacggagcaaggcuuuuuccaacuguuaucccuacgaugucccugacuaugccucucuccgcucgcugguggcaucaagcggcacacuggaguucauaaaugaagguuuuaccuggacggggguuacucagaacggaggcaguaaugccugcaagcgaggcccagaucguggguucuuuuccagacucaacugguuauacaaaucuggaaauaccuaucccgugcugaacgucacaaugccuaauaacgacaacuucgauaaacuuuacaucuggggugugcaccauccaagcacugaccaagaccagaccuccuuguauguacaggcuucaggcaggguuacagugaguaccaagcggagccagcaaacggucauucccaauaucgggccucgcccaugggugagaggacugucuuccaggauuucaaucuacuggacuauagugaaaccgggcgauauucuacucaucaacagcaaugguaaccugauugcaccccggggguacuuuaagaugcgcacaggaaaaaguucuaucaugcgauccgacgccccuaucggcaccuguauuagcgagugcauaacuccaaauggcucgauccccaacgauaagccuuuccagaaugucaacaaaauuacauauggggcuuguccaaaguacguuaagcagaauacccuuaaacuggccacgggaaugagaaacgugcccgagaagcagaccagggguaucuuuggcgcgauagcaggguucauugaaaauggaugggagggcaugaucgacgguugguauggguuucggcaccaaaacucugaaggcacaggacaggccgcugauuugaaauccacucaggccgcaaucgaccaaauuaauggcaagcucaaccguguaaucgagaaaaccaaugagaaguuccaccagauugaaaaagaguucucagaaguggaggggcgcauacaggaucuggaaaaguacgucgaggacacaaagaucgauuuauggaguuauaacgcugagcugcucguggcccuugaaaaccagcauacuauugaccugaccgauagcgagaugaauaaauuguuugaaaagacaagaaggcaacuacgggagaacgcggaagacaugggaaaugguugcuucaaaaucuaccaccgaugugacaacgccugcaucggcuccauucgcaaugggaccuaugaucaugacguuuacagagaugaggcacugaacaauagguuucagauaaagggaguggagcucaaaucuggcuacaaggacuggauccuguggauuagcuucgcuaucucaugcuuucuucugugugucguguugcucgguuucauuaugugggccugccagaaggggaacauccgguguaauauaugcaucuga

SEQ ID NO: 130564 - RNA, 1701 nt, Artificial Sequence; identical to SEQ ID NO: 122780
  derived and/or modified sequence opt3 from hemagglutinin__InfluenzaA__AFG99017

SEQ ID NO: 130565 - RNA, 1701 nt, Artificial Sequence
  derived and/or modified sequence opt3 from hemagglutinin__InfluenzaA__AFG99028
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcggcaauccacacagaauacuagaugggaucaacuguacccucauagacgcucugcuuggagauccgcauugcgacggcuuccagaaugagaaaugggaucuguuuguggaaaggagcaaggccuucuccaacuguuaucccuacgacgucccugauuaugcaucuuugcggucgcucguggccucaagcgguacucuggaguuuaucaaugaaggguucaacuggacaggaguuacccagaauggcggcaguuccgcuugcaaacgcgggccagacaacggauuuuucucucgacugaauuggcucuacaagagcgguuccacguaucccgugcaaaacgucacuaugccuaauaacgauaacucagacaaguuauacauuuggggcgugcaccauccaaguaccgauaaagagcagacagaccuguauguacaggcaagcgggaagguuacugugucuaccaaacguucccagcaaacagucauccccaaugugggaucaagaccuugggugaggggccuuagcagucgggucucuauuuacuggaccaucguuaagccaggugacauauuggugauuaacuccaaugggaaccugaucgccccgcgcggauacuuuaaaaugagaacgggcaagagcucgauuaugaggucugaugcucccaucggcacuuguuccucagagugcaucacaccuaaugggaguauuccaaacgacaagcccuuccagaauguaaacaaaauaaccuauggagccuguccuaaguacgugaaacagaauacucuaaagcucgcgacagguaugcggaacgucccagaaaaacagacccgcggcaucuuuggggcaauugccggauucaucgagaauggcugggaagguaugauagaugggugguauggcuuucgacaccaaaacagcgagggaacgggccaggcugccgaccugaaguccacccaggcagcuauugaucaaaucaaugggaaacuuaacagagugaucgagaagacaaaugaaaaguuccaccagauugagaaagaguucucugaaguugaaggaaggauccaggaccuggagaaguacguggaggauacuaaaauugacuuguggagcuauaacgccgaacuccuggucgcguuagagaaccagcauaccauagaucugacagacucagaaaugaauaagcucuuugagaaaacucggcgucaacuucgcgaaaacgccgaggauauggguaauggcugcuucaagaucuaccacaagugugacaacgcaugcauugggaguaucagaaauggaaccuaugaccaugauguguacagggacgaggcucugaacaaucgguuucagaucaaaggcguagaauugaaguccgguuacaaagauuggauucuauggauuagcuucgccaucucuugcuuucugcucuguguugugcugcuuggguucauuaugugggcuugccagaagggcaacauccgauguaauauuugcaucuga

SEQ ID NO: 130566 - RNA, 1701 nt, Artificial Sequence
  derived and/or modified sequence opt3 from hemagglutinin__InfluenzaA__AFG99039
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacagaauacuagacggcaucaacuguacccucauagaugcucugcuuggggacccgcauugcgauggauuccagaaugagaaaugggaccuguuuguggaaaggagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcaaaacgucgcaaugccuaauaacgacaacucagauaaguuauacauuuggggugugcaccauccaaguacugacaaagagcagaccgaccuguauguacaggccagcggcaagguuacagugucuacuaaacguucccagcaaaccgucauccccaauguggggucaagaccuugggugaggggacuuagcagucgggucucuauuuacuggacaaucguuaagccaggcgauauauuggugauuaacuccaaugguaaccugaucgcuccgcgcggguacuuuaaaaugagaaccggaaagagcucgauuaugaggucugacgcccccaucggcacguguuccucagagugcaucacuccuaauggcaguauuccaaacgauaagcccuuccagaauguaaacaaaauaacauauggggcguguccuaaguacgugaaacagaauacccuaaagcucgcaacuggaaugcggaacgucccagaaaaacagacacgcgguaucuuuggcgccauugcuggguucaucgagaauggaugggaaggcaugauagacgguugguauggguuucgacaccaaaacagcgagggcaccggacaggccgcagaucugaaguccacgcaggcugccauugaccaaaucaauggcaaacuuaacagagugaucgagaagaccaaugaaaaguuccaccagauugagaaagaguucucugaaguugaagggaggauccaggaucuggagaaguacguggaggacacaaaaauugauuuguggagcuauaacgcggaacuccuggucgccuuagagaaccagcauacuauagaccugaccgauucagaaaugaauaagcucuuugagaaaacacggcgucaacuucgcgaaaacgcagaggacaugggaaaugguugcuucaagaucuaccacaagugugacaacgcuugcauuggcaguaucagaaaugggacuuaugaucaugacguguacagggaugaggcccugaacaaucgguuucagaucaaaggaguagaauugaaguccggcuacaaagacuggauucuauggauuagcuucgcuaucucuugcuuucugcucuguguugugcugcuugguuucauuaugugggccugccagaaggggaacauccgauguaauauuugcaucuga

SEQ ID NO: 130567 - RNA, 1701 nt, Artificial Sequence; identical to SEQ ID NO: 122780
  derived and/or modified sequence opt3 from hemagglutinin__InfluenzaA__AFG99050

SEQ ID NO: 130568 - RNA, 1701 nt, Artificial Sequence
  derived and/or modified sequence opt3 from hemagglutinin__InfluenzaA__AFG99061
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacaggauucuagacggcaucaacuguacccucauagaugcucugcuuggggacccgcauugcgauggauuccagaaugagaaaugggaccuguuuguggaaagaagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaacggguuuuucucucgacugaauuggcucuacaagagcggauccacguaucccgugcaaaacgucacuaugccuaauaacgacaacucagauaaguuauacauuuggggugugcaccauccaaguaccgacaaagagcagacagaccuguauguacaggcaagcggcaagguuacugugucuaccaaacguucccagcaaacagucauccccaauguggggucaagaccuugggugaggggacuuagcagucgggucucuauuuacuggaccaucguuaagccaggcgauauauuggugauuaacuccaaugguaaccugaucgccccgcgcggguacuuuaaaaugagaacgggaaagagcucgauuaugaggucugacgcucccaucggcacuuguuccucagagugcaucacaccuaauggcaguauuccaaacgauaagcccuuccagaauguaaacaaaauaaccuauggggccuguccuaaguacaucaaacagaauacucuaaagcucgcgacaggaaugcggaacgugccagaaaaacagacccgcgguauuuuuggcgcaaucgccggguucauagagaauggaugggaaggcaugauugacgguugguauggguuucgacaccaaaacagcgagggcacgggacaggcugccgaucugaaguccacccaggcagcuaucgaccaaaucaauggcaaacuuaacaaggucauugagaagacaaaugaaaaauuccaccagaucgagaaggaguucucugaaguggaagggaggauucaggaucuggagaaauacguugaggacacuaagauagauuuguggagcuauaacgccgaacuccugguggcguuagagaaccagcauaccaucgaccugacagauucagaaaugaauaaacucuuugagaagacuagacggcaacuucgugaaaacgccgaggacaugggaaaugguugcuucaagauuuaccacaaaugugacaacgcaugcaucggcaguauccgcaaugggaccuaugaucaugacgucuacagagaugaggcucugaacaauagguuucagauuaagggaguggaauugaaauccggcuacaaggacuggauacuauggaucagcuucgccauuucuugcuuucugcucuguguaguucugcuugguuucaucaugugggcuugccagaaagggaacauucgguguaauaucugcauauga

SEQ ID NO: 130569 - RNA, 1701 nt, Artificial Sequence
  derived and/or modified sequence opt3 from hemagglutinin__InfluenzaA__AFG99072
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacaggauucuagacggcaaaaacuguacccucaucgaugcucugcuuggggacccgcauugcgauggauuccagaaugagaagugggaccuguuuguggaaagaagcaaagccuucuccaacuguuaucccuacgaugucccugacuaugcaucuuugcggucgcucguggccucaagcggcacucuggaguuuauaaaugaagguuucaacuggacagggguuacccagaauggaggcaguuccgcuugcaagcgcggcccagauaacggguuuuucucucgacugaauuggcucuacaagagcggauccacguaucccgugcaaaacgucacuaugccuaauaacgacaacucagaucguuuauacaucuggggugugcaccauccaaguaccgacaaagagcagacagaccuguauguacaggcaagcggcaagguuacugugucuaccaaaagaucccagcaaacagucauucccaauguggggucaaggccuugggugcggggacuuagcagucgcgucucuaucuacuggaccauuguuaagccaggcgauaucuuggugauaaacuccaaugguaaccugauugccccgagaggguacuuuaaaaugaggacgggaaagagcucgaucaugcggucugacgcucccauuggcacuuguuccucagagugcaucacaccuaauggcaguaucccaaacgauaagcccuuccagaauguaaacaaaauuaccuauggggccuguccuaaguacgugaaacagaauacucuaaagcucgcgacaggaaugcgcaacgucccagaaaaacagacccgagguauauuuggcgcaaucgccggguucauugagaauggaugggaaggcaugaucgacgguugguauggguuuagacaccaaaacagcgagggcacgggacaggcugccgaucugaaguccacccaggcagcuauagaccaaauuaauggcaaacuuaacagggugaucgagaagacaaaugaaaaguuccaccagaucgagaaagaguucucugaaguugaagggcggauucaggaucuggagaaguacguggaggacacuaaaaucgauuuguggagcuauaacgccgaacuccuggucgcguuagagaaccagcauaccauugaccugacagauucagaaaugaauaagcucuuugagaaaacucgucgccaacuuagagaaaacgccgaggacaugggaaaugguugcuucaagauauaccacaagugugacaacgcaugcaucggcaguauuaggaaugggaccuauaaccaugauguguaccgggacgaggcucugaauaaccgauuucagaucaaaggaguagaauugaaguccggcuacaaagauuggauccuauggauuagcuucgccauaucuugcuuucugcucuguguugugcugcuugguuucaucaugugggcuugccagaaggggaauauucgcuguaacaucugcauuuga

SEQ ID NO: 130570 - RNA, 1701 nt, Artificial Sequence
  derived and/or modified sequence opt3 from hemagglutinin__InfluenzaA__AFG99083
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacagaauacuagacggcaucaacuguacccucauagaugcucugcuuggggacccgcauugcgauggauuccagaaugagaaaugggaccuguuuguggaaaggagcaaggccuucuccaacuguuaucccuacgaugucccugacuaugcaucuuugcggucgcucguggccucaagcggcacucuggaguuuaucaaugaagguuucaacuggacagggguuacccagaauggaggcaguuccgcuugcaaacgcggcccagauaagggguuuuucucucgacugaacuggcucuacaagagcggauccacguaucccgugcaaaaugucacuaugccuaacaaugacaacucagauaaauuauacauuuggggugugcaccauccaaguaccgacaaggagcagacagaccuguauguacaggcaagcggcaaaguuacugugucuaccaagcguucccagcaaacagucauccccaacguggggucaagaccuugggugaggggacuuagcagucgggucucuauuuacuggaccaucguuaaaccaggcgauauauuggugauuaauuccaacgguaaucugaucgccccgcgcggguacuuuaagaugcuaacgggaaagagcucgauuaugagaucugacgcucccaucggcacuuguuccucagagugcaucacaccuaacggcaguauuccaaaugauaaacccuuccagaacguaaauaagauaaccuauggggccuguccuaaauacgugaagcagaacacucucaaacuggcgacaggaaugaggaaugucccagaaaagcagacccgggguaucuuuggcgcaauugccggguucaucgagaacggaugggaaggcaugauagacgguugguauggguuucgccaccaaaauagcgagggcacgggacaggcugccgaucuuaaauccacccaggcagcuauugaccaaaucaacggcaagcugaaucgagugaucgagaagacaaacgaaaaauuccaccagauugagaaggaguucucugaaguugaagggagaauccaugauuuggagaaauacguggaggacacuaagauugaucucuggagcuauaaugccgaacuguuagucgcgcuggagaaccagcacaccauagaccucacagauucagaaaugaacaaacuuuuugagaagacuaggcggcagcugcgugaaaaugccgaggacaugggaaacgguugcuucaagaucuaccauaaaugugacaaugcaugcauuggcaguauccgcaacgggaccuaugaucacgacguguacagagaugaggcuuugaauaacagguuucaaaucaagggaguagaacuaaaauccggcuacaaggacuggauucuguggauuagcuucgccaucucuugcuuucuccuguguguugugcuucuggguuucauuaugugggcuugccagaaagggaauauccgguguaacauuugcaucuga

SEQ ID NO: 130571 - RNA, 1701 nt, Artificial Sequence
  derived and/or modified sequence opt3 from hemagglutinin__InfluenzaA__AFG99094
augaagaccaucauugcccugagcuacauauucugccucguguuugcucaggaccuucccggcaacgauaauuccacagcaacucuguguuuggggcaccaugccgucccuaacggaacguuaguuaaaaccaucacaaaugaccaaauugaggugacuaacgcgaccgaacugguacagucuucaaguacagguaagaucugcgauaauccacacaggauucuagacggcaucaacuguacccucauagaugcucugcuuggggacccgcauugcgauggauuccagaaugagaaaugggaccuguuuguggaaagaagcaaggccuucuccaacuguuaucccuacgaugucccugacuaugcaucuuugcggucgcucguggccucaagcggcacucuggaguuuaucaaugaagguuucaacuggacagggguuacccagaauggaggcaguggcgcuugcaaacgcgggccagauaacggauuuuucucccgacugaauuggcucuacaagucugguagcacguaucccgugcaaaacgucacuaugccuaauaacgacaacuccgauaaguuauacauuuggggcgugcaccauccaucaaccgacaaagagcagacagaccuguauguacaggcaagugggaagguuacugugagcaccaaacguucucagcaaacagucauccccaaugugggauccagaccuugggugaggggccuuucaagccgggucaguauuuacuggaccaucguuaagccaggugauauauuggugauuaacucuaaugggaaccugaucgccccgcgcggauacuuuaaaaugagaacgggcaaguccagcauuaugaggucggacgcucccaucggcacuuguucuuccgagugcaucacaccuaaugggucaauuccaaacgauaagcccuuccagaauguaaacaaaauaaccuauggagccuguccuaaguacgugaaacagaauacucuaaagcucgcgacagguaugcggaacgucccagaaaaacagacccgcggcaucuuuggggcaauugccggauucaucgagaauggcugggaagguaugauagacgggugguauggcuuucgacaccaaaacagugagggaacgggccaggcugccgaucuuaagagcacccaggcagcuauugaccaaaucaaugggaaacugaacagagugaucgagaagacaaaugaaaaguuccaccagauugagaaagaguucuccgaaguugaaggaaggauccaggaucuggagaaguacguggaggacacuaaaauugauuuguggucuuauaacgccgaacuccuggucgcguuagagaaccagcauaccauagaccugacagauagcgaaaugaauaagcucuuugagaaaacucggcgucaacuucgcgaaaacgccgaggacauggguaauggcugcuucaagaucuaccacaagugugacaacgcaugcauugggucaaucagaaauggaaccuaugaucaugacguguacagggaugaggcucugaacaaucgguuucagaucaaaggcguagaauugaagagugguuacaaagacuggauucuauggauauccuucgccaucagcugcuuucugcucuguguugugcugcuuggguucauuaugugggcuugccagaagggcaacauccgauguaauauuugcaucuga

SEQ ID NO: 130572 - RNA, 1701 nt, Artificial Sequence
  derived and/or modified sequence opt3 from hemagglutinin__InfluenzaA__AFG99116
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucguggacgcucugcuuggggauccgcauugcgacggauuccagaaugagaaaugggaucuguuugucgaacgguccaaggccuucucuaacuguuaucccuacgacgugccugauuaugcaucguugcgcucacucguugccagcaguggcacucuggaguuuaucaaugaauccuucaacuggacaggugugacccagucugggggaagcuacgcuugcaaacgaggcuccgacaauucauuuuucagucgucugaacuggcucuaugagagcgagucuaaguacccagucuuaaaugugacgaugcccaacaauggcaacuuugauaagcuguauauauggggaguacaccauccuuccacugacaaagaacaaaccaaccuuuacguuagagcaucagggagggugacagucagcacuaagcggagucagcagaccaucauuccaaauaucgguucucgccccugggugagaggcuuguccagcaggauuucgaucuacuggacaauagugaaaccuggggauauucugcuaaucaacucuaauggaaaccucauugccccacggggcuauuucaagauccgcaccgguaaauccucaaucaugcgaagugacgcuccgauugggacguguagcuccgagugcauaacucccaauggaucuaucccuaacgacaagccauuucagaaugucaacaagauuacauacggcgccugucccaaauauguuaagcaaaauacccugaaacuugcgacuggcaugagaaacgugccugaaaagcagacaagggggaucuucggagcaauagccgguuuuauugagaauggcugggaggggaugguagauggaugguacggcuuccggcaccagaacagcgaagguaccgggcaggcugccgaccugaaaucaacgcaagcagcuaucgaucagaucaauggcaaguugaaccgugugauugagaaaaccaaugaaaaguuccaccagaucgagaaggaauuuagugaggucgagggacgcauucaagaccucgaaaaauauguggaggauacaaagauagaccugugguccuacaacgccgaauuacugguugcgcucgagaaccagcauacuaucgaucuuaccgacagcgaaaugaauaaacuguucgagaagacaagaaggcaguugcgggagaacgccgaagauaugggcaaugggugcuuuaaaauuuaucacaagugugacaacgcaugcaucggaucuauccgaaaugguacuuacgaucaugacguguaccgcgacgaggcucuaaacaauagauuccagauuaagggcgucgaacugaaaucaggguauaaggauuggauacucuggaucaguuuugccauuagcugcuuccugcuuugugugguacuguugggauuuaucaugugggcuugccaaaaaggcaacauuagguguaauaucugcauauga

SEQ ID NO: 130573 - RNA, 1701 nt, Artificial Sequence
  derived and/or modified sequence opt3 from hemagglutinin__InfluenzaA__AFG99127
augaagaccaucauugcccugagcuacauacucugccuuguguucgcucagaaccugcccggcaaugacaacuccacagcaacuuuguguuuagggcaccaugccgucccuaauggaacgcugguuaaaaccaucacaaacgaucaaauugaggugacuaaugcgaccgaacuuguacagucuucaaguacagguagaaucugcgacagcccacacaggauucucgauggcaagaacuguacccugguggacgcccuucugggggauccgcauugcgacggauuucagaaugagaaaugggauuuguucgucgaacgguccaaggcuuuuucuaacuguuaucccuacgacgugccugauuaugcaucgcuccgcucacugguugccagcaguggcacucuggaguucaucaaugaauccuuuaacuggacaggugugacccagucugggggaagcuacgcuugcaaacgaggcuccgacaauucauucuuuagucgucucaacugguuauaugagagcgagucuaaguacccaguccugaaugugacgaugcccaacaauggcaacuucgauaagcuauauauauggggaguacaccauccuuccacugacaaagaacaaaccaacuuguacguuagagcaucagggagggugacagucagcacuaagcggagucagcagaccaucauuccaaauaucgguucucgccccugggugagaggccuguccagcaggauuucgaucuacuggacaauagugaaaccuggggauauucuacucaucaacucuaauggaaaccugauugccccacggggcuauuuuaagauccgcaccgguaaauccucaaucaugcgaagugacgcuccgauugggacguguagcuccgagugcauaacucccaauggaucuaucccuaacgacaagccauuccagaaugucaacaagauuacauacggcgccugucccaaauauguuaagcaaaauacccuuaaacuggcgacuggcaugagaaacgugccugaaaagcagacaagggggaucuuuggagcaauagccgguuucauugagaauggcugggaggggaugguagauggaugguacggcuuucggcaccagaacagcgaagguaccgggcaggcugccgacuugaaaucaacgcaagcagcuaucgaucagaucaauggcaagcucaaccgugugauugagaaaaccaaugaaaaguuccaccagaucgagaaggaguucagugaagucgagggacgcauucaagaccuggaaaaauauguggaggauacaaagauagacuuaugguccuacaacgccgaacugcucguugcgcuugagaaccagcauacuaucgaucugaccgacagcgaaaugaauaaauuguuugagaagacaagaaggcagcuacgggagaacgccgaagauaugggcaaugggugcuucaaaauuuaucacaagugugacaacgcaugcaucggaucuauccgaaaugguacuuacgaucaugacguguaccgcgacgaggcucugaacaauagauuucagauuaagggcgucgaacucaaaucaggguauaaggauuggauacuguggaucaguuucgccauuagcugcuuucuucugugugugguauugcucggauucaucaugugggcuugccaaaaaggcaacauuagguguaauaucugcauauga

SEQ ID NO: 130574 - RNA, 1701 nt, Artificial Sequence
  derived and/or modified sequence opt3 from hemagglutinin__InfluenzaA__AFG99138
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucguggacgcucugcuuggggauccgcauugcgacggauuccagaaugagaaaugggaucuguuugucgaacgguccaaggccuucucuaacuguuaucccuacgacgugccugauuaugcaucguugcgcucacucguugccagcaguggcacucuggaguuuaucaaugaauccuucaacuggacaggugugacccagucugggggaagcuccgcuugcaaacgaggcucagacaauagcuuuuucagucgucugaacuggcucuacgagucugaguccaaguauccagucuuaaaugugacgaugcccaacaauggcaacuuugauaagcuguacauauggggaguacaccauccuucaacugacaaagaacaaaccaaccuuuauguuagagcaagcgggagggugacagucaguacuaagcggaaucagcagaccgugaucccaaacauugguucucgccccugggugagaggcuuguccagcaggaucucgauuuacuggacaaucgucaaaccuggggauauacugcuaauuaauucuaacggaaaucucaucgccccacggggcuacuucaagauucgcaacgguaaauccucaaucaugcgaagugacgcuccgaucgggaccuguagcuccgagugcauuacgcccaauggaucuauaccuaacgacaagccauuucagaauguuaacaagaucacuuauggcgccugucccaaauacgugaagcaaaauacacugaaacuugcgaccggcaugagaaacguaccugaaaagcagacuagggggauuuucggagcaaucgccgguuuuauagagaauggcugggaggggaugguggauggaugguauggcuuccggcaccguaacagcgaagguacagggcaggcugccgaccugaaaucaacccaggcagcuauugaucaaaucaauggcaaguugaaccgcgucaucgagaaaacgaacgaaaaguuccaccagauugagaaggaauuuagugagguggagggaagaauccaggaccucgaaaaauacguugaggauaccaagauugaccugugguccuauaaugccgaauuacugguggcgcucgagaaccaacauacaauagaucuuacugacagcgaaaugaauaaacuguucgagaagaccaggcggcaguugcgagagaacgccgaagauaugggcaaugggugcuuuaaaaucuaccacaagugugacaacgcaugcauuggaucuauccgcaaugguacauaugaucaugacgucuacagagacgaggcucuaaacaauagguuccagaucaagggcguggaacugaaaucaggguacaaggauuggauucucuggauaaguuuugccaucagcugcuuccugcuuuguguaguucuguugggauuuauuaugugggcuugccagaaaggcaacauccgguguaauauuugcaucuga

SEQ ID NO: 130575 - RNA, 1701 nt, Artificial Sequence
  derived and/or modified sequence opt3 from hemagglutinin__InfluenzaA__AFG99149
augaagaccaucauugcccugagcuacauacucugccuuguguucgcucagaaccugcccggcaaugacaacuccacagcaacuuuguguuuagggcaccaugccgucccuaauggaacgcugguuaaaaccaucacaaacgaucaaauugaggugacuaaugcgaccgaacuuguacagucuucaaguacagguagaaucugcgacagcccacacaggauucucgauggcaagaacuguacccugaucgacgcucuacugggggauccgcauugcgacggauuucagaaugagaaaugggauuuguucguggaacggucccgcgccuuuucuaacuguuaucccuacgacgucccugauuaugcaucgcuccgaucacugguggccagcaguggcacucuggaguucauaaaugaagguuuuaacuggacagggguuacccaguccggaggcucuuacgcuugcaagcguggcagcgacaauuccuucuuuucaagacucaacugguuauaugagagugagagcaaauacccagugcugaaugucacgaugcccaacaaugggaaguucgauaaguuguauaucuggggagugcaccauccuucuacugacaaagaacaaaccaacuuguacguaagggcauccggucggguuacagugucaacuaagcgcagccagcagaccgucauuccaaacaucggcaguagacccugggugagggggcugucuucccggauuagcaucuacuggacaauagugaaaccuggagauauucuacucaucaauucgaccggcaaccugauugccccacgcgguuauuuuaagauccgaacggggaaaucuuccaucaugagaucagacgcuccgauuggaacuuguaguagcgagugcauaacacccaauggcuccaucccuaacgacaagccauuccagaaugucaacaagauuaccuacggcgccugucccagguauguuaaacaaaauacucuuaagcuggcgacagggaugcggaacgugccugaaaaacagacccguggaaucuuuggugcaauagccggcuucauugagaaugggugggagggaaugguagauggcugguacgguuuucgccaccagaacucugaagggacgggccaggcugccgaccuuaagagcacccaagcagcuaucgaucagaucaauggaaaacucaacagagugauugagaagacaaaugaaaaauuccaccagaucgagaaggaguucucagaagucgagggcaggauucaagaccuggaaaaguauguggaggauacuaaaauagacuuauggaguuacaacgccgaacugcucguugcgcuugagaaucagcauaccaucgaucugacagacgccgaaaugaacaaguuguuugagaaaacucggaagcagcuacgagagaacgcagaagauauggggaauggaugcuucaaaauuuaucacaagugugacaacgcuugcaucgguuccauccgcaauggcaccuacgaucaugacguguacagagacgaggcccugaacaauagguuucagauuaagggggucgaacucaaaagcggauauaaggauuggauacuguggaucucuuucgcuauuucaugcuuucuucugugugugguauugcucggcuucaucaugugggccugccaaaaagguaacauucgguguaauaucugcauauga

SEQ ID NO: 130576 - RNA, 1701 nt, Artificial Sequence
  derived and/or modified sequence opt3 from hemagglutinin__InfluenzaA__AFG99171
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucguggacgcucugcuuggggauccgcauugcgacggauuccagaaugagaaaugggaucuguuugucgaacgguccaaggccuucucuaacuguuaucccuacgacgugccugauuaugcaucguugcgcucacucguugccagcaguggcacucuggaguuuacaaaugaauccuucaacuggaccggugugacgcagucugggggaagcuacgcuugcaaacgaggcuccgacaauucauuuuucagucgucugaacuggcucuaugagagcgagucuaaguacccagucuuaaaugugacuaugcccaacaauggcaacuuugauaagcuguauaucuggggaguacaccauccuuccaccgacaaagaacaaacaaaccuuuacguuagagcaucagggagggugacugucagcaccaagcggaaucagcagacagugauaccaaacaucgguagucgccccugggugagaggcuugucuuccaggauuagcaucuacuggaccauugucaaaccuggggauauccugcuaauaaauucgaacggaaaucucauugccccacggggcuauuucaagauccgcaacgguaaaucuuccauuaugcgaucagacgcuccgaucgggacguguaguagcgagugcaucacucccaauggauccauuccuaacgacaagccauuucagaauguuaacaagauaacauacggcgccugucccaaauaugugaagcaaaauacccugaaacuugcgacuggcaugagaaacguaccugaaaagcagacaagggggaucuucggagcaauugccgguuuuaucgagaauggcugggaggggaugguggauggaugguacggcuuccggcaccguaacucugaagguaccgggcaggcugccgaccugaaaagcacgcaggcagcuauagaucaaauuaauggcaaguugaaccgcgucaucgagaaaaccaacgaaaaguuccaccagaucgagaaggaauuuucagagguggagggaaggauucaggaccucgaaaaauauguugaggauacaaagaucgaccuguggaguuacaaugccgaauuacugguggcgcucgagaaccaacauacuauugaucuuaccgacuccgaaaugaauaaacuguucgagaagacaagacggcaguugcgagagaacgccgaagauaugggcaaugggugcuuuaaaauauaucacaagugugacaacgcaugcaucggaagcauucgcaaugguacuuacgaucaugacgucuacagagacgaggcucuaaacaauagguuccagaucaagggcguggaacugaaaucuggguauaaggauuggauccucuggauuucauuugccauaaguugcuuccugcuuuguguaguucuguugggauuuaucaugugggcuugccagaaaggcaacauucgguguaauaucugcauuuga

SEQ ID NO: 130577 - RNA, 1701 nt, Artificial Sequence
  derived and/or modified sequence opt3 from hemagglutinin__InfluenzaA__AFG99182
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuaugagagugaguacaaguauccagcauuaaacgucacgaugcccaauaacgggaaauuugacaagcuguacaucuggggagugcaccauccuagcacugauaaagaacaaaccaaucuuuacguaagagccucugguaggguuacaguguccacuaagcggucacagcagaccgucauuccaaacaucggcagccgccccugggugagaggguugaguucuaggauuuccaucuauuggacaauagugaaaccuggagacauucugcuaaucaacagcaccggcaaucucauugcuccacgggguuacuucaagauccgcacggggaagucgucuaucaugcgauccgaugccccgauuggaacuuguucaagugagugcauaacacccaacggcagcaucccuaaugacaaaccauuucagaacgucaauaagauuaccuauggcgcgugucccagauacguuaaacaaaacacucugaaacuugcaacagggaugaggaaugugccugaaaagcagacccggggaaucuucggugccauagcuggcuuuauugagaacgggugggagggaaugguagacggcugguaugguuuccgucaccaaaauuccgaagggacgggccaggccgcagaucugaagucuacccaggcugccaucgaccagaucaacggaaaauugaaucgccucauugagaagacaaacgaaaaguuccaccagaucgagaaagaauuuagcgagguggagggcaggauucaagaucuggaaaaguacgucgaggacacuaaaauagauuuauggucauauaaugcggaacugcucguggcccuugagaaccagcauaccaucgaccugacagauagugaaaugaauaaguuguucgagaaaacuagaaagcagcuacgggagaacgcagaagacauggggaacggaugcuuuaagauuuaccacaaaugugauaaugcuugcaucgguuccauccgaaacggcaccuacgaccaugauguuuaucgcgacgaggcccugaauaacagauuccagauuaaggggguggaacucaaaagcggauacaaggacuggauacuguggaucucuuuugcuauuucaugcuuccuucugugugucguguugcucggcuuuaucaugugggccugccaaaaagguaauauuagguguaacaucugcauauga

SEQ ID NO: 130578 - RNA, 1701 nt, Artificial Sequence
  derived and/or modified sequence opt3 from hemagglutinin__InfluenzaA__AFG99193
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacgagaagugggaucuguucguggaacggucuaaagccuuuucgaauuguuaucccuacgacgucccugauuaugcaucauugcgcagccucguggccaguuccggcacucuggaguucauaaacgaagguuuuaauuggacagggguuacccagucuggaggcagcuacgcuugcaagcgaggcuccgugaacucauucuuuagucgucugaauuggcucuaugagagcgagucuaaguacccagcauuaaacgucacgaugcccaauaacgggaaauucgaaaagcuguauaucuggggagugcaccauccuuccacugacaaagagcaaaccaaucuuuacguaagagccucagguaggguuacagugagcacuaagcggagucagcagaccgucauuccaaacaucggcccccgcccuugggugagaggguugucuuccaggauuagcaucuacuggacaauagugaaaccaggagauauucugcuaaucaacucgaccggcaaucucauugcuccgcgggguuauuuuaagauccgcacggggaagucuuccaucaugcgaucagacgcccccauuggaacuuguaguagcgaaugcauaacaccuaacggcuccaucccaaaugauaaacccuuccagaacgucaauaagauuaccuacggcgcguguccuagauauguuaaacaaaacacucugaagcuggcaacagggaugaggaaugugccagagaaacagacccggggaaucuuuggugccauagcuggcuucauugagaacgggugggaaggaaugguagacggcugguacgguuuucgucaccaaaauucugaggggacgggccaggccgcagaccuuaagagcacccaggcugccaucgaucagaucaacggaaaauugaaucgccucauugaaaagacaaacgagaaguuccaccagaucgaaaaagaguucucagagguggaaggcaggauucaagaccuggagaaguaugucgaagauacuaaaauagacuuauggaguuacaaugcggagcugcucguggcccuugaaaaccagcauaccaucgauaugacagacuccgagaugaauaagcuguuugagaaaacuagaaagcaguugcgggaaaacgcagaggauauggggaacggaugcuucaagauuuaucacaaaugugacaaugcuugcaucgguagcauccgaaacggcaccuacgaucaugacguuuaccgcgaugaagcccuaaauaacagauuucagauuaaggggguggagcugaaaucuggauauaaggacuggauacucuggaucucauucgcuauuaguugcuuucugcuuugugucgugcuguugggcuucaucaugugggccugccaaaaagguaauauuagguguaacaucugcauauga

SEQ ID NO: 130579 - RNA, 1701 nt, Artificial Sequence
  derived and/or modified sequence opt3 from hemagglutinin__InfluenzaA__AFG99204
augaagaccaucauugcccugagcuacauauucugccucggcuuugcucagaaacuucccgggaacgacaauuccacagcaacucuguguuugggacaccaugccgugccuaacgguacguuagucaagaccaucacaaaugaucaaauugagguuacuaacgcgaccgaacuggugcagucuucaaguacaggcagaaucugcgacagcccacacaggauucuagaugggaaaaauuguacccucaucgacgcucugcuuggagauccgcauugcgacggcuuccagaacgagaagugggaucuguuuguagaacgguccaaagccuucucuaauuguuaucccuacgacgugccugauuaugcaucguugcgcucacucgucgccagcagugguacucuggaguuuauaaacgaaggguucaauuggacaggagugacccaguccggcggcucuuacgcuugcaagcgagggagcguuaacuccuuuuucucacgucugaauuggcucuauaagagugagagcaaauacccagcauuaaacgugacgaugcccaauaacggaaaguuugacaaacuguauaucugggguguccaccauccuucuacugauaaggagcaaaccaaucuuuacgugagagccuccggcaggguaacaguuucaacuaaacggagccagcagaccgugauuccaaacaucgggagucgccccugggucagaggauugucuuccaggauuagcaucuacuggacaauagugaagccuggcgacauucugcuaaucaacucgaccgguaaucucauugcuccacggggguauuucaagauccgcacgggaaaaucuuccaucauucgaucagaugccccgauaggcacuuguaguagcgaaugcaucacacccaacggcuccauuccuaaugacaagccauuucagaacgugaauaaaaucaccuacggggcgugucccagauaugucaagcaaaacacucugaaacuugcaacaggaaugaggaauguuccugagaagcagacccgggguauauucggcgccauugcuggguuuaucgaaaacggaugggagggcaugguggacgguugguacggguuccgucaccaaaauucugagggcacgggacaggccgcagaucugaaaagcacccaggcugccaucgaccagauuaacggcaaguugaaucgccucaucgaaaagacaaacgagaaauuccaccagauugaaaaggaguuuucagaaguagaggggagaauacaagaucuggagaaauauguggaagacacuaagaucgauuuauggaguuacaaugcggagcugcucgucgcccuugaaaaccagcauaccauugaccugacagauuccgagaugaauaaauuguucgaaaagacuaggaagcagcuacgggagaacgcagaggacaugggaaacgguugcuuuaaaaucuaucacaagugugauaaugcuugcaucggcagcauucgaaacgggaccuacgaccaugauguguaccgcgacgaagcccugaauaacagauuccagauaaaaggaguugagcucaagucuggcuauaaagacuggauccuguggauuucauuugcuaucaguugcuuccuucuguguguggucuugcucgguuuuauuaugugggccugccaaaaggggaauaucagguguaacauaugcaucuga

SEQ ID NO: 130580 - RNA, 1701 nt, Artificial Sequence
  derived and/or modified sequence opt3 from hemagglutinin__InfluenzaA__AFG99215
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuauagaacgguccaaagccuucucuaauuguuaucccuacgacgugccugauuaugcaucguugcgcucacucgucgccagcaguggcacucuggaguuuaucaacgaagguuucaauuggacaggggugacccaguccggaggcucuuacgcuugcaagcgaggcagcguuaacuccuuuuucucacgucugaauuggcucuaugagagugaguacaaguauccagcauuaaacgugacgaugcccaauaacgggaaauuugacaagcuguacauuuggggaguccaccauccuagcacugaaaaagagcaaaccaaucuuuacgugagagccucugguaggguaacaguuuccacuaagcggucacagcagaccgugacaccaaacaucggcagccgccccugggucagaggguugaguucuaggauuuccaucuauuggaccauagugaaaccuggagauauucugcuaaucaacagcacgggcaaucucauugcuccacgggguuacuucaagauccgcacugggaagucgucuaucaugcgauccgacgccccgauuggaacauguucaagugaaugcauaacccccaacggcagcaucccuaaugauaaaccauuucagaacgugaauaagauuacuuauggcgcgugucccagauacgucaaacaaaacacacugaaacuugcaaccgggaugaggaauguuccugagaagcagacgcggggaaucuucggugccauagcuggcuuuauugagaacgggugggaaggaaugguggacggcugguaugguuuccgucaccaaaauuccgaggggaccggccaggccgcagaccugaagucuacacaggcugccaucgaucagaucaacggaaaauugaaucgccucauugaaaagacuaacgagaaguuccaccagaucgaaaaagaguuuagcgagguagaaggcaggauucaagaccuggagaaguacguggaagauaccaaaauagacuuauggucauauaaugcggagcugcucgucgcccuugaaaaccagcauacaaucgaucugacugacagugagaugaauaaguuguucgagaaaaccagaaagcagcuacgggaaaacgcagaggauauggggaacggaugcuuuaagauuuaccacaaaugugacaaugcuugcaucgguuccauccgaaacggcacauacgaucaugacguguaucgcgaugaagcccugaauaacagauuccagauuaaggggguugagcucaaaagcggauacaaggacuggauacuguggaucucuuuugcuauuucaugcuuccuucuguguguggucuugcucggcuuuaucaugugggccugccaaaaagguaauauuagguguaacaucugcauauga

SEQ ID NO: 130581 - RNA, 1701 nt, Artificial Sequence
  derived and/or modified sequence opt3 from hemagglutinin__InfluenzaA__AFG99226
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagguuucaauuggacagggguuacccaguccggaggcucuuacgcuugcaagcgaggcagcgugaacuccuuuuucucacgucugaauuggcucuaugagagugaguacaaguauccagcauuaaacgucacgaugcccaauaacgggaaauuugacaagcuguacaucuggggagugcaccauccuagcacugauaaagaacaaaccaaucuuuacguaagagccucugguaggguuacaguguccacuaagcggucacagcagaccgucauuccaaacaucggcagccgccccugggugagaggguugaguucuaggauuuccaucuauuggacaauagugaaaccuggagacauucugagcaucaacucgaccggcaaucuaauugcuccacgggguuacuucaagauccgcacggggaagucuuccaucaugcgaucagaugccccgauuggaacuuguaguagcgagugcauaacacccaacggcuccaucccuaaugacaaaccauuucagaacgucaauaagauuaccuauggcgcgugucccagauacguuaaacaaaacacucucaagcuggcaacagggaugaggaaugugccugaaaaacagacccggggaaucuucggugccauagcuggcuuuauugagaacgggugggagggaaugguagacggcugguaugguuuccgucaccaaaauucugaagggacgggccaggccgcagaucuuaagagcacccaggcugccaucgaccagaucaacggaaaacugaaucgcuugauugagaagacaaacgaaaaguuccaccagaucgagaaagaauuuucagagguggagggcaggauucaagaucucgaaaaguacgucgaggacacuaaaauagaucuguggaguuauaaugcggaauuacugguggcccucgagaaccagcauaccaucgaccuuacagauuccgaaaugaauaagcuguucgagaaaacuagaaagcaguugcgggagaacgcagaagacauggggaacggaugcuuuaagauuuaccacaaaugugauaaugcuugcaucgguagcauccgaaacggcaccuacgaccaugauguuuaucgcgacgaggcccuaaauaacagauuccagauuaaggggguggaacugaaaucuggauacaaggacuggauacucuggaucucauuugcuauuaguugcuuccugcuuugugucgugcuguugggcuuuaucaugugggccugccaaaaagguaauauuagguguaacaucugcauauga

SEQ ID NO: 130582 - RNA, 1701 nt, Artificial Sequence
  derived and/or modified sequence opt3 from hemagglutinin__InfluenzaA__AFG99237
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagacuucaauuggacagguguuacccaguccgggggaucuuacgcuugcaagcgagagagcgugaacuccuuuuucucacgucugaauuggcucuaugagagugaauacaaguauccagcauuaaacgucacgaugcccaauaacggcaaauuugagaagcuguacaucuggggcgugcaccauccuagcacugauaaagaacaaaccaaucuuuacguaagagccucugggaggguuacaguguccacuaagcggucacagcagaccgucauuccaaacaucggaagccgccccugggugagagguuugaguucuaggauuuccaucuauuggacaauagugaaaccuggcgacauucugcuaaucaacagcaccgggaaucucauugcuccacggggauacuucaagauccgcacgggcaagucgucuaucaugcgauccgaugccccgauugguacuuguucaagugagugcauaacacccaacgggagcaucccuaaugacaaaccauuucagaacgucaauaagauuaccuauggagcgugucccagauacguuaggcaaaacacucugaaacuugcaacaggcaugcggaaugugccugagaagcagacccguggcaucuucggggccauagcuggauuuauugaaaacgguugggagggcaugguagacgggugguauggauuccgccaccaaaauuccgaaggcacgggucaggccgcagaucugaaaucuacccaggcugccaucgaccagaucaacgggaaguugaauagacucauugagaaaacaaacgaaaaguuccaccagaucgagaaggaguuuagcgaaguggagggcaggauucaagaucuggaaaaauacgucgaggacacuaagauagauuuauggucauauaaugcggaacugcucguggcccuugagaaccagcauaccaucgaccugacagauagugagaugaauaaauuguucgaaaagacucggaaacagcuacgagagaacgcagaagacaugggaaacggcugcuuuaagauuuaccacaagugugauaaugcuugcaucggguccauccgcaacggaaccuacgaccaugauguuuauagagacgaggcccugaauaacagguuccagauuaaagguguggaacucaagagcggcuacaaagacuggauacuguggaucucuuuugcuauuucaugcuuccuucugugugucguguugcucggguuuaucaugugggccugccaaaagggaaauauucgguguaacaucugcauauga

SEQ ID NO: 130583 - RNA, 1701 nt, Artificial Sequence
  derived and/or modified sequence opt3 from hemagglutinin__InfluenzaA__AFG99248
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucucacgcuugcaagcgaggcagcgugaacuccuucuuuucacgucugaauuggcuccaugagagugaguauaaguacccagcauuaaacgucacgaugcccaauaacggcaaauucgauaagcuguauaucuggggagugcaccacccuauuacugacagagaacaaaccaaucuuuacguaagggccagcgggcggguuacagugucuacuaaacgcucccagcagaccgucaucccaaacauugguuuuagacccugggugaggggcuugucaagccggaucaguauauacuggacaauugugaagccuggggauauccugcuaauuaacucuaccggaaaucucaucgcuccacgcggcuauuucaaaauccgaaacgguaaguccagcauuaugagaucggacgccccgauagggacguguucuuccgagugcaucacucccaauggaucaauuccuaacgacaagccauuucagaaugucaacaaaaucacauacggcgcgugucccagguauguuaagcaaaauacccugaaacuugcaacuggcaugcggaacgugccugaaaagcagacacgugggauauucggagccauugcugguuuuaucgagaauggcugggaggggaugguagauggaugguacggcuuccgccaucagaacagugaagguaccgggcaggccgcagaccugaaaagcacgcaagcugccaucgaucagauuaauggcaaguugaacagacucaucgagaaaaccaaugaaaaguuccaccagauugagaaggaauuuuccgagguggagggaaggauacaagaccuggaaaaauaugucgaggauacaaagaucgacuuauggucuuacaacgcggaacugcucguggcccuugagaaucagcauacuauugaucugaccgacagcgaaaugaacaaauuguucgagaagacacggaaacagcuacgagagaacgcagaagauaugggcaaugggugcuuuaagaucuaucacaagugugacaacgcuugcaucggaucaauucgcaaugguacuuacgaucacgacguuuacagagacgaggcccugaacaauagguuccagauaaaaggcguggaacucaagaguggguauaaagauuggauccuguggauuuccuuugcuaucagcugcuuccuucugugugucguguugcucggauuuauuaugugggccugccaaaagggcaacauccgguguaauauaugcaucuga

SEQ ID NO: 130584 - RNA, 1701 nt, Artificial Sequence
  derived and/or modified sequence opt3 from hemagglutinin__InfluenzaA__AFG99259
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaguggagguaacuaacgcgaccgaacuggugcagucuucaaguacagguagaauuugcgacagcccacacaggauccuagauggcaaaaauuguacccucauugacgcucugcuuggggauccgcauugcgacggauuccagaacgagaagugggaucuguuugucgaacgguccaaagccuauucuaauuguuaccccuaugacgugccugauuacgcaucguugcgcucacucguugccagcaguggcacucuggaguucaucaacgaagacuuuaauuggacaggugugacccaguccgggggaucuuaugcuugcaagcgaggcagcgucaacuccuucuuuucacgucugaauuggcuccacaagagugaguacaaauauccagcauuaaacgugacgaugcccaauaacggcaaguucgauaaacuguacauauggggaguacaucacccuagcacugacagagagcaaaccaaucuuuacguuagggccucugggcgggugacagucuccacuaagcgcucacagcagaccgugaucccaaacauugguagcagacccugggugaggggcuugaguucucggaucuccauuuauuggacaaucgucaaaccuggggauauacugcuaauuaacagcaccggaaaucucaucgcuccacgcggcuacuuuaagauucgaacggguaagucgucuaucaugagauccgacgccccgaucgggacuuguucaagugaaugcauuacacccaacggaagcauaccuaaugacaaaccauuccagaacguuaauaagaucaccuauggcgcgugucccagguacgugaaacaaaacacucugaaacuugcaacaggcaugcggaauguaccugagaaacagacccgugggauuuuuggagccaucgcugguuucauagaaaacggcugggaggggaugguggauggaugguauggcuuucgccaccaaaauuccgaggguacggggcaggccgcagaccugaagucuacccaggcugccauugaucagaucaacggcaaauugaauagacucaucgaaaagacaaacgagaaguuccaucagauugaaaaagaguucagcgaagucgagggaaggauccaagaccuggagaaguacguggaagauacuaaaauugacuuauggucauauaaugcggagcugcucguugcccuugaaaaccagcacaccauagaucugacagacagugagaugaauaaguuguuugaaaagacucggaagcagcuacgagagaacgcagaggauaugggcaacgggugcuucaagaucuaccauaaaugugacaaugcuugcauuggauccauccgcaacgguaccuacgaucacgacguguauagagacgaagcccugaauaacagguuucagaucaagggcgucgagcucaaaagcggguacaaggauuggauucuguggauaucuuucgcuaucucaugcuuucuucugugugugguauugcucggauucauuaugugggccugccaaaaaggcaauauccgguguaacauuugcaucuga

SEQ ID NO: 130585 - RNA, 1701 nt, Artificial Sequence
  derived and/or modified sequence opt3 from hemagglutinin__InfluenzaA__AFG99270
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacaagagugaguacaaauauccagccuuaaacgucaccaugcccaauaacggcaaguucgauaaacuguacaucuggggagugcaucacccuagcacggacagagagcaaacuaaucuuuacguaagggcuucugggcggguuaccguguccacaaagcgcucacagcagacugucauuccaaacaucgguagcagacccugggugaggggcuugaguucucggauuuccaucuauuggaccauagugaaaccuggggauauucugcuaaucaacagcacaggaaaucucauugccccacgcggcuacuuuaagauccgaaccgguaagucgucuaucaugagauccgacgcgccgauugggacguguucaagugaaugcauaacucccaacggaagcaucccuaaugacaaaccauuccagaacgucaauaggauuacauauggcgcauguccccgguacguuaagcaaaacacccugaaacuugccacuggcaugcguaaugugccugagaagcagacacgcgggaucuuuggagcuauagccgguuucauugaaaacggcugggaggggaugguagauggaugguauggcuuuagacaccauaauuccgaggguaccgggcaggcagcugaccugaaaucuacgcaggccgcgaucgaucaaaucaacggcaaguugaauaggcucauugagaaaaccaacgaaaaguuccaccagaucgaaaaggaguucagcgaaguggagggacggauucaggaccuggagaaauacgucgaagauacaaagauagacuuauggucauauaaugccgagcugcucguggcacuugaaaaccaacauacuaucgaucugaccgacagugagaugaauaaauuguuugaaaagacacgaaaacagcuacgcgagaacgcugaggauaugggcaacgggugcuucaagauuuaccacaagugugacaaugccugcaucggauccaucagaaacgguacuuacgaucacgacguuuauagggacgaagcucugaauaaccgguuucagauuaaaggcguggagcucaagagcggguacaaagauuggauacuguggaucucuuucgccauuucaugcuuucuucugugugucguguugcucggauucaucaugugggcaugccagaagggcaauauucgcuguaacaucugcauauga

SEQ ID NO: 130586 - RNA, 1701 nt, Artificial Sequence
  derived and/or modified sequence opt3 from hemagglutinin__InfluenzaA__AFG99281
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuucucuaauuguuaucccuacgacgucccugauuaugcaucguugcgcucacucguggccagcaguggcacucuggaguuuauaaacgaagaguucaauuggacagguguuacccaguccgggggaucuuacgcuugcaagcgaggcagcgugaacuccuuuuucucacgucugaauuggcuccacaagagugaguauaaauacccagcauuaaacgucacgaugcccaauaacggcagauuugacaagcuguauaucuggggagugcaucacccuagcacugauagggaacaaaccaaucuuuacguacgggccucugggcgcguuacaguguccacuaaaagaucacagcagaccgucauuccaaacaucggucccaggccuugggugcggggcuugagcagucgcauuucuaucuacuggacaauagugaagccaggggacauucugcuaaucaacuccaccggaaaucucauugcuccgcgaggcuauuucaaaauccacacggguaagagcucgaucaugagaucugaugcccccauugggacuuguuccucagagugcauaacaccuaacggaaguaucccaaaugacaagcccuuucagaacgucaauaaaauuaccuacggcgcguguccuagguauguuaagcaaaacacucugaaacuugcaacaggcaugcggaaugugccagacaagcagacccgugggaucuucggagccauagcugguuuuauugaaaacggcugggaggggaugguagauggaugguacggcuuccgccaucagaauagcgaggguacggggcaggccgcagaccugaaauccacccaagcugccaucgaucagaucaacggcaaguugaauagacucauugagaaaacaaacgaaaaguuccaccagaucgaaaaggaguuuucugaaguggagggaaggauucaagaccuggagaaauaugucgaagauacuaagauagacuuauggagcuacaaugcggagcugcucguggcccuugaaaaccagcauaccaucgaucugacagacucagagaugaauaaauuguucgaaaagacucggaaacagcuacgagagaacgcagaggauaugggcaacgggugcuuuaagauuuaucacaagugugacaaugcuugcaucggaaguauccgcaacgguaccuacgaucacgacguuuacagagacgaagcccugaauaacagguuccagauuaaaggcguggagcucaaguccggguauaaagauuggauacuguggaucagcuuugcuauuucuugcuuccuucugugugucguguugcucggauuuaucaugugggccugccaaaagggcaauauucgguguaacaucugcauauga

SEQ ID NO: 130587 - RNA, 1701 nt, Artificial Sequence
  derived and/or modified sequence opt3 from hemagglutinin__InfluenzaA__AFG99292
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaguggagguaacuaacgcgaccgaacuggugcagucuucaaguacagguagaauuugcgacagcccacacaggauccuagauggcaaaaauuguacccucauugacgcucugcuuggggauccgcauugcgacggauuccagaacgagaagugggaucuguuugucgaacgguccaaagccuauucuaauuguuaccccuaugacgugccugauuacgcaucguugcgcucacucguugccagcaguggcacucuggaguucaucaacgaagacuuuaauuggacaggugugacccaguccgggggaucuuaugcuugcaagcgaggcagcgucaacuccuucuuuucacgucugaauuggcuccacgagagugaguacaaguauccagcauuaaacgugacgaugcccaauaacggcaaauucgauaagcuguacauauggggaguacaucacccuagcacugacagagaacaaaccaaucuuuacguuagggccucugggcgggugacagucuccacuaaacgcucacagcagaccgugaucccaaacauugguagcagacccugggugaggggcuugaguucucggaucuccauuuauuggacaaucgucaagccuggggauauacugcuaauuaacagcaccggaaaucucaucgcuccacgcggcuacuuuaaaauucgaacggguaagucgucuaucaugagauccgacgccccgaucgggacuuguucaagugagugcauuacacccaacggaagcauaccuaaugacaagccauuccagaacguuaauaaaaucaccuauggcgcgugucccagguacgugaagcaaaacacucugaaacuugcaacaggcaugcggaauguaccugaaaagcagacccgugggauuuuuggagccaucgcugguuucauagagaacggcugggaggggaugguggauggaugguauggcuuucgccaccaaaauuccgaagguacggggcaggccgcagaccugaaaucuacccaggcugccauugaucagaucaacggcaaguugaauagacucaucgagaaaacaaacgaaaaguuccaucagauugagaaggaguucagcgaagucgagggaaggauccaagaccuggaaaaauacguggaggauacuaagauugacuuauggucauauaaugcggaacugcucguugcccuugagaaccagcacaccauagaucugacagacagugaaaugaauaaauuguuugagaagacucggaaacagcuacgagagaacgcagaagauaugggcaacgggugcuucaagaucuaccauaagugugacaaugcuugcauuggauccauccgcaacgguaccuacgaucacgacguguauagagacgaggcccugaauaacagguuucagaucaaaggcgucgaacucaagagcggguacaaagauuggauucuguggauaucuuucgcuaucucaugcuuucuucugugugugguauugcucggauucauuaugugggccugccaaaagggcaauauccgguguaacauuugcaucuga

SEQ ID NO: 130588 - RNA, 1701 nt, Artificial Sequence
  derived and/or modified sequence opt3 from hemagglutinin__InfluenzaA__AFG99303
augaagaccaucauugcccugagcuacauauucugccucguggucgcucagaaacuucccggcaacgacaauuccacagcaacucuguguuuggggcaccaugccguuccuaacggaacguuagugaagaccaucacaaaugaucaaauugagguaacuaacgcgaccgaacuggugcagucuucaaguacagguagaaucugcgacagcccacacaggauucuagauggcaaaaauuguacccucaucgacgcucugcuuggggauccgcauugcgacggauuucagaacaaggagugggaucuguucgucgaacgguccaaagccuauucuaauuguuaccccuaugacgugccugauuacgcaucguugcgcucacucguugccagcaguggcacucuggaguuuauaaacgaagacuucaauuggacagguguggcucaguccgggggaucuuaugcaugcaagcgaggcagcgucaacuccuuuuucucacgucugaauuggcuccacgagagugaguacaaguauccagccuuaaacgugaccaugcccaauaacggcaaauuugauaagcuguacaucuggggaguacaucacccuagcacggacagagaacaaacuaaucuuuacguuagggcuucugggcgggugaccgucuccacaaaacgcucacagcagacugugauuccaaacaucgguagcagacccugggugaggggcuugaguucucggauuuccaucuauuggaccauagucaagccuggggauauucugcuaaucaacagcacaggaaaucucauugccccacgcggcuacuucaaaauccgaaccgguaagucgucuaucaugagauccgacgcgccgauugggacguguucaagugagugcauaacucccaacggaagcaucuccaaugacaagccuuuucagaacguuaauaggauuacauauggcgcauguccacgguacgugaaacaaaacacccugaagcuggccacuggcaugcguaauguacccgaaaaacagacacgcgggaucuucggagcuauagccgguuuuauugagaacggcugggaggggaugguggauggaugguauggcuucagacaccaaaauucugaagguaccgggcaggcagcugaccuuaagagcacgcaggccgcgaucgaucagaucaacggcaaauugaauaggcucauugagaagaccaacgaaaaauuucaucagaucgagaaggaguucucagaagucgagggacggauucaagaccuggaaaaguacguggaggauacaaaaauagacuuauggaguuauaaugccgaacugcucguugcacuugagaaccagcacacuaucgaucugaccgacuccgaaaugaauaaguuguucgagaaaacacgaaagcagcuacgcgagaacgcugaagauaugggcaacgggugcuuuaaaauuuaccauaagugugacaaugccugcaucggaagcaucagaaacgguacuuacgaucacgacguguauagggacgaggcucugaauaaccgguuccagauuaagggcgucgaacucaaaucuggguacaaggauuggauacuguggaucucauuugccauuaguugcuuccuucugugugugguauugcucggauuuaucaugugggcaugccaaaaaggcaauauucgcuguaacaucugcauauga

SEQ ID NO: 130589 - RNA, 1701 nt, Artificial Sequence
  derived and/or modified sequence opt3 from hemagglutinin__InfluenzaA__AFG99314
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacuccuuccagaacgagaagugggaucuguuuguggaacggucuaaagccuauucgaauuguuaccccuaugacgucccugauuacgcaucauugcgcagccucguggccaguuccggaacucuggaguucauaaacgaagacuuuaauuggacaggcguuacccagucuggugggagcuaugcuugcaagcgaggauccgugaacucauucuuuagucgucugaauuggcuccacgagagcgaguacaaguauccagcauuaaacgucacgaugcccaauaacggcaaauucgauaagcuguacaucuggggcauucaucacccuucuacugacagagaacaaaccaaucuuuacgugagggccuccgggcggguaacaguuucaacuaaacgcagccagcagaccgugaucccaaacauuggaaguagacccugggucagggguuugucuucccggaucagcauauauuggacaauugugaagccuggcgauauccugcuaauuaacucgaccgggaaucucaucgcuccacgcggauacuuuaaacugcgaacgggcaagucuuccaucaugagaucagacgccccgauugguacuuguaguagcgagugcauaacacccaacggguccaucccuaaugacaagccauuccagaacgugaauaaaauuaccuauggagcgugucccagguacgucaagcaaaacacucuuaaacuggcaacaggcaugcggaauguuccugaaaagcagacccguggcaucuuuggggccauagcuggauucauugagaacgguugggagggcaugguggaugggugguauggauuucgccaccaaaauucugaaggcacgggucaggccgcagacuugaaaagcacccaggcugccaucgaucagaucaacgggaagcucaauagacugauugagaaaacaaacgaaaaguuccaucagaucgagaaggaguucucagaaguagagggcaggauucaagacuuagaaaaauacguggaggauacuaagauagaccuguggaguuauaaugcggaacuccuugucgcccuggagaaccagcacaccaucgauuugacagacuccgaaaugaauaaacuauuugagaagacucggaaacagcugcgagagaacgcagaagauaugggaaacggcugcuucaagauuuaccauaagugugacaaugcuugcaucgggagcauccgcaacggaaccuacgaucacgacguguauagagacgaggcccucaauaacagguuucagauuaaagguguugaacugaagucuggcuacaaagauuggauacuuuggaucucauucgcuauuaguugcuuucuguugugugugguccuccugggguucaucaugugggccugccaaaagggaaauauucgguguaacaucugcauauga

SEQ ID NO: 130590 - RNA, 1701 nt, Artificial Sequence
  derived and/or modified sequence opt3 from hemagglutinin__InfluenzaA__AFG99336
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacaagagugaguacaaauauccagccuuaaacgucaccaugcccaauaacggcaaguucgauaaacuguacaucuggggagugcaucacccuagcacggacagagagcaaacuaaucuuuacguaagggcuucugggcggguuaccguguccacaaagcgcucacagcagacugucauuccaaacaucgguagcagacccugggugaggggcuugaguucucggauuuccaucuauuggaccauagugaaaccuggggauauucugcuaaucaacagcacaggaaaucucauugccccacgcggcuacuuuaagauccgaaccgguaagucgucuaucaugagauccgacgcgccgauugggacguguucaagugaaugcauaacucccaacggaagcaucccuaaugacaaaccauuccagaacgucaauaggauuacauauggcgcauguccccgguacguuaagcaaaacacccugaaacuugccacuggcaugcguaaugugccugagaagcagacacgcgggaucuuuggagcuauagccgguuucauugaaaacggcugggaggggaugguagauggaugguauggcuuuagacaccaaaauuccgaggguaccgggcaggcagcugaccugaaaucuacgcaggccgcgaucgaucagaucaacggcaaguugaauaggcucauugagaaaaccaacgaaaaguuccaucagaucgaaaaggaguucagcgaaguggagggacggauucaagaccuggagaaauacgucgaagauacaaagauagacuuauggucauauaaugccgagcugcucguggcacuugaaaaccagcacacuaucgaucugaccgacagugagaugaauaaauuguuugaaaagacacgaaaacagcuacgcgagaacgcugaggauaugggcaacgggugcuucaagauuuaccauaagugugacaaugccugcaucggauccaucagaaacgguacuuacgaucacgacguuuauagggacgaagcucugaauaaccgguuucagauuaaaggcguggagcucaagagcggguacaaagauuggauacuguggaucucuuucgccauuucaugcuuucuucugugugucguguugcucggauucaucaugugggcaugccaaaagggcaauauucgcuguaacaucugcauauga

SEQ ID NO: 130591 - RNA, 1701 nt, Artificial Sequence
  derived and/or modified sequence opt3 from hemagglutinin__InfluenzaA__AFG99347
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacaagccagaguacaaauaucccgccuuaaacgucaccaugccuaauaacggcaaguucgauaaacuguacaucuggggagugcaucacccaaguacggacagagagcaaacuaaucuuuacguaagggcuagcgggcggguuaccgugucuacaaagcgcucccagcagacugucauucccaacaucgguucaagaccuugggugaggggcuugagcagucggauuucuaucuauuggaccauagugaaaccaggggauauucugcuaaucaacuccacaggaaaucucauugccccgcgcggcuacuuuaagauccgaaccgguaagagcucgaucaugagaucugacgcgcccauugggacguguuccucagaaugcauaacuccuaacggaaguaucccaaaugacaaacccuuccagaacgucaauaggauuacauauggcgcauguccucgguacguuaagcaaaacacccugaaacuugccacuggcaugcguaaugugccagagaagcagacacgcgggaucuuuggagcuauagccgguuucauugaaaacggcugggaggggaugguagauggaugguauggcuuuagacaccagaauagcgaggguaccgggcaggcagcugaccugaaauccacgcaagccgcgaucgaucagaucaacggcaaguugaauaggcucauugacaaaaccaacgaaaaguuccaucagaucgagaaggaguucucugaaguggaaggacggauucaagaucuggagaaauacgucgaggacacaaagauagauuuauggagcuauaaugccgaacugcucguggcacuugagaaccagcacacuaucgaccugaccgauucagaaaugaauaaauuguuugagaagacacgaaaacagcuacgcgaaaacgcugaggacaugggcaacgggugcuucaagauuuaccauaagugugauaaugccugcaucggaaguaucagaaacgguacuuacgaccacgacguuuauagggaugaggcucugaauaaccgguuucagauuaaaggcguggaacucaaguccggguacaaagacuggauacuguggaucagcuucgccauuucuugcuuucuucugugugucguguugcucggauucaucaugugggcaugccaaaagggcaauauucgcuguaacaucugcauauga

SEQ ID NO: 130592 - RNA, 1701 nt, Artificial Sequence
  derived and/or modified sequence opt3 from hemagglutinin__InfluenzaA__AFG99358
augaagaccaucauugcccugagccacauacucugccuuguguucgcucagaaacugcccggcaacgacaauuccacagcaacuuuguguuuagggcaucacgccgucccuaacggaacgcugguuaagaccaucacaaaugaucaaauugaggugacuaacgcgaccgaacuuguacagucuucaaguacagguagaaucugcgacagcccacauaggauucucgauggcaaaaauuguacccugaucgacgcucuacugggggauccgcacugcgacggauuucagaacaaggagugggauuuguucguggaacgguccaaagccuacucuaauuguuaucccuacgacgucccugauuaugcaucgcuccgcucacugguggccagcaguggcacucuggaguuuauaaacgaagacuucaauuggacagguguugcucaggaugggggauccuacgcaugcaagcgaggcucugugaacagcuuuuucucccgucucaauugguuacauaagcuggaguauaaauacccagcccuuaacgucaccaugcccaauaacggcaaguuugacaaauuguauaucuggggagugcaccacccuucaacggauagugaccaaacuagccuguacguaagagcuucugggaggguuaccguguccacaaagcggucacagcagacugucaccccaaauauugguagccgccccugggugagaggccuaaguucuaggaucuccauuuacuggacaaucgugaaaccuggggacauacuccugauuaacagcaucggaaaccuuauugccccacggggcuauuucaagauccgcaaugguaagucgucuaucaugcgauccgaugucccgauugggaacuguucaagugagugcauaacccccaauggaagcaucccuaacgacaaaccauuucagaauguuaacagaauuacguacggcgcgugucccagguaugugaagcaaaauacucugaaauuggcaacaggcaugcggaacguaccugaaaagcagacccgugggaucuucggagccauagcugguuuuauugagaauggcugggaagggaugguggauggaugguacggcuuccgccaucagaacuccgaggguacugggcaggccgcagaccucaaaucuacacaagcugccaucgaucagaucaauggcaagcugaacagauuaauugagaaaaccaaugaaaaguuucaccagaucgagaaggaguucagcgaagucgaaggaaggauucaagaccuggagaaauauguggaggauacgaagauagaccucuggucauacaacgcggaacuucugguugccuuggagaaucagcauaccaucgaucuaacagacagugaaaugaacaaacuguucgagaagacucggaaacagcuccgagaaaacgcagaggauaugggcaaugggugcuuuaagauuuaucacaagugugacaacgcuugcaucggauccauccgcaaugguaccuacgaccacgauguguacagagacgaggcccugaacaauagguuccagauuaaaggcgucgaacuuaagagcggguauaaagauuggauacuguggaucucuuuugcuauuucaugcuucuugcucugugugguacuguuaggauuuaucaugugggccugccaaaagggcaacauucgguguaauaucugcauauga

SEQ ID NO: 130593 - RNA, 1701 nt, Artificial Sequence
  derived and/or modified sequence opt3 from hemagglutinin__InfluenzaA__AFG99369
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauugggcugguguugcacaguccgggggaucuuaugccugcaagcgaggcagcgugaacuccuucuuuucacgucugaauuggcuccacgagagugaguacaaguauccagcuuuaaacgucacaaugcccaauaacggcaaauucgauaagcuguacaucuggggagugcaucacccuagcaccgacagagaacaaacgaaucuuuacguaagggccucugggcggguuacuguguccaccaaacgcucacagcagacagucauuccaaacaucgguagcagacccugggugaggggcuugaguucucggauuuccaucuauuggacuauagugaagccuggggauauucugcuaaucaacagcaccggaaaucucauugcgccacgcggcuacuuuaaaauccgaacagguaagucgucuaucaugagauccgacgcaccgauugggaccuguucaagugagugcauaacgcccaacggaagcaucccuaaugacaagccauuccagaacgucaauaggauuacuuauggcgccuguccccgguacguuaaacaaaacacacugaaacuugcuaccggcaugcguaaugugccugaaaagcagacucgcgggaucuuuggagccauagcagguuucauugagaacggcugggaggggaugguagauggaugguauggcuuuagacaccaaaauuccgaagguacagggcaggcugccgaccugaagucuacccaggcggccaucgaucagaucaacggcaaauugaauaggcucauugagaagacgaacgaaaaauuccaucagaucgagaaggaguucagcgaaguggagggacggauucaagaccuggaaaaguacgucgaggauaccaaaauagacuuauggucauauaaugcagaacugcucguggcucuugagaaccagcacacaaucgaucugacugacagugaaaugaauaaguuguuugagaaaacccgaaagcagcuacgcgagaacgccgaagauaugggcaacgggugcuucaaaauuuaccauaagugugacaaugcuugcaucggauccaucagaaacgguacauacgaucacgacguuuauagggacgaggcccugaauaaccgguuucagauuaagggcguggaacucaaaagcggguacaaggauuggauacuguggaucucuuucgcaacuucaugcuuucuucugugugucguguugcucggauucauuaugugggccugccaaaaaggcaauauccgcuguaacauuugcaucuga

SEQ ID NO: 130594 - RNA, 1701 nt, Artificial Sequence
  derived and/or modified sequence opt3 from hemagglutinin__InfluenzaA__AFG99380
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaucuuuacguaagggcuucugggcggguuaccguguccacaaaacgcucacagcagacugucauuccaaacaucgguagcagacccugggugaggggcuugaguucucggauuuccaucuauuggaccauagugaagccuggggauauucugcuaaucaacagcacaggaaaucucauugccccacgcggcuacuuuaaaauccgaaccgguaagucgucuaucaugagauccgacgcgccgauugggacguguucaagugagugcauaacucccaacggaagcaucccuaaugacaagccauuccagaacgucaauaggauuacauauggcgcauguccccgguacguuaaacaaaacacccugaaacuugccacuggcaugcguaaugugccugaaaagcagacacgcgggaucuuuggagcuauagccgguuucauugagaacggcugggaggggaugguagauggaugguauggcuuuagacaccaaaauuccgaagguaccgggcaggcagcugaccugaagucuacgcaggccgcgaucgaucagaucaacggcaaauugaauaggcucauugagaagaccaacgaaaaauuccaucagaucgagaaggaguucagcgaaguggagggacggauucaagaccuggaaaaguacgucgaggauacaaaaauagacuuauggucauauaaugccgaacugcucguggcacuugagaaccagcacacuaucgaucugaccgacagugaaaugaauaaguuguuugagaaaacacgaaagcagcuacgcgagaacgcugaagauaugggcaacgggugcuucaaaauuuaccauaagugugacaaugccugcaucggauccaucagaaacgguacuuacgaucacgacguuuauagggacgaggcucugaauaaccgguuucagauuaagggcguggaacucaaaagcggguacaaggauuggauacuguggaucucuuucgccauuucaugcuuucuucugugugucguguugcucggauucaucaugugggcaugccaaaaaggcaauauucgcuguaacaucugcauauga

SEQ ID NO: 130595 - RNA, 1701 nt, Artificial Sequence; identical to SEQ ID NO: 130594
  derived and/or modified sequence opt3 from hemagglutinin__InfluenzaA__AFG99391

SEQ ID NO: 130596 - RNA, 1701 nt, Artificial Sequence
  derived and/or modified sequence opt3 from hemagglutinin__InfluenzaA__AFG99402
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcuccacaagagugaguacaaauauccagcauuaaacgucacgaugcccaauaacggcaaguucgauaaacuguacaucuggggagugcaucacccuguaacugacagagagcaaaccaaucuuuacguuagggccagcgggcgggugacagucucuacuaagcgcucccagcagaccgugauuccaaacaucgguucaagacccugggugaggggcuugagcagucggauuucuaucuauuggacaauagucaaaccuggggauauucugcuaaucaacuccaccggaaaucucauugcuccacgcggcuacuuuaagauccgaacggguaagagcucgaucaugagaucugacgccccgauugggacuuguuccucagaaugcauaacacccaacggaaguaucccuaaugacaaaccauuccagaacguuaauaagauuaccuauggcgcgugucccagguacgugaaacaaaacacucugaaacuugcaacaggcaugcggaauguaccugagaaacagacccgugggaucuuuggagccauagcugguuucauugaaaacggcugggaggggaugguggauggaugguauggcuuucgccaccagaauagcgaggguacggggcaggccgcagaccugaaguccacccaagcugccaucgaucagaucaacggcaaauugaauagacucauugaaaagacaaacgagaaguuccaucagaucgaaaaagaguucucugaagucgagggaaggauucaagaccuggagaaguacguggaagauacuaaaauagacuuauggagcuauaaugcggagcugcucguugcccuugaaaaccagcacaccaucgaucugacagacucagagaugaauaaguuguuugaaaagacucggaagcagcuacgagagaacgcagaggauaugggcaacgggugcuucaagauuuaccauaaaugugacaaugcuugcaucggaaguauccgcaacgguaccuacgaucacgacguguauagagacgaagcccugaauaacagguuucagauuaagggcgucgagcucaaauccggguacaaggauuggauacuguggaucagcuucgcuauuucuugcuuucuucugugugugguauugcucggauucaucaugugggccugccaaaaaggcaauauucgguguaacaucugcauauga

SEQ ID NO: 130597 - RNA, 1701 nt, Artificial Sequence
  derived and/or modified sequence opt3 from hemagglutinin__InfluenzaA__AFG99413
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaucuuuacguaagggcuucugggcggguuaccguguccacaaaacgcucacagcagacugucauuccaaacaucgguagcagacccugggugaggggcuugaguucucggauuuccaucuauuggaccauagugaagccuggggauauucugcuaaucaacagcacaggaaaucucauugccccacgcggcuacuuuaaaauccgaaccgguaagucgucuaucaugagauccgacgcgccgauugggacguguucaagugagugcauaacucccaacggaagcaucccuaaugacaagccauuccagaacgucaauaggauuacauauggcgcauguccccgguacguuaaacaaaacacccugaaacuugccacuggcaugcguaaugugccugaaaagcagacacgcgggaucuuuggagcuauagccgguuucauugagaacggcugggaggggaugguagauggaugguauggcuuuagacaccaaaauuccgaagguaccgggcaggcagcugaccugaagucuacgcaggccgcgaucgaucagaucaacggcaaauugaauaggcucauugagaagaccaacgaaaaauuccaucagaucgagaaggaguucagcgaaguggagggacggauucaagaccuggaaaaguacgucgaggauacaaaaauagacuuauggucauauaaugccgaacugcucguggcacuugagaaccagcacacuaucgaucugaccgacagugaaaugaauaaguuguuugagaaaacacgacgccagcuaagagagaacgcugaagauaugggcaacgggugcuucaagauuuaccauaaaugugacaaugccugcaucggauccaucaggaacgguacuuacgaucacgacguuuaucgggacgaggcucugaauaaccgcuuucagauuaagggcguggaacucaagagcggguacaaagauuggauacuguggaucucuuucgccauuucaugcuuucuucugugugucguguugcucggauucaucaugugggcaugccaaaagggcaauauuagauguaacaucugcauauga

SEQ ID NO: 130598 - RNA, 1701 nt, Artificial Sequence
  derived and/or modified sequence opt3 from hemagglutinin__InfluenzaA__AFG99424
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacaagagugaguacaaauauccagccuuaaacgucaccaugcccaauaacggcaaguucgauaaacuguacaucuggggagugcaucacccuagcacggacagagagcaaacuaaucuuuacguaagggcuucugggcggguuaccguguccacaaagcgcucacagcagacugucauuccaaacaucgguagcagacccugggugaggggcuugaguucucggauuuccaucuauuggaccauagugaaaccuggggauauucugcuaaucaacagcacaggaaaucucauugccccacgcggcuacuuuaagauccgaaccgguaagucgucuaucaugagauccgacgcgccgauugggacguguucaagugaaugcauaacucccaacggaagcaucccuaaugacaaaccauuccagaacgucaauaggauuacauauggcgcauguccccgguacguuaagcaaaacacccugaaacuugccacuggcaugcguaaugugccugagaagcagacacgcgggaucuuuggagcuauagccgguuucauugaaaacggcugggaggggaugguagauggaugguauggcuuuagacaccaaaauuccgaggguaccgggcaggcagcugaccugaaaucuacgcaggccgcgaucgaucagaucaacggcaaguugaauaggcucauugagaaaaccaacgaaaaguuccaucagaucgaaaaggaguucagcgaaguggagggacggauucaagaccuggagaaauacgucgaagauacaaagauagacuuauggucauauaaugccgagcugcucguggcacuugaaaaccagcacacuaucgaucugaccgacagugagaugaauaaauuguuugaaaagacacgacgccagcuaagagagaacgcugaggauaugggcaacgggugcuucaaaauuuaccauaagugugacaaugccugcaucggauccaucaggaacgguacuuacgaucacgacguuuaucgggacgaagcucugaauaaccgcuuucagauuaagggcguggagcucaaaagcggguacaaggauuggauacuguggaucucuuucgccauuucaugcuuucuucugugugucguguugcucggauucaucaugugggcaugccaaaaaggcaauauuagauguaacaucugcauauga

SEQ ID NO: 130599 - RNA, 1701 nt, Artificial Sequence
  derived and/or modified sequence opt3 from hemagglutinin__InfluenzaA__AFG99435
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagaauagcucaacagguagaaucugcgacaguccacacaggauucuagauggcaaaaacuguacccucaucgacgcucugcuuggggauccgcauugcgacggacugcagaauaaggagugggauuuguucguggaacggagcaaagccuauuccaacuguuaccccuaugacgucccugauuacgcaucucuccgcucgcugguggccucaagcggcacucuggaguuuacaaaggaagacuucaauuggaccgguguugcucagagugggggauccuaugcaugcaagcgaggcucugugaacagcuuuuucucccgucucaauugguuacacgagucagaguacaaauauccagcccugaacgucacgaugcccaauaacggcaaguuugauaaacuuuacauauggggagugcaucacccuaguacugacagagaacaaaccaauuuguacguaagggcuagcgggcggguuacagugucuacuaagcgcucccagcagaccgucaucccaaacauugguucaagacccugggugaggggccugagcagucggaucucuauuuauuggacaaucgugaaaccuggggauauacuacucauuaacuccaccggaaaucugaucgccccacgcggcuacuucaagauucgaacggguaagagcucgaucaugagaucugacgcgccgaucgggacuuguuccucagagugcauuacacccaacggaaguauaccuaaugacaaaccauuucagaacgucaauaggaucaccuauggcgcauguccccgguacguuaagcaaaacacucuuaaacuggccacaggcaugcguaaugugccugaaaagcagacccgcgggauuuucggagcuaucgccgguuuuauagagaacggcugggaggggaugguagauggaugguauggcuucagacaccagaauagcgaagguacggggcaggcagcugacuugaaauccacccaagccgcgauugaucagaucaacggcaagcucaauaggcugaucgagaaaacaaacgaaaaguuucaucagauugagaaggaguucucugaaguggagggacggauccaagacuuagaaaaauacgucgaggauacuaagauugaccuguggagcuauaaugccgaacuccuuguggcacuggagaaccagcacaccauagauuugacagacucagaaaugaauaaacuauucgagaagacucgaaaacagcugcgcgagaacgcugaagauaugggcaacgggugcuuuaagaucuaccauaagugugacaaugccugcauuggaaguaucagaaacgguaccuacgaucacgacguuuauagggacgaggcucucaauaaccgguuccagaucaaaggcguggaacugaaguccggguacaaagauuggauucuuuggauaucuuuugccaucucuugcuuccuguugugugucgugcuccugggauuuauuaugugggcaugccaaaagggcaauauccgcuguaacauuugcaucuga

SEQ ID NO: 130600 - RNA, 1701 nt, Artificial Sequence; identical to SEQ ID NO: 130599
  derived and/or modified sequence opt3 from hemagglutinin__InfluenzaA__AFG99446

SEQ ID NO: 130601 - RNA, 1701 nt, Artificial Sequence
  derived and/or modified sequence opt3 from hemagglutinin__InfluenzaA__AFG99457
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacacaggauucucgauggcgagaauuguacccugaucgacgcccuucugggggauccgcauugcgacggauuucagaacaaagaaugggauuuguucguggagcgguccaaggcuuauucuaauuguuaccccuaugacgucccugauuacgcaucgcuccgcucacugguggccagcaguggcacucuggaauuuauaaacgaggacuucaauuggacagguguugcucaguccgggggaucuuaugcaugcaaacgaggcagcgugaacuccuuuuucucacgucucaauugguuacacaagagugaguacaaguauccagcccugaacgucaccaugcccaauaacggcaaauuugauaaacuuuacaucuggggagugcaucacccuagcacggacagagaucaaacuucuuuguacguaagggcuuccgggcggguuaccgugucaacaaaacgcagccagcagacugucauuccaaauaucgguaguagacccugggugaggggccagucuucccggauuagcaucuauuggaccauagugaagccuggggacauucugcuaaucaacucgacaggaaaccucauugccccacgcggcuacuucaaaauccgaaaugguaagucuuccaucaugagaucagacgcgccgauugggaccuguaguagcgaaugcauaacgcccaacggauccaucccuaaugauaagccauuucaaaacgucaauaggauuacuuauggcgcauguccccgguacguuaaacagaacacacugaaacuugccaccggcaugcguaaugugccugagaagcagacucgcgggaucuucggagcuauagccgguuuuauugaaaacggcugggaggggaugguagacggaugguauggcuucagacaccaaaauucugaggguacagggcaggcagcugaucuaaagagcacccaggccgcgaucgaccagaucaacggcaaauugaauaggcucauugaaaagacgaacgagaaauuucaucaaaucgaaaaggaguucucagaaguggagggacggauucaggaucuggagaaguacgucgaagacaccaaaauagauuuauggaguuauaaugccgagcugcucguggcacuugaaaaccagcacacaaucgaccugacugauuccgagaugaauaaguuguucgaaaagacccgaaagcagcuacgcgagaacgcugaggacaugggcaacgggugcuuuaaaauuuaccauaagugugauaaugccugcaucggaagcaucagaaacgguacauacgaccacgacguuuauagggaugaagcucugaauaaccgguuccaaauuaagggcguggagcucaaaucuggguacaaggacuggauacuguggaucucauuugccauuaguugcuuccuucugugugucguguugcucggauuuaucaugugggcaugccagaaaggcaauauucgcuguaacaucugcauauga

SEQ ID NO: 130602 - RNA, 1701 nt, Artificial Sequence
  derived and/or modified sequence opt3 from hemagglutinin__InfluenzaA__AFG99468
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaucuuuacguaagggcuucugggcggguuaccguguccacaaaacgcucacagcagacugucauuccaaacaucgguagcagacccugggugaggggcuugaguucucggauuuccaucuauuggaccauagugaagccuggggauauucugcuaaucaacagcacaggaaaucucauugccccacgcggcuacuuuaaaauccgaaccgguaagucgucuaucaugagauccgacgcgccgauugggacguguucaagugagugcauaacucccaacggaagcaucccuaaugacaagccauuccagaacgucaauaggauuacauauggcgcauguccccgguacguuaaacaaaacacccugaaacuugccacuggcaugcguaaugugccugaaaagcagacacgcgggaucuuuggagcuauagccgguuucauugagaacggcugggaggggaugguagauggaugguauggcuuuagacaccaaaauuccgaagguaccgggcaggcagcugaccugaagucuacgcaggccgcgaucgaucagaucaacggcaaauugaauaggcucauugagaagaccaacgaaaaauuccaucagaucgagaaggaguucagcgaaguggagggacggauucaagaccuggaaaaguacgucgaggauacaaaaauagacuuauggucauauaaugccgaacugcucguggcacuugagaaccagcacacuaucgaucugaccgacagugaaauggauaaguuguuugagaaaacacgaaagcagcuacgcgagaaugcugaagacaugggcaacgggugcuucaaaauuuaccauaagugugauaacgccugcaucggauccaucagaaaugguacuuacgaccacgacguuuauagggaugaggcucugaacaaucgguuucagauuaagggcguggaacucaaaagcggguacaaggacuggauacuguggaucucuuucgccauuucaugcuuucuucugugugucguguugcucggauucaucaugugggcaugccaaaaaggcaacauucgcuguaauaucugcauauga

SEQ ID NO: 130603 - RNA, 1701 nt, Artificial Sequence
  derived and/or modified sequence opt3 from hemagglutinin__InfluenzaA__AFG99490
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucauagaacgguccaaagccuauucuaauuguuaccccuaugacgugccugauuacgcaucgcuccgcucacuggucgccagcaguggcacucuggaguuuaucaacgaagacuucaauuggacagguguggcucaguccggggagucuuaugcaugcaagcgaggaagcguuaaguccuuuuucucacgucucaacugguuacacgagagugaauacaaauauccagcccugaaugugaccaugcccaacaauggcaaguuugauaaacuuuacauuuggggcguccaucacccuagcacggacagagagcaaacuucuuuguacgugagggcuuccgggcggguaaccguuucaacaaagcgcagccagcagacugugaucccaaacauuggaaguagacccugggucaggggucugucuucccggaucagcauauauuggaccauugugaaaccuggcgauauccuacucauuaauucgacagggaaccugaucgccccacgcggauacuucaagauccgaaccggcaagucuuccauuaugagaucagacgcgccgauagguacguguaguagcgaaugcaucacucccaacggguccauuccuaaugacaaaccauuucagaacgugaauaggaucacauauggagcauguccccgguacgucaagcaaaacacccuuaaacuggccacuggcaugcguaauguuccugagaagcagacacgcggcauauucggggcuauugccggauuuaucgagaacgguugggaaggcaugguggaugggugguauggauucagacaccaaaauucugagggcaccggucaggcagcugacuugaaaagcacgcaggccgcgaucgaucagauuaacgggaagcucaauaggcugaucgagaaaaccaacgaaaaguuucaucagauugaaaaggaguucucagagguagaaggccggauacaagacuuagagaaauacguggaagauacaaagaucgaccuguggaguuauaaugccgagcuccuugucgcacuggaaaaccagcacacuauugauuugaccgacuccgagaugaauaaacuauucgagaagacacgaaaacagcugcgcgaaaacgcugaggauaugggaaauggcugcuuuaagaucuaccauaagugugacaacgccugcaucgggagcauuagaaacggaacuuacgaucacgacguguauagggacgaagcucucaauaaccgguuccagauaaaagguguugagcugaagucuggcuacaaagauuggauccuuuggauuucauuugccaucaguugcuuccuguugugugugguccuccugggguuuauuaugugggcaugccaaaagggaaauauccgcuguaacauaugcaucuga

SEQ ID NO: 130604 - RNA, 1701 nt, Artificial Sequence
  derived and/or modified sequence opt3 from hemagglutinin__InfluenzaA__AFG99501
augaagaccaucauugcccugagcuacauauucugccucguggucgcucagaaacuucccggcaacgacaauuccacagcaacucuguguuuggggcaccaugccguuccuaacggaacguuagugaagaccaucacaaaugaucaaauugagguaacuaacgcgaccgaacuggugcagucuucaaguacagguagaaucugcgacagcccacacaggauucuagauggcaaaaauuguacccucaucgacgcucugcuuggggauccgcauugcgacggauuucagaacaaggagugggaucuguucgucgaacgguccaaagccuauucuaauuguuaccccuaugacgugccugauuacgcaucguugcgcucacucguugccagcaguggcacucuggaguuuauaaacgaagacuucaauuggacagguguggcucaguccgggggaucuuauaccugcaagcgaggcagcgucaacuccuuuuucucacgucugaauuggcuccacgagagugaguacaaguauccagcauuaaacgugacgaugcccaauaacggcaaauuugauaagcuguacaucuggggaguacaucacccuagcacugacagagaacaaaccaaucuuuacguuagggccucugggcgggugacagucuccacuaaacgcucacagcagaccgugauuccaaacaucgguagcagacccugggugaggggcuugaguucucggauuuccaucuauuggacaauagucaagccuggggauauucugcuaaucaacagcaccggaaaucucauugcuccacgcggcuacuucaaaauccgaacggguaagucgucuaucaugagauccgacgccccgauugggacuuguucaagugagugcauaacacccaacggaagcaucuccaaugacaagccuuuucagaacguuaauaggauuaccuauggcgcguguccacgguacgugaaacaaaacacucugaagcuggcaacaggcaugcguaauguacccgaaaaacagacccgcgggaucuucggagccauagcugguuuuauugagaacggcugggaggggaugguggauggaugguauggcuucagacaccaaaauucugaagguacggggcaggccgcagaccuuaagagcacccaggcugccaucgaucagaucaacggcaaauugaauaggcucauugagaagacaaacgaaaaauuucaucagaucgagaaggaguucucagaagucgagggacggauucaagaccuggaaaaguacguggaggauacuaaaauagacuuauggaguuauaaugcggaacugcucguugcccuugagaaccagcacaccaucgaucugacagacuccgaaaugaauaaguuguucgagaaaacucgaaagcagcuacgcgagaacgcagaagauaugggcaacgggugcuuuaaaauuuaccauaagugugacaaugcuugcaucggaagcaucagaaacgguaccuacgaucacgacguguauagggacgaggcccugaauaaccgguuccagauuaagggcgucgaacucaaaucuggguacaaggauuggauacuguggaucucauuugcuauuaguugcuuccuucugugugugguauugcucggauuuaucaugugggccugccaaaaaggcaauauucgcuguaacaucugcauauga

SEQ ID NO: 130605 - RNA, 1701 nt, Artificial Sequence
  derived and/or modified sequence opt3 from hemagglutinin__InfluenzaA__AFG99512
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggauucuuaugcaugcaagcgaggaagcgugaaguccuuuuucucacgucucaacugguuacacgagagugaguacaaauauccagcccugaaugucaccaugcccaacaaugacaaguuugauaaacuuuacaucuggggcgugcaucacccuagcacggacagagaacaaacuucuuuguacauuagggcuuccggccggguaaccguuucaacaaagcgcagccagcagacugugaucccaaacauugggaguagacccugggucaggggacugucuucccggaucagcauauauuggaccauugugaaaccuggugacauccuacucauuaauucgacaggcaaccugaucgccccacgcggguacuucaagauccgaaccggaaagucuuccauuaugagaucagaugcgccgauaggcacguguaguagcgagugcaucacucccaacgguuccauuccuaaugacaaaccauuucagaacgugaauaggaucacauauggggcauguccccgguacgucaagcaaaacacccuuaaacuggccacuggaaugcguaauguuccugaaaagcagacacgcggcauauucggcgcuauugccggguuuaucgagaacggaugggaggguaugguggauggcugguauggguucagacaccaaaauucugaaggaaccggccaggcagcugacuugaaaagcacgcaggccgcgaucgaucagauuaacgguaagcucaauaggcugaucgagaaaaccaacgaaaaguuucaucagauugagaaggaguucucagaaguagaggggcggauacaagacuuagaaaaauacguggaggauacaaagaucgaccuguggaguuauaaugccgaacuccuugucgcacuggagaaccagcacacuauugauuugaccgacuccgaaaugaauaaacuauucgagaagacacgaaaacagcugcgcgagaacgcugaagauaugggcaauggaugcuuuaagaucuaccauaagugugacaacgccugcaucggcagcauuagaaacgggacuuacgaccacgauguguauagggacgaggcucucaauaaccgguuccagauaaaaggaguugaacugaagucugguuacaaagauuggauccuuuggauuucauuugccaucaguugcuuccuguugugugugguccuccugggcuuuauuaugugggcaugccaaaaggggaauauccgcuguaacauaugcaucuga

SEQ ID NO: 130606 - RNA, 1701 nt, Artificial Sequence
  derived and/or modified sequence opt3 from hemagglutinin__InfluenzaA__AFG99523
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagucaauacaaguauccagccuuaaacgucaccaugcccaauaacggcaaauucgauaagcuguacaucuggggagugcaucacccuagcacggacagagagcagacuaaucuuuacguaagggcuucugggcggguuaccguguccacaaaacgcucacagcagacugucauuccaaacaucgguagcagacccugggugaggggcuugaguucucggauuuccaucuauuggaccauagugaagccuggggauauucugcuaaucaacagcacaggaaaucucauugccccacgcggcuacuuuaaaauccgaaccgguaagucgucuaucaugagauccgacgcgccgauugggacguguucaagugaaugcauaacucccaacggaagcaucccuaaugacaagccauuccaaaacgucaauaggauuacauauggcgcauguccccgguacguuaaacagaacacccugaaacuugccacuggcaugcguaaugugccugagaaacagacacgcgggaucuuuggagcuauagccgguuucauugaaaacggcugggaggggaugguagauggaugguauggcuuuagacaccaaaauuccgaggguaccgggcaggcagcugaccugaagucuacgcaggccgcgaucgaucagaucaacggcaaauugaauaggcucauugaaaagaccaacgagaaauuccaucaaaucgaaaaggaguucagcgaaguggagggacggauucaggaccuggagaaguacgucgaagauacaaaaauagacuuauggucauauaaugccgagcugcucguggcacuugaaaaccagcacacuaucgaucugaccgacagugagaugaauaaguuguuugaaaagacacgaaagcagcuacgcgagaacgcugaggauaugggcaacgggugcuucaaaauuuaccauaagugugacaaugccugcaucggauccaucagaaacgguacuuacgaucacgacguuuauagggacgaagcucugaauaaccgguuucaaauuaagggcguggagcucaaaagcggguacaaggauuggauacuguggaucucuuucgccauuucaugcuuucuucugugugucguguugcucggauucaucaugugggcaugccagaaaggcaauauucgcuguaacaucugcauauga

SEQ ID NO: 130607 - RNA, 1701 nt, Artificial Sequence; identical to SEQ ID NO: 130503
  derived and/or modified sequence opt3 from hemagglutinin__InfluenzaA__AFG99534

SEQ ID NO: 130608 - RNA, 1701 nt, Artificial Sequence; identical to SEQ ID NO: 130503
  derived and/or modified sequence opt3 from hemagglutinin__InfluenzaA__AFG99545

SEQ ID NO: 130609 - RNA, 1701 nt, Artificial Sequence
  derived and/or modified sequence opt3 from hemagglutinin__InfluenzaA__AFG99556
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagacuucaauuggaccgguguugcucaguccggggagucuuaugcaugcaagcgaggaagcgugaaguccuuuuucucacgucucaacugguuacacgagagugauuacaaauauccagcccugaaugucacgaugcccaacaauggcaaguuugacaaacuuuacauauggggcgugcaucacccuagcacugauagagaacaaaccucuuuguacguaagggcuuccgggcggguuacagugucaacuaagcgcagccagcagaccgucaucccaaacauuggaaguagacccugggugaggggucugucuucccggaucagcauuuauuggacaaucgugaaaccuggcgacauacuacucauuaauucgaccgggaaccugaucgccccacgcggauacuucaagauucgaacgggcaagucuuccaucaugagaucagacgcgccgaucgguacuuguaguagcgagugcauuacacccaacggguccauaccuaaugauaaaccauuucagaacgucaauaggaucaccuauggagcauguccccgguacguuaagcaaaacacucuuaaacuggccacaggcaugcguaaugugccugaaaagcagacccgcggcauuuucggggcuaucgccggauuuauagagaacgguugggagggcaugguagacgggugguauggauucagacaccaaaauucugaaggcacgggucaggcagcugauaggaaaagcacccaggccgcgauugaccagaucaacgggaaguugaaucggcucaucgagaaaacaaacgaaaaguuucaucagauugagaaggaguucucagaaguggagggccgaauccaagaucuggaaaaauacgucgaggacacuaagauugauuuauggaguuauaaugccgaacugcucguggcacuugagaaccagcacaccauagaccugacagauuccgaaaugaauaaauuguucgagaagacucgcaaacagcuaagagagaacgcugaagacaugggaaauggcugcuuuaagaucuaccauaagugugauaacgccugcauugggagcaucaggaacggaaccuacgaccacgacguuuaucgggaugaggcucugaauaaccgcuuccagaucaaagguguggaacucaagucuggcuacaaagacuggauucuguggauaucauuugccaucaguugcuuccuucugugugucguguugcucggguuuauuaugugggcaugccaaaagggaaauaucagauguaacauuugcaucuga

SEQ ID NO: 130610 - RNA, 1701 nt, Artificial Sequence; identical to SEQ ID NO: 130503
  derived and/or modified sequence opt3 from hemagglutinin__InfluenzaA__AFG99567

SEQ ID NO: 130611 - RNA, 1701 nt, Artificial Sequence; identical to SEQ ID NO: 130503
  derived and/or modified sequence opt3 from hemagglutinin__InfluenzaA__AFG99578

SEQ ID NO: 130612 - RNA, 1701 nt, Artificial Sequence; identical to SEQ ID NO: 130503
  derived and/or modified sequence opt3 from hemagglutinin__InfluenzaA__AFG99589

SEQ ID NO: 130613 - RNA, 1701 nt, Artificial Sequence
  derived and/or modified sequence opt3 from hemagglutinin__InfluenzaA__AFG99600
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacagggugcucgauggcaaaaauuguacccugauugacgcucuacugggggauccgcauugcgacggauuucagaacaaggagugggauuuguucgucgaacgguccaaagccuauucuaauuguuaccccuaugacgugccugauuacgcaucgcuccgcucacugguugccagcaguggcacucuggaguuuacaaacgaagacuucaauuggaccgguguggcucaguccggggagucuuaugcaugcaagcgaggaagcgucaaguccuuuuucucacgucucaacugguuacacgagagugauuacaaauauccagcccugaaugugacgaugcccaacaauggcaaguuugacaaacuuuacaucuggggcguacaucacccuagcacugauagagaacaaaccucuuuguacguuagggcuuccgggcgggugacagucucaacuaagcgcagccagcagaccgugauaccaaacaucggaaguagacccugggugaggggucugucuucccggauuagcaucuauuggacaauugucaaaccuggcgacauccuacucauaaauucgaccgggaaccugauugccccacgcggauacuucaagauccgaauuggcaagucuuccaucaugagaucagacgcgccgaucgguacguguaguagcgagugcauuacucccaacggguccauaccuaaugauaaaccauuucagaacguuaauaggaucacauauggagcauguccccgguacgugaagcaaaacacccuuaaacuggccacuggcaugcguaauguaccugaaaagcagacacgcggcauuuucggggcuaucgccggauuuauagagaacgguugggagggcaugguggacgggugguauggauucagacaccaaaauucugaaggcaccggucaggcagcugauuugaaaagcacgcaggccgcgauugaccagaucaacgggaagcucaauaggcugaucgagaaaaccaacgaaaaguuucaucagauugagaaggaguucucagaagucgagggccggauccaagauuuagaaaaauacguggaggacacaaagauugaucuguggaguuauaaugccgaacuccuuguugcacuggagaaccagcacacuauagacuugaccgauuccgaaaugaauaaacuauucgagaagacacgaaaacagcugcgcgagaacgcugaagacaugggaaauggcugcuuuaagaucuaccauaagugugauaacgccugcauugggagcaucagaaacggaacuuacgaccacgacguguauagggaugaggcucucaauaaccgguuccagaucaaaggugucgaacugaagucuggcuacaaagacuggauucuuuggauaucauuugccaucaguugcuuccuguugugugugguacuccugggguuuauuaugugggcaugccaaaagggaaauauccgcuguaacauuugcaucuga

SEQ ID NO: 130614 - RNA, 1701 nt, Artificial Sequence; identical to SEQ ID NO: 130503
  derived and/or modified sequence opt3 from hemagglutinin__InfluenzaA__AFG99611

SEQ ID NO: 130615 - RNA, 1701 nt, Artificial Sequence; identical to SEQ ID NO: 130503
  derived and/or modified sequence opt3 from hemagglutinin__InfluenzaA__AFG99622

SEQ ID NO: 130616 - RNA, 1701 nt, Artificial Sequence; identical to SEQ ID NO: 130503
  derived and/or modified sequence opt3 from hemagglutinin__InfluenzaA__AFG99633

SEQ ID NO: 130617 - RNA, 1701 nt, Artificial Sequence
  derived and/or modified sequence opt3 from hemagglutinin__InfluenzaA__AFG99644
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaauaguucaacagguagaaucugcgacaguccacacaggauucucgauggcaaaaacuguacccugaucgacgcucuacugggggauccgcauugcgacgauuuucagaauaaggagugggacuuguucguggaacggagcaaagccuauuccaacuguuaccccuaugaugucccugacuacgcaucucuccgcucgcugguggccgcuucaggaacucuggaguuuauaaaugaagauuucaacuggacaggcguugcacagagcggugagaguuaugccugcaagcgaggguccgugaagucuuucuuuagccgucucaauugguuacacgaguccgaauacaaauauccagcucugaacgucaccaugcccaauaacggaaaguuugacaaacuuuacaucuggggcgugcaucacccuucaacggauagagagcaaacuucuuuguacguaagggccagcggccggguuaccgugucuacaaagcgcucccagcagacugucauuccaaauaucgggucaagacccugggugaggggacugagcagucggauuucuaucuauuggaccauagugaaaccuggugacauucuacucaucaacuccacaggcaaccugauugcgccacgcggguacuucaagauccgaaccggaaagagcucgaucaugagaucugacgcaccgauuggcacguguuccucagaaugcauaacucccaaugguaguaucccuaacgauaaaccauuucagaaugucaacaggauuacauauggggccuguccccgguacguuaagcaaaauacccuuaaacuggcuacuggaaugcguaacgugccugagaagcagacacgcggcaucuucggcgccauagcaggguuuauugagaauggaugggaagguaugguagacggcugguauggguucagacaccagaacagcgagggaaccggccaggcugccgauuugaaauccacgcaagcggccaucgaccagaucaaugguaagcucaacaggcugauugagaaaaccaaugaaaaguuucaucagaucgaaaaggaguucucugagauugaagggcggauacaaaacuuagagaaauacguggaagauacaaagaucgaccuguggagcuauaaugcagagcuccuugucgcucuggaaaaccagcacacuauugauuugaccgacucagagaugaauaaacuauucgagaagacacgaaaacagcugcgcgaaaacgccgaggauaugggcaacggaugcuuuaagaucuaccauaagugugacaaugcuugcaucggcaguauuagaaacgggacuuacgaucacgacguguauagggacgaagcccucaauaaccgguuccagauaaaaggaguugagcugaaguccgguuacaaagauuggauccuuuggauuagcuuugcaaucucuugcuuccuguugugugugguccuccugggcuuuauuaugugggccugccaaaaggggaauauccgcuguaacauaugcaucuga

SEQ ID NO: 130618 - RNA, 1701 nt, Artificial Sequence
  derived and/or modified sequence opt3 from hemagglutinin__InfluenzaA__AFG99655
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaaaauucuucaacagguagaaucugcgacaguccacacaggauucucgauggcaaaaacuguacccugaucgacgcucuacugggggauccgcauugcgacgauuuucagaauaaggagugggacuuguucguggaacggagcaaagccuauuccaacuguuaccccuaugaugucccugacuacgcaucucuccgcucgcugguggccucaagcggaacucuggaguuuauaaaugaagauuucaacuggacaggcguugcucagaguggugaguccuaugcaugcaagcgagggucugucaagagcuuuuucucccgucucaauugguuacacgagucagaauacaaauauccagcccugaacgugaccaugcccaauaacggaaaguuugacaaacuuuacaucuggggcgugcaucacccuaguacggauagagagcagacuagcuuguacguaagggcuucuggccggguuaccguguccacaaagcgcucacagcagacugucauuccaaauaucgggagcagacccugggugaggggacugaguucucggauuuccaucuauuggaccauagugaaaccuggugacauucuacucaucaacagcacaggcaaccugauugccccacgcggguacuucaagauccgaaccggaaagucgucuaucaugagauccgacgcgccgauuggcacguguucaagugaaugcauaacucccaaugguagcaucccuaacgauaaaccauuucagaaugucaacaggauuacauauggggcauguccccgguacguuaagcaaaauacccuuaaacuggccacuggaaugcguaacgugccugagaagcagacacgcggcaucuucggcgcuauagccggguuuauugagaauggaugggaagguaugguagacggcugguauggguucagacaccagaacuccgagggaaccggccaggcagcugauuugaaaucuacgcaagccgcgaucgaccagaucaaugguaagcucaacaggcugauugaaaagaccaaugagaaguuucaucagaucgaaaaggaguucagcgagauugaagggcggauacaagauuuagagaaauacguggaagacacaaagaucgaucuguggucauauaacgccgagcuccuugucgcacuggaaaaucagcacacuauugacuugaccgauagugagaugaacaaacuauucgagaagacacgaaaacagcugcgcgaaaaugcugaggacaugggcaacggaugcuuuaagaucuaccauaagugugauaacgccugcaucggcuccauuagaaaugggacuuacgaccacgacguguauagggaugaagcucucaacaaucgguuccagauaaaaggaguugagcugaaaagcgguuacaaagacuggauccuuuggauuucuuuugccaucucaugcuuccuguugugugugguccuccugggcuuuauuaugugggcaugccaaaaggggaacauccgcuguaauauaugcaucuga

SEQ ID NO: 130619 - RNA, 1701 nt, Artificial Sequence; identical to SEQ ID NO: 130618
  derived and/or modified sequence opt3 from hemagglutinin__InfluenzaA__AFG99666

SEQ ID NO: 130620 - RNA, 1701 nt, Artificial Sequence; identical to SEQ ID NO: 124354
  derived and/or modified sequence opt3 from hemagglutinin__InfluenzaA__AFG99677

SEQ ID NO: 130621 - RNA, 1701 nt, Artificial Sequence; identical to SEQ ID NO: 130503
  derived and/or modified sequence opt3 from hemagglutinin__InfluenzaA__AFG99688

SEQ ID NO: 130622 - RNA, 1701 nt, Artificial Sequence
  derived and/or modified sequence opt3 from hemagglutinin__InfluenzaA__AFG99701
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaugccuauucuaacuguuaccccuaugacgucccugauuacgcaucgcuccgcucacugguggccagcaguggcacucuggaguuuacaaaugaagacuucaacuggaccgguguugcucaguccggggagucuuaugcaugcaaacgaggaagcgugaaguccuuuuucucacgucucaauugguuacacgagagugauuacaaguauccagcccugaacgucacgaugcccaauaacggcaaauuugacaaguuguacauauggggcgugcaucacccuagcacugauagagaacaaaccucuuuguacguaagggcuuccgggcggguuacagugucaacuaaacgcagccagcagaccgucaucccaaauauuggaaguagacccugggugaggggucugucuucccggaucagcauuuauuggacaaucgugaagccuggcgacauacuacucauuaacucgaccgggaaccugaucgccccacgcggauacuucaaaauucgaacgggcaagucuuccaucaugagaucagacgcgccgaucgguacuuguaguagcgagugcauuacacccaauggguccauaccuaacgauaagccauuucagaaugucaacaggaucaccuauggagcauguccccgguacguuaaacaaaauacucuuaagcuggccacaggcaugcguaacgugccugaaaaacagacccgcggcauuuucggggcuaucgccggauuuauagagaaugguugggagggcaugguagacgggugguauggauucagacaccagaacucugaaggcacgggucaggcagcugaucuuaagagcacccaagccgcgauugaccagaucaaugggaaacucaacaggcugaucgagaagacaaaugaaaaauuucaucagauugagaaggaguucucagaaguggagggccggauccaagauuuagaaaaguacgucgaggacacuaaaauugaucuguggaguuauaacgccgaacuccuuguggcacuggagaaucagcacaccauagacuugacagauuccgaaaugaacaagcuauucgagaaaacucgaaagcagcugcgcgagaaugcugaagacaugggaaacggcugcuuuaaaaucuaccauaagugugauaacgccugcauugggagcaucagaaauggaaccuacgaccacgacguuuauagggaugaggcucucaacaaucgguuccagaucaagggugccgaacugaaaucuggcuacaaggacuggauucuuuggauaucauuugcaaucaguugcuuccuguugugugugguccuccugggguuuauuaugugggccugccaaaaaggaaacauccgcuguaauauuugcaucuga

SEQ ID NO: 130623 - RNA, 1701 nt, Artificial Sequence
  derived and/or modified sequence opt3 from hemagglutinin__InfluenzaA__AFG99712
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugaggucccugacuacgcaucgcuccgcucacugguggccagcaguggcacucuggaauuuacaaacgaggauuucaauuggaccgguguugcucaguccggggagucuuaugcaugcaagcgaggaagcgugaaguccuuuuucucacgucucaacugguuacacgaaagugacuacaaauauccagcccugaaugucacgaugcccaacaauggcaaguuugauaaacuuuacauauggggcgugcaucacccuagcacugacagagagcaaaccucuuuguacguaagggcuuccgggcggguuacagugucaacuaagcgcagccagcagaccgucaucccaaacauuggaaguagacccugggugaggggucugucuucccggaucagcauuuauuggacaaucgugaaaccuggcgauauacuacucauuaauucgaccgggaaccugaucgccccacgcggauacuucaagauucgaacgggcaagucuuccaucaugagaucagacgcgccgaucgguacuuguaguagcgaaugcauuacacccaacggguccauaccuaaugacaaaccauuucagaacgucaauaggaucaccuauggagcauguccccgguacguuaagcaaaacacucuuaaacuggccacaggcaugcguaaugugccugagaagcagacccgcggcauuuucggggcuaucgccggauuuauagagaacgguugggaaggcaugguagaugggugguauggauucagacaccaaaauucugagggcacgggucaggcagcugacuugaaaagcacccaggccgcgauugaucagaucaacgggaagcucaauaggcugaucgagaaaacaaacgaaaaguuucaucagauugaaaaggaguucucagagguggaaggccggauccaagacuuagagaaauacgucgaagauacuaagauugaccuguggaguuauaaugccgagcuccuuguggcacuggaaaaccagcacaccauagauuugacagacuccgagaugaauaaacuauucgagaagacucgaaaacagcugcgcgaaaacgcugaggauaugggaaauggcugcuuuaagaucuaccauaagugugacaacgccugcauugggagcaucagaaacggaaccuacgaucacgacguuuauagggacgaagcucucaauaaccgguuccagaucaaagguguggagcugaagucuggcuacaaagauuggauucuuuggauaucauuugccaucaguugcuuccuguugugugucgugcuccugggguuuauuaugugggcaugccaaaagggaaauauccgcuguaacauuugcaucuga

SEQ ID NO: 130624 - RNA, 1701 nt, Artificial Sequence; identical to SEQ ID NO: 130503
  derived and/or modified sequence opt3 from hemagglutinin__InfluenzaA__AFG99723

SEQ ID NO: 130625 - RNA, 1701 nt, Artificial Sequence; identical to SEQ ID NO: 130618
  derived and/or modified sequence opt3 from hemagglutinin__InfluenzaA__AFG99734

SEQ ID NO: 130626 - RNA, 1701 nt, Artificial Sequence
  derived and/or modified sequence opt3 from hemagglutinin__InfluenzaA__AFG99745
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggauucuuaugcaugcaagcgaggaagcgugaaguccuuuuucucacgucucaacugguuacacgagagugaguacaaauauccagcccugaaugucaccaugcccaacaaugacaaguuugauaaacuuuacaucuggggcgugcaucacccuagcacggaaagagagcaaacuucuuuguacauuagggcuuccggccggguaaccguuucaacaaagcgcagccagcagacugugaucccaaacauugggaguaaacccugggucagaggacugucuuccaggaucagcauauauuggaccauugugaagccuggugacauccuacucauuaauucgacaggcaaccugaucgccccacggggguacuucaagauccgcaccggaaaaucuuccauuaugcgaucagacgcgccgauaggcacguguaguagcgaaugcaucacucccaacgguuccauuccuaaugauaagccauuucagaacgugaauagaaucacauauggggcaugucccagguacgucaaacaaaacacccuuaagcuggccacuggaaugcggaauguuccugagaaacagacacguggcauauucggcgcuauugccggguuuaucgagaacggaugggaagguaugguggacggcugguauggguuccgccaccagaauagcgagggaaccggccaggcagcugauuugaagucuacgcaagccgcgaucgaccagauuaacgguaaacucaauagacugaucgaaaagaccaacgagaaguuucaucagauugaaaaagaguucucagagguagaagggaggauacaagauuuagagaaguacguggaagacacaaaaaucgaucuguggaguuauaaugccgagcuccuugucgcacuggaaaaccagcacacuauugacuugaccgauuccgagaugaauaagcuauucgagaaaacacggaagcagcugcgagaaaacgcugaggacaugggcaauggaugcuuuaagaucuaccauaaaugugauaacgccugcaugggcagcauccgcaacgggacuuacgaccacgacguguauagagaugaagcucucaauaacagguuccagauuaagggaguugagcugaaaucugguuacaaggacuggauacuuuggaucucauuugccauuaguugcuuccuguugugugugguccuccugggcuuuaucaugugggcaugccaaaaagggaauauucgguguaacaucugcauauga

SEQ ID NO: 130627 - RNA, 1701 nt, Artificial Sequence; identical to SEQ ID NO: 130503
  derived and/or modified sequence opt3 from hemagglutinin__InfluenzaA__AFG99756

SEQ ID NO: 130628 - RNA, 1701 nt, Artificial Sequence
  derived and/or modified sequence opt3 from hemagglutinin__InfluenzaA__AFG99767
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacgauuuucagaacaaggagugggacuuguucguggaacgguccaaagccuauucuaauuguuaccccuaugaugucccugacuacgcaucgcuccgcucacugguggccagcaguggaacucuggaguuuauaaacgaagauuucaauuggacaggcguugcucaguccggugagucuuaugcaugcaagcgagggagcgugaaguccuuuuucucacgucucaacugguuacacgagagugaauacaaauauccagcccugaaugucaccaugcccaacaaugacaaguuugauaaacuuuacaucuggggagugcaucacccuagcacggacagagagcaaacuucuuuguacauuagggcuuccggccggguaaccguuucaacaaagcgcagccagcagacugugaucccaaacauuggcaguagacccugggucagggggcugucuucccggaucagcauauauuggaccauugugaaaccuggagacauccuacucauuaauucgacagguaaccugaucgccccacgcggcuacuucaagauccgaaccgggaagucuuccauuaugagaucagaugcgccgauaggaacguguaguagcgaaugcaucacucccaacggcuccauuccuaaugacaaaccauuucagaacgugaauaggaucacauauggugcauguccccgguacgucaagcaaaacacccuuaaacuggccacugggaugcguaauguuccugagaagcagacacgcggaauauucggcgcuauugccggcuuuaucgagaacgggugggaaggaaugguggaugguugguauggcuucagacaccaaaauucugaggggaccggacaggcagcugacuugaaaagcacgcaggccgcgaucgaucagauuaacggcaagcucaauaggcugaucgagaaaaccaacgaaaaguuucaucagauugaaaaggaguucucagagguagaaggucggauacaagacuuagagaaauacguggaagauacaaagaucgaccuguggaguuauaaugccgagcuccuugucgcacuggaaaaccagcacacuauugauuugaccgacuccgagaugaauaaacuauucgagaagacacgaaaacagcugcgcgaaaacgcugaggauauggggaauggcugcuuuaagaucuaccauaagugugacaacgccugcaucggaagcauuagaaacggcacuuacgaccacgauguguauagggacgaagcucucaauaaccgguuccagauaaaagggguugagcugaagucuggauacaaagauuggauccuuuggauuucauuugccaucaguugcuuccuguugugugugguccuccuggguuuuauuaugugggcaugccaaaagggcaauauccgcuguaacauaugcaucuga

SEQ ID NO: 130629 - RNA, 1701 nt, Artificial Sequence
  derived and/or modified sequence opt3 from hemagglutinin__InfluenzaA__AFG99778
augaagaccaucauugcccugagcuacauacucugccuuguguucgcucagaaacugcccggcaacgacaauuccacagcaacuuuguguuuagggcaccaugccgucccuaacggaacgcugguuaagacccuaacaaaugaucaaaucgaggugacuaacgcgaccgaacucguacagucuucaaguacagguaaaauuugcgacagcccacacagaauccuggauggcaagaauuguacccuuauugacgcucuguugggggauccgcauugcgacggacuccagaacaaagagugggaucuguuuguggaaagguccaaggccuauucuaauuguuaccccuaugacgucccugauuacgcaucgcugcggucacucguggccagcaguggcacuuuagaguucaucaacgaagacuuuaauuggacagguguugcucaggaugggggauccuaugcaugcaagcgcggcucugugaacagcuucuuuucccgacugaauuggcuucacaaaucagaguacaaguauccagccuugaacgucaccaugcccaauaacggcaaaguggacaagcuguacauauggggaguacaucacccuaguacggaucgugaccaaacuagccuauacguuagagcuucugggagggugaccgucuccacaaaacggucacagcagacugugaucccaaauauugguagccgccccugggugagaggccagaguucuaggaucuccauuuauuggaccaucgucaagccuggggacauacuccugauuaacagcacaggaaaccuuaucgccccacggggcuacuucaagauucgcaaugguaaaucgucuaucaugcgauccgaugcgccgaucgggaccuguucaagugagugcauuacgcccaacggaagcauaccuaaugacaagccauuucaaaacguuaauagaaucacuuauggcgcaugucccagguacgugaaacagaacacacugaaguuggccaccggcaugcggaauguaccugaaaaacagacucgugggauuuucggagcuaucgccgguuuuauagagaacggcugggaagggaugguggauggaugguauggcuuccgccaccaaaauuccgaggguacagggcaggcagcugaccucaagucuacccaggccgcgauugaucagaucaacggcaaacugaauagauuaaucgagaagacgaacgaaaaguuucaucaaauugagaaagaguucagcgaagucgaaggaaggauccaggaccuggagaaguacguggaggauaccaaaauugaccucuggucauauaaugccgaacuucugguugcauuggagaaccagcacacaauagaucuaacugacagugaaaugaauaagcuguuugagaaaacccggaagcagcuccgagaaaacgcugaggauaugggcaacgggugcuucaagaucuaccauaaaugugacaaugccugcauuggauccauccgcaacgguacauacgaccacgauguguauagagacgaggcucugaauaacagguuccaaaucaagggcgucgaacuuaaaagcggguacaaggauuggauucuguggauaucuuuugccaucucaugcuucuugcucugugugguacuguuaggauuuauuaugugggcaugccagaaaggcaauauccgguguaacauuugcaucuga

SEQ ID NO: 130630 - RNA, 1701 nt, Artificial Sequence; identical to SEQ ID NO: 130503
  derived and/or modified sequence opt3 from hemagglutinin__InfluenzaA__AFG99789

SEQ ID NO: 130631 - RNA, 1701 nt, Artificial Sequence; identical to SEQ ID NO: 130618
  derived and/or modified sequence opt3 from hemagglutinin__InfluenzaA__AFG99800

SEQ ID NO: 130632 - RNA, 1701 nt, Artificial Sequence
  derived and/or modified sequence opt3 from hemagglutinin__InfluenzaA__AFG99811
augaagaccaucauugcccugagcuacauacucugccuuguguucucccagaaacugcccggcaacgacaauucuacagcuacuuuguguuuagggcaccaugcagucccuaacggaacgcugguuaagaccaucacaaaugaucaaauugaggugacuaacgccaccgagcuaguacaaaauucaaguacagguagaaucugcgacagcccacacaggauucucgauggcaaaaacuguacccugaucgacgcgcuucugggggauccgcauugcgacgauuuucagaauaaggaaugggacuuguucguggaacgguccaaggcuuauucuaacuguuaccccuaugaugucccugacuacgccucgcuccgcucacugguggcaagcaguggaacucuggaguuuauaaaugaagauuucaacuggacaggcguugcccaguccggugagucuuaugcuugcaaacgagggagcgugaaguccuuuuucucacgucucaauugguuacacgagagugaauacaaauauccagcacugaacgucaccaugcccaauaacggaaaguuugacaaacuuuacaucuggggcgugcaucacccuagcacggauagagagcagacuucuuuguacguaagggccuccggccggguuaccgugucaacaaagcgcagccagcagacugucauuccaaauaucgggaguagacccugggugaggggacugucuucccggauuagcaucuauuggaccauagugaaaccuggugacauucuacucaucaacucgacaggcaaccugauugcuccacgcggguacuucaagauccgaaccggaaagucuuccaucaugagaucagacgccccgauuggcacguguaguagcgaaugcauaacucccaaugguuccaucccuaacgauaaaccauuucagaaugucaacaggauuacauauggggcguguccccgguacguuaagcaaaauacccuuaaacuggcaacuggaaugcguaacgugccugagaagcagacacgcggcaucuucggcgccauagcuggguuuauugagaauggaugggaagguaugguagacggcugguauggguucagacaccagaacucugagggaaccggccaggccgcagauuugaaaagcacgcaagcugccaucgaccagaucaaugguaagcucaacaggcugauugagaaaaccaaugaaaaguuucaucagaucgaaaaggaguucucagagauugaagggcggauacaagauuuagagaaauacguggaagacacaaagaucgaucuguggaguuauaacgcggagcuccuugucgcccuggaaaaucagcacacuauugacuugaccgauuccgagaugaacaaacuauucgagaagacacgaaaacagcugcgcgaaaaugcagaggacaugggcaacggaugcuuuaagaucuaccauaagugugauaacgcuugcaucggcagcauuagaaaugggacuuacgaccacgacguguauagggaugaagcccucaacaaucgguuccagauaaaaggaguugagcugaagucugguuacaaagacuggauccuuuggauuucauuugcuaucaguugcuuccuguugugugugguccuccugggcuuuauuaugugggccugccaaaaggggaacauccgcuguaauauaugcaucuga

SEQ ID NO: 130633 - RNA, 1701 nt, Artificial Sequence; identical to SEQ ID NO: 130503
  derived and/or modified sequence opt3 from hemagglutinin__InfluenzaA__AFG99822

SEQ ID NO: 130634 - RNA, 1701 nt, Artificial Sequence; identical to SEQ ID NO: 130503
  derived and/or modified sequence opt3 from hemagglutinin__InfluenzaA__AFG99833

SEQ ID NO: 130635 - RNA, 1701 nt, Artificial Sequence; identical to SEQ ID NO: 130503
  derived and/or modified sequence opt3 from hemagglutinin__InfluenzaA__AFG99844

SEQ ID NO: 130636 - RNA, 1701 nt, Artificial Sequence
  derived and/or modified sequence opt3 from hemagglutinin__InfluenzaA__AFG99855
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagacuucaauuggaccgguguugcucaguccggggagucuuaugcaugcaagcgaggaagcgugaaguccuuuuucucacgucucaacugguuacacgagagugauuacaaauauccagcccugaaugucacgaugcccaacaauggcaaguuugacaaacuuuacauauggggcgugcaucacccuagcacugauagagaacaaaccucuuuguacguaagggcuuccgggcggguuacagugucaacuaagcgcagccagcagaccgucaucccaaacauuggaaguagacccugggugaggggucugucuucccggaucagcauuuauuggacaaucgugaaaccuggcgacauacuacucauuaauucgaccgggaaccugaucgccccacgcggauacuucaagauucgaacgggcaagucuuccaucaugagaucagacgcgccgaucgguacuuguaguagcgagugcauuacacccaacggguccauaccuaaugauaaaccauuucagaacgucaauaggaucaccuauggagcauguccccgguacguuaagcaaaacacucuuaaacuggccacaggcaugcguaaugugccuggcaagcagacccgcgggauuuucggagcuaucgccgguuuuauagaaaacggcugggaggggaugguagacggaugguauggcuucagacaccaaaauucugaggguacggggcaggcagcugauuugaaaagcacccaggccgcgauugaccagaucaacggcaagcucaauaggcugaucgagaaaacaaacgaaaaguuucaucagauugaaaaggaguucucagaaguggagggacggauccaagauuuagagaaauacgucgaagacacuaagauugaucuguggaguuauaaugccgagcuccuuguggcacuggaaaaccagcacaccauagacuugacagauuccgagaugaauaaacuauucgaaaagacucgaaaacagcugcgcgagaacgcugaggacaugggcaaugggugcuuuaagaucuaccauaagugugauaacgccugcauuggaagcaucagaaacgguaccuacgaccacgacguuuauagggaugaagcucucaauaaccgguuccagaucaaaggcguggagcugaagucuggguacaaagacuggauucuuuggauaucauuugccaucaguugcuuccuguugugugucgugcuccugggauuuauuaugugggcaugccaaaagggcaauauccgcuguaacauuugcaucuga

SEQ ID NO: 130637 - RNA, 1701 nt, Artificial Sequence; identical to SEQ ID NO: 130503
  derived and/or modified sequence opt3 from hemagglutinin__InfluenzaA__AFG99866

SEQ ID NO: 130638 - RNA, 1701 nt, Artificial Sequence; identical to SEQ ID NO: 130503
  derived and/or modified sequence opt3 from hemagglutinin__InfluenzaA__AFG99877

SEQ ID NO: 130639 - RNA, 1701 nt, Artificial Sequence
  derived and/or modified sequence opt3 from hemagglutinin__InfluenzaA__AFG99888
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggagucuuaugcaugcaagcgaggaagcgugaaguccuuuuucucacgucucaacugguuacacgagagugaauacaaauauccagcccugaaugucaccaugcccaacaaugauaaguuugacaaacuuuacaucuggggcgugcaucacccuagcacggauagagagcaaacuucuuuguacauuagggcuuccggccggguaaccguuucaacaaagcgcagccagcagacugugaucccaaacauugggaguagacccugggucaggggacugucuucccggaucagcauauauuggaccauugugaaaccuggugacauccuacucauuaauucgacaggcaaccugaucgccccacgcggguacuucaagauccgaaccggaaagucuuccauuaugagaucagacgcgccgauaggcacguguaacagugaaugcaucacucccaaugguagcauuccuaacgauaaaccauuucagaaugugaacaggaucacauauggggcauguccccgguacgucaagcaaaauacccuuaaacuggccacuggaaugcguaacguuccugagaagcagacacgcggcauauucggcgcuauugccggguuuaucgagaauggaugggaagguaugguggacggcugguauggguucagacaccagaacuccgagggaaccggccaggcagcugauuugaaaucuacgcaagccgcgaucgaccagauuaaugguaagcucaacaggcugaucgaaaagaccaaugagaaguuucaucagauugaaaaggaguucagcgagguagaagggcggauacaagauuuagagaaauacguggaagacacaaagaucgaucuguggucauauaacgccgagcuccuugucgcacuggaaaaucagcacacuauugacuugaccgauagugagaugaacaaacuauucgagaagacacgaaaacagcugcgcgaaaaugcugaggacaugggcaacggaugcuuuaagaucuaccauaagugugauaacgccugcaucggcuccauuagaaaugggacuuacaaccacgacguguauagggacgaagcucucaauaaccgguuccagauaaaaggaguugagcugaaaagcgguuacaaagauuggauccuuuggauuucuuuugccaucucaugcuuccuguugugugugguccuccugggcuuuauuaugugggcaugccaaaaggggaauauccgcuguaacauaugcaucuga

SEQ ID NO: 130640 - RNA, 1701 nt, Artificial Sequence; identical to SEQ ID NO: 130503
  derived and/or modified sequence opt3 from hemagglutinin__InfluenzaA__AFG99899

SEQ ID NO: 130641 - RNA, 1701 nt, Artificial Sequence; identical to SEQ ID NO: 130503
  derived and/or modified sequence opt3 from hemagglutinin__InfluenzaA__AFG99910

SEQ ID NO: 130642 - RNA, 1701 nt, Artificial Sequence; identical to SEQ ID NO: 130503
  derived and/or modified sequence opt3 from hemagglutinin__InfluenzaA__AFG99921

SEQ ID NO: 130643 - RNA, 1701 nt, Artificial Sequence
  derived and/or modified sequence opt3 from hemagglutinin__InfluenzaA__AFG99932
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggagucuuaugcaugcaagcgaggaagcgugaaguccuuuuucucacgucucaacugguuacacgagagugaauacaaauauccagcccugaaugucaccaugcccaacaaugauaaguuugacaaacuuuacaucuggggcgugcaucacccuagcacggauagagagcaaacuucuuuguacauuagggcuuccggccggguaaccguuucaacaaagcgcagccagcagacugugaucccaaacauugggaguagacccugggucaggggacugucuucccggaucagcauauauuggaccauugugaaaccuggugacauccuacucauuaauucgacaggcaaccugaucgccccacgcggguacuucaagauccgaaccggaaagucuuccauuaugagaucagacgcgccgauaggcacguguaguagcgaaugcaucacucccaacgguuccauuccuaaugauaaaccauuucagaacgugaauaggaucacauauggggcauguccccgguacgucaagcaaaacacccuuaaacuggccacuggaaugcguaauguuccugagaagcagacacgcggcauauucggcgcuauugccggguuuaucgagaacggaugggaagguaugguggacggcugguauggguucagacaccaaaauucugagggaaccggccaggcagcugauuugaaaagcacgcaggccgcgaucgaccagauuaacgguaagcucaauaggcugaucgagaaaaccaacgaaaaguuucaucagauugaaaaggaguucucagagguagaagggcggauacaagauuuagagaaauacguggaagacacaaagaucgaucuguggaguuauaaugccgagcuccuugucgcacuggaaaaccagcacacuauugacuugaccgauuccgagaugaauaaacuauucgagaagacacgaaaacagcugcgcgaaaacgcugaggacaugggcaauggaugcuuuaagaucuaccauaagugugauaacgccugcaucggcagcauuagaaacgggacuuacgaccacgacguguauagggaugaagcucucaauaaccgguuccagauaaaaggaguugagcugaagucugguuacaaagacuggauccuuuggauuucauuugccaucaguugcuuccuguugugugugguccuccugggcuuuauuaugugggcaugccaaaaggggaauauccgcuguaacauaugcaucuga

SEQ ID NO: 130644 - RNA, 1701 nt, Artificial Sequence; identical to SEQ ID NO: 130503
  derived and/or modified sequence opt3 from hemagglutinin__InfluenzaA__AFG99943

SEQ ID NO: 130645 - RNA, 1701 nt, Artificial Sequence
  derived and/or modified sequence opt3 from hemagglutinin__InfluenzaA__AFG99954
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggauucuuaugcaugcaagcgaggaagcgugaaguccuuuuucucacgucucaacugguuacacgagagugaguacaaauauccagcccugaaugucaccaugcccaacaaugacaaguuugauaaacuuuacaucuggggcgugcaucacccuagcacggaaagagagcaaacuucuuuguacauuagggcuuccggccggguaaccguuucaacaaagcgcagccagcagacugugaucccaaacauuggguucaaacccugggucagaggacugaguucuaggaucuccauauauuggaccauugugaagccuggugacauccuacucauuaauagcacaggcaaccugaucgccccacggggguacuuuaagauccgcaccggaaaaucgucuauuaugcgauccgacgcgccgauaggcacguguucaagugaaugcaucacucccaacgguagcauuccuaaugauaagccauuccagaacgugaauagaaucacauauggggcaugucccagguacgucaaacaaaacacccuuaagcuggccacuggaaugcggaauguuccugagaaacagacacguggcauauuuggcgcuauugccggguucaucgagaacggaugggaagguaugguggacggcugguauggguuucgccaccaaaauuccgagggaaccggccaggcagcugauuugaagucuacgcaggccgcgaucgaccagauuaacgguaaacucaauagacugaucgaaaagaccaacgagaaguuccaucagauugaaaaagaguucagcgagguagaagggaggauacaagauuuagagaaguacguggaagacacaaaaaucgaucuguggucauauaaugccgagcuccuugucgcacuggaaaaccagcacacuauugacuugaccgauagugagaugaauaagcuauuugagaaaacacggaagcagcugcgagaaaacgcugaggacaugggcaauggaugcuucaagaucuaccauaaaugugauaacgccugcaucggcuccauucgcaacgggacuuacgaccacgacguguauagagaugaagcucucaauaacagguuucagauaaagggaguugagcugaaaagcgguuacaaggacuggauccuuuggauuucuuucgccaucucaugcuuucuguugugugugguccuccugggcuucauuaugugggcaugccaaaaagggaauauccgguguaacauaugcaucuga

SEQ ID NO: 130646 - RNA, 1701 nt, Artificial Sequence
  derived and/or modified sequence opt3 from hemagglutinin__InfluenzaA__AFG99965
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacacaggauucucgauggcaaaaauuguacccugaucgacgcccuucugggggauccgcauugcgacggauuucagaacaaggaaugggauuuguucguagaacgguccaaagcauauucuaauuguuaccccuaugacgugccugauuacgccucgcuccgcucacuggucgcuagcaguggcacucuggaguuuacaaacgaagacuucaauuggaccgguguggcacaguccggggagucuuaugccugcaagcgaggaagcguuaaguccuuuuucucacgucucaacugguuacacgagagugauuacaaauauccagcucugaaugugacgaugcccaacaauggcaaguuugacaaacuuuacauauggggcguccaucacccuagcacugauagagaacaaaccucuuuguacgugagggccuccgggcggguaacaguuucaacuaagcgcagccagcagaccgugaucccaaacauuggaaguagacccugggucaggggucugucuucccggaucagcauuuauuggacaaucgugaaaccuggcgacauacuacucauuaauucgaccgggaaccugaucgcgccacgcggauacuucaagauucgaacgggcaagucuuccaucaugagaucagacgcaccgaucgguacuuguaguagcgagugcauuacacccaacggguccauaccuaaugauaaaccauuucagaacgugaauaggaucaccuauggagccuguccccgguacgucaagcaaaacacucuuaaacuggcuacaggcaugcguaauguuccugaaaagcagacccgcggcauuuucggggccaucgcaggauuuauagagaacgguugggagggcaugguggacgggugguauggauucagacaccaaaauucugaaggcacgggucaggcugccgauuugaaaagcacccaggcggccauugaccagaucaacgggaagcucaauaggcugaucgagaaaacaaacgaaaaguuucaucagauugagaaggaguucucagaaguagagggccggauccaagauuuagaaaaauacguggaggacacuaagauugaucuguggaguuauaaugcagaacuccuugucgcucuggagaaccagcacaccauagacuugacagauuccgaaaugaauaaacuauucgagaagacucgaaaacagcugcgcgagaacgccgaagacaugggaaauggcugcuuuaagaucuaccauaagugugauaacgcuugcauugggagcaucagaaacggaaccuacgaccacgacguguauagggaugaggcccucaauaaccgguuccagaucaaagguguugaacugaagucuggcuacaaagacuggauucuuuggauaucauuugcaaucaguugcuuccuguugugugugguccuccugggguuuauuaugugggccugccaaaagggaaauauccgcuguaacauuugcaucuga

SEQ ID NO: 130647 - RNA, 1701 nt, Artificial Sequence; identical to SEQ ID NO: 130503
  derived and/or modified sequence opt3 from hemagglutinin__InfluenzaA__AFG99976

SEQ ID NO: 130648 - RNA, 1701 nt, Artificial Sequence
  derived and/or modified sequence opt3 from hemagglutinin__InfluenzaA__AFG99987
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucagaacggggauuccuaugcaugcaagcgaggaucugucaagagcuuuuucucccgucucaauugguuacacgagucagaguacaaauauccagcccugaacgugaccaugcccaauaacgacaaguuugauaaacuuuacaucuggggcgugcaucacccuaguacggacagagaacaaacuagcuuguacauuagggcuucuggccggguaaccguuuccacaaagcgcucacagcagacugugaucccaaauauugggagcagacccugggucaggggacugaguucucggaucuccauauauuggaccauugugaaaccuggugacauccuacucauuaacagcacaggcaaccugaucgccccacgcggguacuucaagauccgaaccggaaagucgucuauuaugagauccgaugcgccgauaggcacguguucaagugagugcaucacucccaaugguagcauuccuaacgacaaaccauuucagaaugugaacaggaucacauauggggcauguccccgguacgucaagcaaaauacccuuaaacuggccacuggaaugcguaacguuccugaaaagcagacacgcggcauauucggcgcuauugccggguuuaucgagaauggaugggaggguaugguggauggcugguauggguucagacaccagaacuccgaaggaaccggccaggcagcugacuugaaaucuacgcaagccgcgaucgaucagauuaaugguaagcucaacaggcugaucgagaaaaccaaugaaaaguuucaucagauugagaaggaguucagcgaaguagaggggcggauacaagacuuagaaaaauacguggaggauacaaagaucgaccuguggucauauaacgccgaacuccuugucgcacuggagaaucagcacacuauugauuugaccgacagugaaaugaacaaacuauucgagaagacacgaaaacagcugcgcgagaaugcugaagauaugggcaacggaugcuuuaagaucuaccauaagugugacaacgccugcaucggcuccauuagaaaugggacuuacgaccacgauguguauagggacgaggcucucaacaaucgguuccagauaaaaggaguugaacuuaagagcgguuacaaagauuggauccuuuggauuucuuuugccaucucaugcuuccuguugugugugguccuccugggcuuuauuaugugggcaugccaaaaggggaacauccgcuguaauauaugcaucuga

SEQ ID NO: 130649 - RNA, 1701 nt, Artificial Sequence
  derived and/or modified sequence opt3 from hemagglutinin__InfluenzaA__AFG99998
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauaacggcaaguuugacaaauuguacaucuggggagugcaucacccuucaacggauagugaccaaacuagccuguacguaagagcuucugggaggguuaccguguccacaaagcggucacagcagacugucaccccaaauauugguagccgccccugggugagaggccuaaguucuaggaucuccauuuauuggacaaucgugaaaccuggggacauacuccugauuaacagcaccggaaaccuuaucgccccacggggcuacuucaagauucgcaaugguaagucgucuaucaugcgauccgaugcgccgaucgggaacuguucaagugagugcauuacgcccaauggaagcauaccuaacgacaaaccauuucagaaugucaacagaaucacuuauggcgcaugucccagguacguuaagcaaaauacacugaaauuggccaccggcaugcggaacgugccugaaaagcagacucgugggauuuucggagcuaucgccgguuuuauagagaauggcugggaagggaugguagauggaugguauggcuuccgccaccagaacuccgaggguacagggcaggcagcugaccucaaaucuacccaagccgcgauugaucagaucaauggcaagcugaacagauuaaucgagaaaacgaaugaaaaguuucaucagauugagaaggaguucagcgaaguggaaggaaggauccaagaccuggagaaauacgucgaggauaccaagauugaccucuggucauauaacgccgaacuucugguggcauuggagaaucagcacacaauagaucuaacugacagugaaaugaacaaacuguucgagaagacccggaaacagcuccgagaaaacgcugaggauaugggcaaugggugcuuuaagaucuaccauaagugugacaacgccugcauuggauccauccgcaaugguacauacgaccacgauguuuauagagacgaggcucugaacaauagguuccagaucaaaggcguggaacuuaagagcggguacaaagauuggauucuguggauaucuuuugccaucucaugcuucuugcucugugucgugcuguuaggauuuauuaugugggcaugccaaaagggcaacauccgguguaauauuugcaucuga

SEQ ID NO: 130650 - RNA, 1701 nt, Artificial Sequence; identical to SEQ ID NO: 130618
  derived and/or modified sequence opt3 from hemagglutinin__InfluenzaA__AFH00021

SEQ ID NO: 130651 - RNA, 1701 nt, Artificial Sequence
  derived and/or modified sequence opt3 from hemagglutinin__InfluenzaA__AFH00032
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguaaaaucugcgacagcccacacaggauucucgauggcaagaauuguacccugaucgacgcucuacugggggauccgcauugcgacgauuuucagaacaaagagugggacuuguucguggaaagauccaaggccuauucuaauuguuaccccuaugaugucccugacuacgcaucgcuccggucacugguggccagcaguggaacucuggaguuuauaaacgaagauuucaauuggacaggcguugcucaguccggugacucuuaugcaugcaagcgcgggagcgugaaauccuuuuucucacgacucaacugguuacacgagagugaguacaaguauccagcccugaaugucaccaugcccaacaaugauaaauuugacaaguuguacaucuggggagugcaucacccuagcacggaccgugaacaaacuucuuuguacauuagagcuuccggcaggguaaccguuucaacaaaacggagccagcagacugugaucccaaacauuggcagucgccccugggucagagggcugucuuccaggaucagcauauauuggaccauugugaagccuggagauauccuacucauuaauucgacagguaaccugaucgccccacggggcuacuucaagauccgcaccgggaaaucuuccauuaugcgaucagacgcgccgauaggaacguguaguagcgagugcaucacucccaacggcuccauuccuaaugauaagccauuucagaacgugaauagaaucacauauggugcaugucccagguacgucaaacaaaacacccuuaagcuggccacugggaugcggaauguuccugaaaaacagacacguggaauauucggcgcuauugccggcuuuaucgagaacgggugggagggaaugguggacgguugguauggcuuccgccaccaaaauucugaagggaccggacaggcagcugaucuuaagagcacgcaggccgcgaucgaccagauuaacggcaaacucaauaagcugaucgagaagaccaacgaaaaauuucaucagauugagaaggaguucucagaaguagaggguagaauacaagauuuagaaaaauacguggaggacacaaagaucgaucuguggaguuauaaugccgaacuccuugucgcacuggagaaccagcacacuauugacuugaccgauuccgaaaugaauaaacuauucgagaagacaaggaagcagcugcgggagaacgcugaagacauggggaauggcugcuuuaaaaucuaccauaagugugacaacgccugcaucggaagcauucgaaacggcacuuacgaucacgacguguaucgcgaugaggcucucaauaacagauuccagauaaaagggguugaacugaagucuggauacaaagacuggauccuuuggauuucauuugccaucaguugcuuccuguugugugugguccuccuggguuuuauuaugugggcaugccaaaagggcaauaucagguguaacauaugcaucuga

SEQ ID NO: 130652 - RNA, 1701 nt, Artificial Sequence
  derived and/or modified sequence opt3 from hemagglutinin__InfluenzaA__AFH00043
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguaaaaucugcgacagcccacacaggauucucgauggcaagaauuguacccugaucgacgcucuacugggggauccgcauugcgacgauuuucagaacaaagagugggacuuguucguggaaagauccaaggccuauucuaauuguuaccccuaugaugucccugacuacgcaucgcuccggucacugguggccagcaguggaacucuggaguuuauaaacgaagauuucaauuggacaggcguugcucaguccggugacucuuaugcaugcaagcgcgggagcgugaaauccuuuuucucacgacucaacugguuacacgagagugaguacaaguauccagcccugaaugucaccaugcccaacaaugauaaauuugacaaguuguacaucuggggagugcaucacccuagcacggaccgugaacaaacuucuuuguacauuagagcuuccggcaggguaaccguuucaacaaaacggagccagcagacugugaucccaaacauuggcagucgccccugggucagagggcugucuuccaggaucagcauauauuggaccauugugaagccuggagauauccuacucauuaauucgacagguaaccugaucgccccacggggcuacuucaagauccgcaccgggaaaucuuccauuaugcgaucagacgcgacgauaggaacuuguaguagcgagugcaucacaccgaacggcuccauucccaaugauaagccuuuucagaacgugaauagaaucaccuauggugcauguccaagguacgucaaacaaaacacucuuaagcuggccacagggaugcggaauguucccgaaaaacagacccguggaauauucggcgcuauugccggcuuuaucgagaacgggugggagggaaugguggacgguugguauggcuuccgccaccaaaauucugaagggacgggacaggcagcugaucuuaagagcacccaggccgcgaucgaccagauuaacggcaaacucaauaagcugaucgagaagacaaacgaaaaauuucaucagauugagaaggaguucucagaaguagaggguagaauacaagauuuagaaaaauacguggaggacacuaagaucgaucuguggaguuauaaugccgaacuccuugucgcacuggagaaccagcacaccauugacuugacagauuccgaaaugaauaaacuauucgagaagacuaggaagcagcugcgggagaacgcugaagacauggggaauggcugcuuuaaaaucuaccauaagugugacaacgccugcaucggaagcauucgaaacggcaccuacgaucacgacguguaucgcgaugaggcucucaauaacagauuccagauaaaagggguugaacugaagucuggauacaaagacuggauccuuuggauuucauuugccaucaguugcuuccuguugugugugguccuccuggguuuuauuaugugggcaugccaaaagggcaauaucagguguaacauaugcaucuga

SEQ ID NO: 130653 - RNA, 1701 nt, Artificial Sequence
  derived and/or modified sequence opt3 from hemagglutinin__InfluenzaA__AFH00054
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucagaacggggauuccuaugcaugcaagcgaggaucugucaagagcuuuuucucccgucucaauugguuacacgagucagaguacaaauauccagcccugaacgugaccaugcccaauaacgacaaguuugauaaacuuuacaucuggggcgugcaucacccuaguacggacagagaacaaacuagcuuguacauuagggcuucuggccggguaaccguuuccacaaagcgcucacagcagacugugaucccaaauauugggagcagacccugggucaggggacugaguucucggaucuccauauauuggaccauugugaaaccuggugacauccuacucauuaacagcacaggcaaccugaucgccccacgcggguacuucaagauccgaaccggaaagucgucuauuaugagauccgaugcgccgauaggcacguguucaagugagugcaucacucccaaugguagcauuccuaacgacaaaccauuucagaaugugaacaggaucacauauggggcauguccccgguacgucaagcaaaauacccuuaaacuggccacuggaaugcguaacguuccugaaaagcagacacgcggcauauucggcgcuauugccggguuuaucgagaauggaugggaggguaugguggauggcugguauggguucagacaccagaacuccgaaggaaccggccaggcagcugacuugaaaucuacgcaagccgcgaucgaucagauuaaugguaagcucaacaggcugaucgagaaaaccaaugaaaaguuucaucagauugagaaggaguucagcgaaguagaggggcggauacaagacuuagaaaaauacguggaggauacaaagaucgaccuguggucauauaacgccgaacuccuugucgcacuggagaaucagcacacuauugauuugaccgacagugaaaugaacaaacuauucgagaagacacgaaaacagcugcgcgagaaugcugaagauaugggcaacggaugcuuuaagaucuaccauaagugugacaacgccugcaucggcuccauuagaaaugggacuuacgaccacgauguguauagggacgaggcucucaacaaucgguuccacauaaaaggaguugaacuuaagagcgguuacaaagauuggauccuuuggauuucuuuugccaucucaugcuuccuguugugugugguccuccugggcuuuauuaugugggcaugccagaaggggaacauccgcuguaauauaugcaucuga

SEQ ID NO: 130654 - RNA, 1701 nt, Artificial Sequence
  derived and/or modified sequence opt3 from hemagglutinin__InfluenzaA__AFH00065
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauaacggcaaguuugacaaauuguacaucuggggagugcaucacccuucaacggauagugaccaaacuagccuguacguaagagcuucugggaggguuaccguguccacaaagcggucacagcagacugucauuccaaauaucgguagccgccccugggugagaggccagccuaguaggauuucuaucuauuggaccauagugaaaccaggggacauucuacucaucaacuccacaggaaaccugauugccccgcggggcuacuucaagauccgcaaugguaagagcucgaucaugcgaucugaugcgcccauugggaacuguuccucagagugcauaaccccuaauggaaguaucccaaacgacaaacccuuucaaaaugucaacagaauuacguauggcgcauguccuagguacguuaagcagaauacucuuaaacuggccacaggcaugcggaacgugccagaaaagcagacccgugggaucuucggagcuauagccgguuuuauugagaauggcugggaagggaugguagauggaugguauggcuuccgccaccagaacagcgaggguacugggcaagcagcugacuugaaauccacacaggccgcgaucgaucagaucaauggcaagcucaacagacugauugagaaaaccaaugaaaaguuucaucaaaucgagaaggaguucucugaaguggaaggaaggauucaggacuuagagaaauacgucgaggauacgaagauagaccuguggagcuauaacgccgaacuccuuguggcacuggagaaucagcacaccaucgauuugacagacucagaaaugaacaaacuauucgagcggacucgaaagcagcugcgcgaaaacgcugaggauaugggcaaugggugcuuuaaaauuuaccauaagugugacaacgccugcaucggaaguaucagaaaugguaccuacgaccacgauguuuauagggacgaggcucucaacaaucgguuccaaauuaagggcguggaacugaaauccggguacaaggauuggauacuuuggaucagcuuugccauuucuugcuuccuguugugugucgugcuccugggauuuaucaugugggcaugccagaaaggcaacauucgcuguaauaucugcauauga

SEQ ID NO: 130655 - RNA, 1701 nt, Artificial Sequence
  derived and/or modified sequence opt3 from hemagglutinin__InfluenzaA__AFH00076
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguaaaaucugcgacagcccacacaggauucucgauggcaagaauuguacccugaucgacgcccuucugggggauccgcauugcgacgauuuucagaacaaagagugggacuuguucguggaaagauccaaggcuuauucuaauuguuaccccuaugaugucccugacuacgcaucgcuccggucacugguggccagcaguggaacucuggaguuuauaaacgaagauuucaauuggacaggcguugcucaguccggugacucuuaugcaugcaagcgcgggagcgugaaauccuuuuucucacgacucaacugguuacacgagagugaguacaaguauccagcccugaaugucaccaugcccaacaaugauaaauuugacaagcuauacaucuggggagugcaucacccuagcacggaccgugaacaaacuucuuuguacauuagagcuuccggcaggguaaccguuucaacaaaacggagccagcagacugugaucccaaacauuggcagucgccccugggucagagggcugucuuccaggaucagcauauauuggaccauugugaagccuggagauauccuacucauuaauucgacagguaaccugaucgccccacggggcuacuucaagauccgcaccgggaaaucuuccauuaugcgaucagacgcgccgauaggaacguguaacagugagugcaucacucccaauggcagcauuccuaacgauaagccauuucagaaugugaacagaaucacauauggugcaugucccagguacgucaaacaaaauacccuuaagcuggccacugggaugcggaacguuccugaaaaacagacacguggaauauucggcgcuauugccggcuuuaucgagaaugggugggagggaaugguggacgguugguauggcuuccgccaccagaacuccgaagggaccggacaggcagcugauuugaagucuacgcaagccgcgaucgaccagauuaauggcaaacucaacagacugaucgagaagaccaaugaaaaguuucaucagauugagaaagaguucagcgaaguagaggguaggauacaagauuuagaaaaguacguggaggacacaaaaaucgaucuguggucauauaacgccgaacuccuugucgcacuggagaaucagcacacuauugacuugaccgauagugaaaugaacaagcuauucgagaaaacacggaagcagcugcgagagaaugcugaagacauggggaacggcugcuuuaagaucuaccauaaaugugacaacgccugcaucggauccauucgcaauggcacuuacgaucacgacguguauagagaugaggcucucaacaauagguuccagauaaaggggguugaacugaaaagcggauacaaggacuggauccuuuggauuucuuuugccaucucaugcuuccuguugugugugguccuccuggguuuuauuaugugggcaugccaaaaaggcaacauccgguguaauauaugcaucuga

SEQ ID NO: 130656 - RNA, 1701 nt, Artificial Sequence
  derived and/or modified sequence opt3 from hemagglutinin__InfluenzaA__AFH00087
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccgaggccuauucuucguguuaccccuaugacgucccugauuacgcaucacuccgcagccugguggccaguuccggcacucuggaauuuauaaaugaggacuucaacuggacagguguugcucaggaugggaaaucuuaugcaugcaagcgaggaagcgugaauagcuuuuucucacgucucaacugguuacacaagcuggaguacaaauauccagcccuuaaugucaccaugcccaacaauggcaaguuugacaaauuguacaucuggggcgugcaucacccuaguacggauagcgaccaaacuucucuguacguaagagcuuccgggaggguuaccgugucaacaaagcggagccagcagacugucauuccaaacaucggaagucgccccugggugagaggucagucuuccaggauuggcaucuauuggaccauagugaaaccuggggacauucuacucaucaauagcacaggaaaccugauugccccacggggcuacuucaagauccgcaacgguaagucgucuaucaugcgauccgaugcgccgauugggaauuguucaagugaaugcauaacccccaacggaagcaucccuaaugacaaaccauuucaaaacgucaauaagauuacguauggcgcaugucccagauacguuaaacagaacacucuuaagcuggccacaggcaugaggaaugugccugagaaacagacccgggggaucuucggagcuauagccgguuuuauugaaaacggcugggaggggaugguagauggaugguauggcuuccgucaccaaaauuccgaggguacugggcaggcagcugacuugaagucuacacaggccgcgaucgaucagaucaacggcaaacucaaucgccugauugaaaagaccaacgagaaguuucaucaaaucgaaaaagaguucagcgaaguggagggaaggauucaggacuuagagaaguacgucgaagauacgaaaauagaccuguggucauauaaugccgagcuccuuguggcacuggaaaaccagcacaccaucgauuugacagacagugagaugaauaagcuauucgaaagaacucggaaacagcugcgagagaacgcugaggauaugggcaacgggugcuuuaagauuuaccauaagugugacaaugccugcaucggauccauccgcaacgguaccuacgaccacgauguuuauagagacgaagcucucaauaacagguuccaaauuaaaggcguggagcugaaguccggguacaaagauuggauacuuuggaucucuuuugccauuucaugcuuccuguugugugucgugcuccugggauuuaucaugugggcaugccagaagggcaauauucgguguaacaucugcauauga

SEQ ID NO: 130657 - RNA, 1701 nt, Artificial Sequence
  derived and/or modified sequence opt3 from hemagglutinin__InfluenzaA__AFH00098
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauaacggcaaguuugacaaauuguacaucuggggagugcaucacccuucaacggauagugaccaaacuagccuguacguaagagcuucugggaggguuaccguguccacaaagcggucacagcagacugucauuccaaauaucgguagccgccccugggugagaggccuaccuaguaggauuucuaucuauuggaccauagugaaaccaggggacauucuccugaucaacuccacaggaaaccuuauugccccgcggggcuacuucaagauccgcaaugguaagagcucgaucaugcgaucugaugcgcccauugggaacuguuccucagagugcauaaccccuaauggaaguaucccaaacgacaaacccuuucagaaugucaacagaauuacguauggcgcauguccuagguacguuaagcaaaauacucugaaauuggccacaggcaugcggaacgugccagaaaagcagacccgugggaucuucggagcuauagccgguuuuauugagaauggcugggaagggaugguagauggaugguauggcuuccgccaccagaacagcgaggguacugggcaggcagcugaccucaaauccacacaagccgcgaucgaucagaucaauggcaagcugaacagauuaauugagaaaaccaaugaaaaguuucaucagaucgagaaggaguucucugaaguggaaggaaggauucaagaccuggagaaauacgucgaggauacgaagauagaccucuggagcuauaacgccgaacuucugguggcauuggagaaucagcacaccaucgaucuaacagacucagaaaugaacaaacuguucgagcggacucgaaagcagcuccgcgaaaacgcugaggauaugggcaaugggugcuuuaaaauuuaccauaagugugacaacgccugcaucggaaguaucagaaaugguaccuacgaccacgauguuuauagggacgaggcucugaacaaucgguuccagauuaagggcguggaacuuaaauccggguacaaggauuggauacuguggaucagcuuugccauuucuugcuucuugcucugugucgugcuguuaggauuuaucaugugggcaugccaaaaaggcaacauucgcuguaauaucugcauauga

SEQ ID NO: 130658 - RNA, 1701 nt, Artificial Sequence
  derived and/or modified sequence opt3 from hemagglutinin__InfluenzaA__AFH00109
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuauaccugcaagcgaggaucugugaacagcuuuuucucccgucucaauugguuacacaaacuggaguacaaguauccagcacuuaacgucacgaugcccaauaacggcaaauuugacaaguuguacaucuggggcgugcaucacccuucaacugauagugaccaaaccagccuguacguaagagccucugggaggguuacaguguccacuaaacggucacagcagaccgucauuccaaauaucggauuccgccccugggugagaggucuaagcaguaggauuucuaucuauuggacaauagugaagccuggcgacauucuccugaucaacuccaccgggaaccuuauugcuccacggggauacuuuaagauccgcaauggcaaaagcucgaucaugcgaucugaugccccgauugguaacuguuccucagagugcauaacgcccaaugggaguaucccuaacgacaagccauuccagaaugucaacagaauuacuuauggagcgugucccagguacguuaaacaaaauacacugaaguuggcaaccggcaugcggaacgugccugaaaaacagacucguggcaucuuuggggccauagcuggauucauugagaaugguugggaaggcaugguagaugggugguauggauuucgccaccagaacagcgagggcacaggucaggccgcagaccucaaguccacccaagcugccaucgaucagaucaaugggaaacugaacagauuaauugagaagacgaaugaaaaguuccaucagaucgagaaagaguucucugaaguggaaggcaggauucaagaccuggagaaguacgucgaggauaccaaaauagaccucuggagcuauaacgcgggacuucugguggccuuggaaaaucagcacacaaucgaucuaacugacucagagaugaacaagcuguuugaacggacccgaaaacagcuccgcgagaacgcagaagauaugggcaaugggugcuucaagauuuaccauaagugugacaacgcuugcaucggaaguaucagaaaugguacauacgaccacgauguuuauagggacgaggcccugaacaaucgguuucagauuaaaggcguggagcuuaaguccggguacaaagauuggauacuguggaucagcuucgcuauuucuugcuuuuugcucugugucgugcuguuaggauucaucaugugggccugccaaaagggcaacauucgcuguaauaucugcauauga

SEQ ID NO: 130659 - RNA, 1701 nt, Artificial Sequence
  derived and/or modified sequence opt3 from hemagglutinin__InfluenzaA__AFH00120
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaagauccgcaauggcaaaagcucgaucaugcgaucugaugcgccgauugguaacuguuccucagagugcauaacccccaaugggaguaucccuaacgacaagccauuccagaaugucaacagaauuacguauggagcaugucccagguacguuaaacaaaauacucugaaguuggccacaggcaugcggaacgugccugaaaaacagacccguggcaucuuuggggcuauagccggauucauugagaaugguugggaaggcaugguagaugggugguauggauuucgccaccagaacagcgagggcacuggucaggcagcugaccucaaguccacacaagccgcgaucgaucagaucaaugggaaacugaacagauuaauugagaagaccaaugaaaaguuccaucagaucgagaaagaguucucugaaguggaaggcaggauucaagaccuggagaaguacgucgaggauacgaaaauagaccucuggagcuauaacgccggacuucugguggcauuggaaaaucagcacaccaucgaucuaacagacucagagaugaacaagcuguuugaacggacucgaaaacagcuccgcgagaacgcugaagauaugggcaaugggugcuucaagauuuaccauaagugugacaacgccugcaucggaaguaucagaaaugguaccuacgaccacgauguuuauagggacgaggcucugaacaaucgguuucagauuaaaggcguggagcuuaaguccggguacaaagauuggauacuguggaucagcuucgccauuucuugcuuuuugcucugugucgugcuguuaggauucacaaugugggcaugccaaaagggcaacauccgcuguaauauuugcaucuga

SEQ ID NO: 130660 - RNA, 1701 nt, Artificial Sequence; identical to SEQ ID NO: 130514
  derived and/or modified sequence opt3 from hemagglutinin__InfluenzaA__AFH00131

SEQ ID NO: 130661 - RNA, 1701 nt, Artificial Sequence
  derived and/or modified sequence opt3 from hemagglutinin__InfluenzaA__AFH00153
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacauuagagcuucugggaggguaaccguuuccacaaaacggucacagcagacugugaucccaaauauuggaagccgccccugggucagaggucuaaguucuaggaucuccauauauuggaccauugugaagccuggcgacauccuccugauuaacagcacagggaaccuuaucgccccacggggauacuucaagauccgcaauggcaaaucgucuauuaugcgauccgaugcgccgauagguaacuguucaagugagugcaucacccccaaugggagcauuccuaacgacaagccauuucagaaugugaacagaaucacguauggagcaugucccagguacgucaaacaaaauacucugaaguuggccacaggcaugcggaacguuccugaaaaacagacccguggcauauucggggcuauugccggauuuaucgagaaugguugggaaggcaugguggaugggugguauggauuccgccaccagaacuccgagggcacuggucaggcagcugaccucaagucuacacaagccgcgaucgaucagauuaaugggaaacugaacagauuaaucgagaagaccaaugaaaaguuucaucagauugagaaagaguucagcgaaguagaaggcaggauacaagaccuggagaaguacguggaggauacgaaaaucgaccucuggucauauaacgccgaacuucuggucgcauuggagaaucagcacaccauugaucuaacagacagugaaaugaacaagcuguucgagcggacucgaaaacagcuccgcgaaaacgcugaggauaugggaaauggcugcuuuaagaucuaccauaagugugacaacgccugcaucggguccauuagaaauggaaccuacgaccacgauguguauagggacgaggcucugaacaaucgguuccagauaaaagguguugaacuuaagagcggcuacaaagauuggauccuguggauuucuuuugccaucucaugcuucuugcucugugugguccuguuaggguuuauuaugugggcaugccaaaagggaaacauccgcuguaauauaugcaucuga

SEQ ID NO: 130662 - RNA, 1701 nt, Artificial Sequence
  derived and/or modified sequence opt3 from hemagglutinin__InfluenzaA__AFH00164
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugauggacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuaucaacgaagacuucaauuggacagguguugcucagaacggggauuccuaugcaugcaagcgaggaucugucaagagcuuuuucucccgucucaauugguuacacgagucagaguacaaauauccagcccugaacgugaccaugcccaauaacgacaaguuugauaaacuuuacauauggggcgugcaucacccuaguacggacagagaacaaacuagcuuguacaucagggcuucuggccggguaaccguuuccacaaagcgcucacagcagacugugauuccaaauaucgggagcagacccugggucaggggacugaguucucggauuuccaucuauuggaccauagugaaaccuggugacauucuacucaucaacagcacaggcaaccugauugccccacgcggguacuucaagauccgaaccggaaagucgucuaucaugagauccgaugcgccgauuggcacguguucaagugagugcauaacucccaaugguagcaucccuaacgacaaaccauuucagaaugugaacaggauuacauauggggcauguccccgguacgucaagcaaaauacccuuaaacuggccacuggaaugcguaacguuccugaaaagcagacacgcggcaucuucggcgcuauagccggguuuauugagaauggaugggaggguaugguggauggcugguauggguucagacaccagaacuccgaaggaaccggccaggcagcugacuugaaaucuacgcaagccgcgaucgaucagaucaaugguaagcucaacaggcugauugagaaaaccaaugaaaaguuucaucagaucgagaaggaguucagcgaaguagaggggcggauucaagacuuagaaaaauacguggaggauacaaagauagaccuguggucauauaacgccgaacuccuugucgcacuggagaaucagcacacuaucgauuugaccgacagugaaaugaacaaacuauucgagaagacacgaaaacagcugcgcgagaaugcugaagauaugggcaacggaugcuuuaagauuuaccauaagugugacaacgccugcaucggcuccaucagaaaugggacuuacgaccacgauguguauagggacgaggcucucaacaaucgguuccagauuaaaggaguugaacuuaagagcgguuacaaagauuggauacuuuggaucucuuuugccauuucaugcuuccuguugugugugguccuccugggcuuuaucaugugggcaugccaaaaggggaacauucgcuguaauaucugcauauga

SEQ ID NO: 130663 - RNA, 1701 nt, Artificial Sequence
  derived and/or modified sequence opt3 from hemagglutinin__InfluenzaA__AFH00175
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaaauccuuuuucucccgucucaacugguuacacaagcuggaguacaaauauccagcccuuaaugucaccaugcccaacaauggcaaguuugacaaauuguacaucuggggcgugcaucacccuucaacggauagugaccaaacuagccuguacguaagagcuucugggaggguuaccguguccacaaagaagucacagcagacugucauuccaaacaucggaagccggcccugggugcgcggucagaguucuagaauuuccaucuauuggaccauagugaaaccuggcgacauucuacucaucaauagcacagggaaccugauugccccaaggggauacuucaagauccggaacggcaaaucgucuaucaugcgcuccgaugcgccgauugguaauuguucaagugagugcauaacccccaacgggagcaucccuaaugacaagccauuucaaaacgucaaucgaauuacguauggagcaugucccagauacguuaaacagaacacucuuaagcuggccacaggcaugaggaaugugccugaaaaacagacccggggcaucuucggggcuauagccggauuuauugagaacgguugggaaggcaugguagaugggugguauggauuccgucaccagaauagcgagggcacuggucaagcagcugacuugaagucuacacaggccgcgaucgaucagaucaacgggaagcucaaucgccugauugagaaaaccaacgaaaaguuucaucaaaucgagaaagaguucagcgaaguggaaggcaggauucaggacuuagagaaguacgucgaggauacgaaaauagaccuguggucauauaaugccgaacuccuuguggcacuggagaaccagcacaccaucgauuugacagacagugaaaugaauaagcuauucgagagaacucggaagcagcugcgagaaaacgcugaggauaugggaaacggcugcuuuaaaauuuaccauaagugugacaaugccugcaucggguccauccgcaacggaaccuacgaccacgauguuuauagagacgaggcucucaauaacagguuccaaauuaaagguguggaacuuaagagcggcuacaaagauuggauacuuuggaucucuuuugccauuucaugcuuccuguugugugucgugcuccugggguuuaucaugugggcaugccagaagggaaauauucgguguaacaucugcauauga

SEQ ID NO: 130664 - RNA, 1701 nt, Artificial Sequence
  derived and/or modified sequence opt3 from hemagglutinin__InfluenzaA__AFH00186
augaagaccaucauugcccugagccacauacucugccuuguguucgcucagaaacugcccggcaacgacaauuccacagcaacuuuguguuuagggcaucacgccgucccuaacggaacgcugguuaagaccaucacaaaugaucaaauugaggugacuaacgcgaccgaacuuguacagucuucaaguacagguagaaucugcgacagcccacauaggauucucgauggcaaaaauuguacccugaucgacgcucuacugggggauccgcacugcgacggauuucagaacaaggagugggauuuguucguggaacgguccaaagccuacucuaauuguuaucccuacgacgucccugauuaugcaucgcuccgcucacugguggccagcaguggcacucuggaguuuauaaacgaagacuucaauuggacagguguugcucaggaugggggauccuacgcaugcaagcgaggcucugugaacagcuuuuucucccgucucaauugguuacauaagcuggaguauaaauacccagcccuuaacgucaccaugcccaauaacggcaaguuugacaaauuguauaucuggggagugcaccacccuucaacggauagugaccaaacuagccuguacguaagagcuucugggaggguuaccguguccacaaagcggucacagcagacugucaccccaaauauugguagccgccccugggugagaggccagaguucuaggaucuccauuuacuggacaaucgugaaaccuggggacauacuacucauuagcucgaccggaaaccugaucgccccacggggcuauuucaagauucgcaacgguaagucuuccaucaugcgaucagaugucccgaucgggaauuguaguagcgagugcauuacgcccaacggauccauaccuaaugacaaaccauuucaaaacguuaauagaaucacuuacggcgcgugucccagguaugugaagcagaacacacuuaaacuggcaaccggcaugcggaauguaccugaaaagcagacucgugggauuuucggagccaucgcugguuuuauagagaacggcugggaagggaugguggauggaugguacggcuuccgccaucaaaauucugaggguacagggcaggccgcagacuugaaaagcacccaggcugccauugaucagaucaacggcaagcucaauagacugaucgagaaaacgaacgaaaaguuucaccaaauugagaaggaguucucagaagucgaaggaaggauccaggacuuagagaaauauguggaggauaccaagauugaccuguggaguuacaaugcggaacucauaguugcccuugagaaccagcauacaaucgaucugacugacuccgaaaugaauaaauuguucgagaagacccggaaacagcuacgagaaaacgcagaggauaugggcaacgggugcuuuaagauuuaucacaagugugacaaugcuugcaucggaagcauccgcaacgguacauacgaccacgauguguacagagacgaggcccugaauaacagguuccaaauuaaaggcgucgaacucaagucuggguauaaagauuggauacuguggaucucauuugcuauuaguugcuuccuucugugugugguauugcucggauuuaucaugugggccugccagaagggcaauauucgguguaacaucugcauauga

SEQ ID NO: 130665 - RNA, 1701 nt, Artificial Sequence
  derived and/or modified sequence opt3 from hemagglutinin__InfluenzaA__AFH00197
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuauaccugcaagcgaggcucugugaacagcuuuuucucccgucucaauugguuacacaagcuggaguacaaauauccagcacuuaacgucacgaugcccaauaacggcaaguuugacaaauuguacaucuggggagugcaucacccuucaacugauagugaccaaaccagccuguacguaagagccucugggaggguuacaguguccacuaagauuucacagcagaccgucaucccaaauauugguagccggcccugggugcgcggccuaaguucuagaaucuccauauauuggacaauugugaaaccuggggacauccuccugauuaacagcaccggaaaccuuaucgcuccaaggggcuacuucaagauccggaaugguaagucgucuauuaugcgcuccgaugccccgauagggaacuguucaagugagugcaucacgcccaauggaagcauuccuaacgacaaaccauuucagaaugucaaccgaaucacuuauggcgcgugucccagauacguuaagcaaaauacacugaaauuggcaaccggcaugaggaacgugccugaaaagcagacucgggggauauucggagccauugcugguuuuaucgagaauggcugggaagggaugguagauggaugguauggcuuccgucaccagaacuccgaggguacagggcaggccgcagaccucaaaucuacccaagcugccaucgaucagauuaauggcaagcugaaccgcuuaaucgagaaaacgaaugaaaaguuucaucagauugagaaggaguucagcgaaguggaaggaagaauacaagaccuggagaaauacgucgaggauaccaagaucgaccucuggucauauaacgcggaacuucugguggccuuggagaaucagcacacaauugaucuaacugacagugaaaugaacaaacuguucgagaggacccggaagcagcuccgagaaaacgcagaggauaugggcaaugggugcuuuaaaaucuaccauaagugugacaacgcuugcaucggauccauucgcaaugguacauacgaccacgauguuuauagagacgaggcccugaacaauagguuccagauaaagggcguggaacuuaaaagcggguacaaggauuggauccuguggauuucuuuugcuaucucaugcuucuugcucugugucgugcuguuaggauuuauuaugugggccugccaaaaaggcaacauccgguguaauauaugcaucuga

SEQ ID NO: 130666 - RNA, 1701 nt, Artificial Sequence
  derived and/or modified sequence opt3 from hemagglutinin__InfluenzaA__AFH00208
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucagaacggggauuccuaugcaugcaagcgaggaucugucaagagcuuuuucucccgucucaauugguuacacgagucagaguacaaauauccagcccugaacgugaccaugcccaauaacgacaaguuugauaaacuuuacaucuggggcgugcaucacccuaguacggacagagaacaaacuagcuuguacauuagggcuucuggccggguaaccguuuccacaaagcgcucacagcagacugugaucccaaauauugggagcagacccugggucaggggacugaguucucggaucuccauauauuggaccauugugaaaccuggugacauccuacucauuaacagcacaggcaaccugaucgccccacgcggguacuucaagauccgaaccggaaagucgucugugaugagauccgaugcgccgauuggcacguguucaagugagugcauaacucccaaugguagcaucccuaacgacaaaccauuucagaaugucaacaggauuacauauggggcauguccccgguacguuaagcaaaauacccuuaaacuggccacuggaaugcguaacgugccugaaaagcagacacgcggcaucuucggcgcuauagccggguuuauugagaauggaugggaggguaugguagauggcugguauggguucagacaccagaacuccgaaggaaccggccaggcagcugacuugaaaucuacgcaagccgcgaucgaucagaucaaugguaagcucagcaggcugauugagaaaaccaacgaaaaguuucaucagaucgagaaggaguucucagaaguggaggggcggauucaagacuuagaaaaauacgucgaggauacaaagauagaccuguggaguuauaaugccgaacuccuuguggcacuggagaaccagcacacuaucgauuugaccgacuccgaaaugaauaaacuauucgagaagacacgaaaacagcugcgcgagaacgcugaagauaugggcaauggaugcuuuaagauuuaccauaagugugacaacgccugcaucggcagcaucagaaacgggacuuacgaccacgauguuuauagggacgaggcucucaauaaccgguuccagauuaaaggaguggaacugaagucugguuacaaagauuggauacuuuggaucucauuugccauuaguugcuuccuguugugugucgugcuccugggcuuuaucaugugggcaugccaaaaggggaauauucgcuguaacaucugcauauga

SEQ ID NO: 130667 - RNA, 1701 nt, Artificial Sequence
  derived and/or modified sequence opt3 from hemagglutinin__InfluenzaA__AFH00219
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgaacugcgacggauuucagaauaaggagugggauuuguucguggaacgguccaaagccuauucuaacuguuaccccuaugacgucccugauuacgcaucgcuccgcucacugguggccagcaguggcacucuggaguuuacaaaugaagacuucaacuggaccgguguugcucaggaugggggauccuaugcaugcaagcgaggcucugugaauagcuuuuucucccgucucaacugguuacauaagcuggaguacaaauauccagcccuuaaugucacgaugcccaacaauggcaaguuugacaaauuguacauauggggagugcaccauccuucaacugauagugaccaaaccagccuguacguaagagcuucugggaggguuacaguguccacuaagcggucacagcagaccgucacaccaaacaucgguagccgccccugggugagaggccuaaguucuaggauuuccaucuauuggaccauugugaaaccuggggacauccuccugauaaacagcacgggaaaucuuauugccccacggggcuacuucaagauccgcaacgguaagucgucuauuaugcgauccgaugcgccgaucgggacuuguucaagugagugcaucacacccaauggaagcauuccuaacgacaaaccauuucagaaugucaacagaauaaccuauggcgcaugucccagguacguuaagcaaaauacucugaaauuggccacaggcaugcggaacgugccugaaaagcagacccgugggaucuucggagcuauugccgguuuuaucgagaauggcugggaagggaugguagauggaugguauggcuuccgccaccagaacuccgaggguacggggcaggcagcugaccucaaaucuacccaagccgcgauagaucagauuaauggcaagcugaacagauuaaucgacaaaacaaaugagaaguuucaccagaucgaaaaggaguucagcgaaguggagggaaggauucaagaucuggaaaaauacgucgaggacacuaagaucgaucucuggucauauaacgccgagcuucugguggcauuggaaaaucagcauaccauugaccuaacagauagugagaugaacaaacuguucgaaaagacucggaaacagcuccgagagaacgcugaagacaugggcaaugggugcuuuaagauauaccacaagugugacaacgccugcaucggauccauucgcaaugguaccuacgaucaugacguuuauagagaugaggcucugaacaauagguuccagaucaaaggcguggagcuuaagagcggguacaaagacuggauccuguggauuucuuuugccauaucaugcuucuugcucugugucgugcuguuaggauuuaucaugugggcaugccaaaagggcaacauucgguguaauaucugcauuuga

SEQ ID NO: 130668 - RNA, 1701 nt, Artificial Sequence
  derived and/or modified sequence opt3 from hemagglutinin__InfluenzaA__AFH00230
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaaauccuuuuucagccgucucaacugguuacacaagcuggaguacaaauauccagcccuuaaugucaccaugcccaacaauggcaaguuugacaaauuguacaucuggggcgugcaucacccuucaacgaacagugaucaaacuagccuguacguaagagcuucugggaggguuaccguguccacaaagcggucacagcagacugucauuccaaauaucggauuccgccccugggugagaggucuaagcaguaggauuucuaucuauuggaccauagugaagccuggcgacauucuccugaucaacuccacagggaaccuuauugccccacggggauacuuuaaaauccgcaauggcaagagcucgaucaugcgaucugacgcgccgauugguaacuguuccucagagugcauaacccccaaugggaguaucccuaacgauaaaccauuccagaaugucaacagaauuacguauggagcaugucccagguacguuaagcaaaauacucugaaauuggccacaggcaugcggaacgugccugaaaagcagacccguggcaucuuuggggcuauagccggauucauugagaaugguugggaaggcaugguagacgggugguauggauuucgccaccagaacagcgagggcacuggucaggcagcugaucucaaauccacacaagccgcgaucgaccagaucaaugggaagcugaacagauuaauugagaagaccaaugaaaaauuccaucagaucgagaaggaguucucugaaguggaaggcaggauucaagaucuggagaaauacgucgaggacacgaagauagaucucuggagcuauaacgccggacuucugguggcauuggaaaaucagcacaccaucgaccuaacagauucagagaugaacaaacuguuugaacggacucgaaagcagcuccgcgagaacgcugaagacaugggcaaugggugcuucaagauuuaccauaaaugugauaacgccugcaucggaaguaucagaaaugguaccuacgaccacgacguuuauagggaugaggcucugaacaaucgguuucagauuaagggcguggagcuuaaauccggguacaaggacuggauacuguggaucagcuucgccauuucuugcuuuuugcucugugucgugcuguuaggauucaucaugugggcaugccaaaaaggcaacauucgcuguaauaucugcauauga

SEQ ID NO: 130669 - RNA, 1701 nt, Artificial Sequence; identical to SEQ ID NO: 123040
  derived and/or modified sequence opt3 from hemagglutinin__InfluenzaA__AFH00241

SEQ ID NO: 130670 - RNA, 1701 nt, Artificial Sequence
  derived and/or modified sequence opt3 from hemagglutinin__InfluenzaA__AFH00252
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacgauuuucagaacaaggagugggacuuguucguggaacgguccaaagccuauucuaauuguuaccccuaugaugucccugacuacgcaucgcuccgcucacugguggccagcaguggaacucuggaguuuauaaacgaagauuucaauuggacaggcguugcucaguccggugacucuuaugcaugcaagcgagggagcgugaaguccuuuuucucacgucucaacugguuacacgagagugaguacaaauauccagcccugaaugucaccaugcccaacaaugauaaguuugacaaacuuuacaucuggggagugcaucacccuagcacggacagagaacaaacuucuuuguacauuagggcuuccggccggguaaccguuucaacaaagcgcagccagcagacugugaucccaaacauuggcaguagacccugggucagggggcugucuucccggaucagcauauauuggaccauugugaaaccuggagauauccuacucauuaauucgacagguaaccugaucgccccacgcggcuacuucaagauccgaaccgggaagucuuccauuaugagaucagacgcgccgauaggaacguguaguagcgagugcaucacucccaacggcuccauuccuaaugauaaaccauuucagaacgugaauaggaucacauauggugcauguccccgguacgucaagcaaaacacccuuaaacuggccacugggaugcguaauguuccugaaaagcagacacgcggaauauucggcgcuauugccggcuuuaucgagaacgggugggagggaaugguggacgguugguauggcuucagacaccaaaauucugaagggaccggacaggcagcugauuugaaaagcacgcaggccgcgaucgaccagauuaacggcaagcucaauaggcugaucgagaaaaccaacgaaaaguuucaucagauugagaaggaguucucagaaguagagggucggauacaagauuuagaaaaauacguggaggacacaaagaucgaucuguggaguuauaaugccgaacuccuugucgcacuggagaaccagcacacuauugacuugaccgauuccgaaaugaauaaacuauucgagaagacacgaaaacagcugcgcgagaacgcugaagacauggggaauggcugcuuuaagaucuaccauaagugugacaacgccugcaucggaagcauuagaaacggcacuuacgaucacgacguguauagggaugaggcucucaauaaccgguuccagauaaaagggguugaacugaagucuggauacaaagacuggauccuuuggauuucauuugccaucaguugcuuccuguugugugugguccuccuggguuuuauuaugugggcaugccaaaagggcaauauccgcuguaacauaugcaucuga

SEQ ID NO: 130671 - RNA, 1701 nt, Artificial Sequence
  derived and/or modified sequence opt3 from hemagglutinin__InfluenzaA__AFH00263
augaagaccaucauugcccugagcuacauacuccaccuuguguucgcucagaaacugcccggcaacgacaauuccacagcaacuuugugcuuagggcaucacgccgucccuaacggaacgcugguuaagaccaucacaaaugaucaaauugaggugacuaacgcgaccgaacuuguacagucuucaaguacagguagaaucugugacagcccacauaggauucucgauggcaaaaauugcacccugaucgacgcucuacugggggauccgaacugugacggauuucagaauaaggagugggauuuguucguggaacgguccaaagccuauucuaacugcuaccccuaugacgucccugauuacgcaucgcuccgcucacugguggccagcaguggcacucuggaguuuacaaaugaagacuucaacuggaccgguguugcucaggaugggggauccuaugcauguaagcgaggcucugugaauagcuuuuucucccgucucaacugguuacacaagcuggaguacaaauauccagcccuuaaugucacgaugcccaacaauggcaaguuugacaaauuguacauauggggagugcaucacccuucaacugauaguguacaaaccagccuguacguuagagcuucugggaaggugacagucuccacuaaaaggucacagcagaccgugacaccaaacaucgguagcaagcccugggugcggggccuaaguucucgcauuuccaucuauuggaccauugucaagccuggggacauccuccugauaaacagcacgggaaaucuuauugccccaagaggcuacuucaaaaucaggaacgguaagucgucuauuaugcgguccgacgcgccgaucgggacuugcucaagugaguguaucacacccaauggaagcauuccuaacgauaaaccauuucagaauguuaaccgcauaaccuauggcgcaugcccccgauacgugaagcaaaauacucugaaauuggccacaggcaugagaaacguaccugaaaagcagaccagggggaucuucggagcuauugccgguuuuaucgagaauggcugggaagggaugguggacggaugguauggcuuccggcaccagaacuccgaggguacggggcaggcagcugaucucaaaucuacccaagccgcgauagaccagauuaauggcaagcugaaccguuuaaucgagaagacaaaugaaaaauuucaucagaucgagaaggaguucagcgaagucgaaggacgcauucaagaucuggagaaauacguggaggacacuaagaucgaucucuggucauauaacgccgaacuucugguugcauuggagaaucagcacaccauugaccuaacagauagugaaaugaacaaacuguucgagaagacuagaaagcagcucagggaaaacgcugaggacaugggcaauggguguuuuaaaauauaccauaagugcgauaacgccuguaucggauccauucggaaugguaccuacgaccacgacguguaucgagaugaggcucugaacaaucgcuuccagaucaaaggcgucgaacuuaagagcggguacaaagacuggauccuguggauuucuuuugccauaucaugcuucuugcucugcgugguacuguuaggauuuaucaugugggcaugucaaaagggcaacauuagaugcaauaucuguauuuga

SEQ ID NO: 130672 - RNA, 1701 nt, Artificial Sequence
  derived and/or modified sequence opt3 from hemagglutinin__InfluenzaA__AFH00274
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguggcauuucuaucuauuggaccauagugaagccuggggacauucuccugaucaacuccacaggaaaccuuauugccccaaggggcuacuuuaagauccggaaugguaaaagcucgaucaugcgcucugaugcgccgauugggaacuguuccucagagugcauaacccccaauggaaguaucccuaacgacaagccauuccagaaugucaaccgaauuacguauggcgcaugucccagauacguuaaacaaaauacucugaaguuggccacaggcaugaggaacgugccugaaaaacagacccgggggaucuuuggagcuauagccgguuucauugagaauggcugggaagggaugguagauggaugguauggcuuucgucaccagaacagcgaggguacugggcaggcagcugaccucaaguccacacaagccgcgaucgaucagaucaauggcaaacugaaccgcuuaauugagaagaccaaugaaaaguuccaucagaucgagaaagaguucucugaaguggaaggaaggauucaagaccuggagaaguacgucgaggauacgaaaauagaccucuggagcuauaacgccggccuucugguggcauuggaaaaucagcacaccaucgaucuaacagacucagagaugaacaagcuguuugaaagaacucggaaacagcuccgagagaacgcugaagauauggggaauggaugcuucaagauuuaccauaagugugacaacgccugcaucgguaguauccgcaauggcaccuacgaccacgauguuuauagagacgaggcucugaacaauagguuucagauuaaagggguggagcuuaaguccggauacaaagauuggauacuguggaucagcuucgccauuucuugcuuuuugcucugugucgugcuguuaggcuucaucaugugggcaugccaaaaggguaacauucgguguaauaucugcauauga

SEQ ID NO: 130673 - RNA, 1701 nt, Artificial Sequence
  derived and/or modified sequence opt3 from hemagglutinin__InfluenzaA__AFH00285
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcggcagcccacacaggauucucgacgggaaaaauuguacccugaucgaugcucugcugggagacccgcauugcgauggcuuucagaacaaggaaugggacuuguucguggaacgguccaaagccuauucuaauuguuaccccuaugaugucccugacuacgcaucgcuccgcucacugguggccagcagugguacucuggaguuuauaaacgaagauuucaauuggacagggguugcucaggacggaggcuccuaugcaugcaagcgaggcucugugaacagcuuuuucucccgucucaauugguuacacaagcuggaguacaaauauccagcccuuaacgucaccaugcccaauaacgggaaguuugauaaauuguacaucuggggagugcaucacccuucaacggacagugaucaaacuagccuguacguaagagcuucugguaggguuaccguguccacaaagcggucacagcagacugucaccccaaauauuggcagccgccccugggugagagggcagaguucuaggaucuccauuuauuggacaaucgugaaaccuggagacauacuacucauuaacagcaccggcaaccugaucgccccacgggguuacuucaagauucgcaaugggaagucgucuaucaugcgauccgacgcgccgaucggaaacuguucaagugagugcauuacgcccaauggcagcauaccuaacgauaaaccauuucaaaaugucaacagaaucacuuauggcgcaugucccagguacguuaagcagaauacacuuaaacuggccaccgggaugcggaacgugccugaaaagcagacucguggaauuuucggugcuaucgccggcuuuauagagaaugggugggaaggaaugguagacggcugguaugguuuccgccaccagaacuccgaggggacaggccaagcagcugauuugaaaucuacccaggccgcgauugaccagaucaauggaaagcucaacagacugaucgagaaaacgaaugaaaaguuucaucaaauugagaaggaguucagcgaaguggaaggcaggauccaggauuuagagaaauacgucgaggacaccaagauugaucuguggucauauaacgccgaacuccuuguggcacuggagaaucagcacacaauagacuugacugauagugaaaugaacaaacuauucgagaagacccggaaacagcugcgagaaaacgcugaggacauggggaauggaugcuuuaagaucuaccauaagugugauaacgccugcauugguuccauccgcaauggcacauacgaccacgacguuuauagagaugaggcucucaacaauagguuccaaaucaaagggguggaacuuaagagcggauacaaagacuggauucuuuggauaucuuuugccaucucaugcuuccuguugugugucgugcuccugggcuuuauuaugugggcaugccagaaggguaacauccgguguaauauuugcaucuga

SEQ ID NO: 130674 - RNA, 1701 nt, Artificial Sequence
  derived and/or modified sequence opt3 from hemagglutinin__InfluenzaA__AFH00296
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacaaggagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguugcucaguccgggggaucuuaugcaugcaagcgaggcagcgugaacuccuucuuuucacgucugaauuggcuccacgagagugaguacaaguauccagccuuaaacgucaccaugcccaauaacggcaaauucgauaagcuguacaucuggggagugcaucacccuagcacggacagagaacaaacuaaucuuuacguaagggcuucugggcggguuaccguguccacaaaacgcucacagcagacugucauuccaaacaucgguagcagacccugggugaggggcuugaguucucggauuuccaucuauuggaccauagugaagccuggggauauucugcuaaucaacagcacaggaaaucucauugccccacgcggcuacuuuaaaauccgaaccgguaagucgucuaucaugagauccgacgcgccgauugggacguguucaagugagugcauaacucccaacggaagcaucccuaaugacaagccauuccagaacgucaauaggauuacauauggcgcauguccccgguacguuaaacaaaacacccugaaacuugccacuggcaugcguaaugugccugaaaagcagacacgcgggaucuuuggagcuauagccgguuucauugagaacggcugggaggggaugguagauggaugguauggcuuuagacaccaaaauuccgaagguaccgggcaggcagcugaccugaagucuacgcaggccgcgaucgaucagaucaacggcaaauugaauaggcucauugagaagaccaacgaaaaauuccaucagaucgagaaggaguucagcgaaguggagggacggauucaagaccuggaaaaguacgucgaggauacaaaaauagacuuauggucauauaaugccgaacugcucguggcacuugagaaccagcacacuaucgaucugaccgacagugaaaugaauaaguuguuugagaaaacacgaaagcagcuacgcgagaacgcugaagauaugggcaacgggugcuucaaaauuuaccauaagugugacaaugccugcaucggauccaucagaaacgguacuuacgaucacgacguuuauagggacgaggcucugaauaaccgguuucagauuaagggcguggaacucaaaagcggguacaaggauuggauacuguggaucucuuucgccaccucaugcuuucuucugugugucguguugcucggauucauuaugugggcaugccaaaaaggcaauauccgcuguaacauuugcaucuga

SEQ ID NO: 130675 - RNA, 1701 nt, Artificial Sequence
  derived and/or modified sequence opt3 from hemagglutinin__InfluenzaA__AFH00307
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggggauccuaugcaugcaagcgaggcucugugaacagcuuuuucucccgucucaauugguuacacaagcuggaguacaaauauccagcccuuaacgucaccaugcccaauaacggcaaguuugacaaauuguacaucuggggagugcaucacccuucaacggauagugaccaaacuagccuguacguaagagcuucugggaggguuaccguguccacaaagcggucacagcagacugucaccccaaauauugguagccgccccugggugagaggccagaguucuaggaucuccauuuauuggacaaucgugaaaccuggggacauacuacucauuaacagcaccggaaaccugaucgccccacggggcuacuucaagauucgcaaugguaagucgucuaucaugcgauccgaugcgccgaucgggaacuguucaagugagugcauuacgcccaauggaagcauaccuaacgacaaaccauuucaaaaugucaacagaaucacuuauggcgcaugucccagguacguuaagcagaauacacuuaaacuggccaccggcaugcggaacgugccugaaaagcagacucgugggauuuucggagcuaucgccgguuuuauagagaauggcugggaagggaugguagauggaugguauggcuuccgccaccagaacuccgaggguacagggcaagcagcugacuugaaaucuacccaggccgcgauugaucagaucaauggcaagcucaacagacugaucgagaaaacgaaugaaaaguuucaucaaauugagaaggaguucagcgaaguggaaggaaggauccaggacuuagagaaauacgucgaggauaccaagauugaccuguggucauauaacgccgaacuccuuguggcacuggagaaucagcacacaauagauuugacugacagugaaaugaacaaacuauucgagaagacccggaaacagcugcgagaaaacgcugaggauaugggcaaugggugcuuuaagaucuaccauaagugugacaacgccugcauuggauccauccgcaaugguacauacgaccacgauguuuauagagacgaggcucucaacaauagguuccaaaucaaaggcguggaacuuaagagcggguacaaagauuggauucuuuggauaucuuuugccaucucaugcuuccuguugugugucgugcuccugggauuuauuaugugggcaugccagaagggcaacauccgguguaauauuugcaucuga

SEQ ID NO: 130676 - RNA, 1701 nt, Artificial Sequence; identical to SEQ ID NO: 130675
  derived and/or modified sequence opt3 from hemagglutinin__InfluenzaA__AFH00318

SEQ ID NO: 130677 - RNA, 1701 nt, Artificial Sequence
  derived and/or modified sequence opt3 from hemagglutinin__InfluenzaA__AFH00329
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagccaccauaggauucucgauggcaaaaauuguacccugaucgacgcucuacugggggauccacacugcgacggauuucagaacaaggagugggauuuguucguggaacgguccaaagccuauucuaauuguuacccguaugacguccccgauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacauaaacuggaguacaaguauccugcccuuaacgucaccaugccaaauaacggcaaauuugacaaguuguacaucuggggcgugcaccaccccucaacggauagugaccaaacuagcauuuacguaagagcuucugggaggguuaccguguccacaaaacggucacagcagacugucaucccuaauauuggaagccgcccaugggugagagguaucaguucuaggauauccauuuauuggaccaucgugaagcccggcgacauucugcuaaucaacagcacagggaaccucaucgccccucggggauacuucaagauucgcaauggcaaaucgucuauaaugcgauccgaugcgccaaucgguaacuguaauucagagugcauuaccccgaacgggaguauccccaaugacaagccuuuucagaacgucaauagaauaacguauggagcauguccaagguacguuaaacaaaacacucugaaacuugccacaggcaugcggaaugugcccgaaaagcagacccguggcauuuucggggcuaucgccggauuuaucgagaacgguugggaaggcaugguagaugggugguauggauuccgccaucagaauagcgagggcacuggucaggcagcugaccugaaguccacacaagccgcgauugaucagaucaacgggaaauugaauagacucauugagaagaccaacgaaaaguuucaccagauagagaaagaguucucugaaguggaaggcaggauccaagaccuggagaaguacgucgaggauacgaaaauugacuuauggagcuauaaugccgaacugcucguggcacuugagaaccagcauaccaucgaucugacagacucagaaaugaacaaguuguucgagcggacucgaaaacagcuacgcgaaaaugcugaggauaugggaaacggcugcuuuaagaucuaccacaagugugacaaugccugcauugggaguauaagaaacggaaccuacgaccacgauguuuauagggacgaggcucugaauaaccgguuccagaucaaagguguggaacucaaguccggcuacaaagauuggauucuguggaucagcuuugccacaucuugcuuccuucugugugucguguugcucggguuuauuaugugggcaugccaaaagggaaauauccgcuguaacauaugcaucuga

SEQ ID NO: 130678 - RNA, 1701 nt, Artificial Sequence
  derived and/or modified sequence opt3 from hemagglutinin__InfluenzaA__AFH00340
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaggaugggaaguccuaugcaugcaagcgaggaucugugaacagcuuuuucucccgucucaauugguuacacaaacuggaguacaaguauccagcccuuaacgucaccaugcccaauaacggcaaauuugacaaguuguacaucuggggcgugcaucacccuucaacggauagugaccaaacuagccuguacguaagagcuucugggaggguuaccguguccacaaaacggucacagcagacugucauuccaaauaucggauuccgccccugggugagaggucuaagcaguaggauuucuaucuauuggaccauagugaagccuggcgacauucuccugaucuccagcacagggaaccuuauugccccacggggauacuuuaagauccgcaacggcaaaucgucuaucaugcgauccgaugcgccgauugguaauuguucaagugagugcauaacccccaacgggagcaucccuaaugacaagccauuccagaacgucaauagaauuacguauggagcaugucccagguacguuaaacaaaacacucugaaguuggccacaggcaugcggaauaucccugaaaaacagacccguggcauauuuggggcuauugccggauucaucgagaacgguugggaaggcaugguggaugggugguauggauuucgccaccaaaauuccgagggcacuggucaggcagcugaccucaagucuacacaggccgcgaucgaucagauuaacgggaaacugaauagauuaaucgagaagaccaacgaaaaguuccaucagauugagaaagaguucagcgaaguagaaggcaggauacaagaccuggagaaguacguggaggauacgaaaaucgaccucuggucauauaaugccggacuucuggucgcauuggaaaaccagcacaccauugaucuaacagacagugagaugaauaagcuguuugaacggacucgaaaacagcuccgcgagaacgcugaagauaugggcaacgggugcuucaagaucuaccauaagugugacaaugccugcaucggauccauuagaaacgguaccuacgaccacgauguguauagggacgaggcucugaauaaccgguuucagauaaaaggcguugagcuuaagagcggguacaaagauuggauccuguggauuucuuucgccaucucaugcuuuuugcucugugugguccuguuaggauucauuaugugggcaugccaaaagggcaauauccgcuguaacauaugcaucuga

SEQ ID NO: 130679 - RNA, 1701 nt, Artificial Sequence
  derived and/or modified sequence opt3 from hemagglutinin__InfluenzaA__AFH00351
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugucaagagcuuuuucucccgucucaauugguuacacaaacuggaguacaaguauccagcccuuaacgugacgaugcccaauaacgauaaauuugacaaguuguacauauggggcgugcaucacccuucaacugauagugaccaaaccagccuguacguacaggcuucugggagaguuacaguguccacuaagaggucacagcagaccgucaucccaaauauuggaagccggcccugggugcgcgguaucaguucuagaauuuccaucuauuggacaauagugaaaccuggcgacauucuacucaucaacagcaccgggaaucugauugccccaaggggauacuucaagauccggaacggcaaaucgucuaucaugcgcuccgaugcgccgauugguaacuguaauucagagugcauaacgcccgacgggaguaucccuaacgauaagccauuucaaaaugucaaccgaauuacuuauggagcaugucccagauacguuaaacagaauacacuuaagcuggccaccggcaugaggaacgugccugaaaaacagacucggggcaucuucggggcuauagccggauuuauugagaaugguugggaaggcaugguagacgggugguauggauuccgucaccagaacagcgagggcacaggucaagcagcugauuugaaguccacccaggccgcgaucgaccagaucaaugggaagcucaaccgccugauugagaaaacgaauaagaaauuucaucaaaucgaaaaggaguucucugaaguggagggcaggauucaggauuuagaaaaauacgucgaggacaccaagauagaucuguggagcuauaacgccgagcuccuuguggcacuggaaaaucagcacacaaucgacuugacugauucagagaugaacaagcuauucgaaagaacccggaaacagcugcgagagaaugcugaagacaugggaaacggcugcuuuaagauuuaccauaaaugugacaacgccugcaucgggaguauccgcaauggaacauacgaucacgacguuuauagagaugaggcucucaacaauagguuccaaauuaaggguguggagcugaaauccggcuacaaggacuggauacuuuggaucagcuuugccauuucuugcuuccuguugugugucgugcuccugggguuuaucaugugggcaugccagaagggaaacauucgguguaauaucugcauauga

SEQ ID NO: 130680 - RNA, 1701 nt, Artificial Sequence
  derived and/or modified sequence opt3 from hemagglutinin__InfluenzaA__AFH00362
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaaauccuuuuucagccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugacaauuguaacucagagugcauaacgcccaaugguaguaucccuaacgauaaaccauuucaaaaugucaaccgaauuacuuauggggcaugucccagauacguuaagcagaauacacuuaaacuggccaccggaaugaggaacgugccugaaaagcagacucggggcaucuucggcgcuauagccggguuuauugagaauggaugggaagguaugguagacggcugguauggguuccgucaccagaacagcgagggaacaggccaagcagcugauuugaaauccacccaggccgcgaucgaccagaucaaugguaagcucaaccgccugauugagaagacgaaugaaaaauuucaucaaaucgagaaggaguucucugaaguggaagggaggauucaggauuuagagaaauacgucgaggacaccaagauagaucuguggagcuauaacgccgaacuccuuguggcacuggagaaucagcacacaaucgacuugacugauucagaaaugaacaaacuauucgagagaacccggaagcagcugcgagaaaacgcugaggacaugggcaauggaugcuuuaagauuuaccauaaaugugacaacgccugcaucggcaguauccgcaaugggacauacgaucacgacguuuauagagaugaggcucucaacaauagguuccaaauuaagggaguggaacugaaauccgguuacaaggacuggauacuuuggaucagcuuugccacuucuugcuuccuguugugugucgugcuccugggcuuuauuaugugggcaugccagaaagggaacauccgguguaauauuugcaucuga

SEQ ID NO: 130681 - RNA, 1701 nt, Artificial Sequence
  derived and/or modified sequence opt3 from hemagglutinin__InfluenzaA__AFH00384
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaaggaagguuucaacuggaccgggguugcucaggacggaaaguccuaugcaugcaaacgaggcucugugaauagcuuuuucucccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcauugggaaccugaucgccccaaggggauacuucaaaauccggaacggcaagucgucuauuaugcgcuccgaugcgccgauagguaauuguaacucagagugcaucacccccaaugggaguauuccuaacgacaaaccauuucaaaaugucaaccgaaucacguauggagcaugucccagauacguuaagcagaauacucuuaaacuggccacaggcaugaggaacgugccugaaaagcagacccggggcauauucggggcuauugccggauuuaucgagaaugguugggaaggcaugguagaugggugguauggauuccgucaccagaacagcgagggcacuggucaagcagcugacuugaaauccacacaggccgcgaucgaucagauuaaugggaagcucaaccgccugaucgagaagaccaaugaaaaauuucaucaaauugagaaggaguucucugaaguggaaggcagaauacaggacuuagagaaauacgucgaggauacgaagaucgaccuguggagcuauaacgccggacuccuuguggcacuggaaaaucagcacaccauugauuugacagacucagagaugaacaaacuauucgaaaggacucggaagcagcugcgagagaacgcugaagauaugggcaaugggugcuuuaagaucuaccauaaaugugacaacgccugcaucggaaguauucgcaaugguaccuacgaccacgauguuuauagagacgaggcucucaacaauagguuccaaauaaagggcguggagcugaaauccggguacaaggauuggauccuuuggauuagcuuugccaucucuugcuuccuguugugugucgugcuccugggauuuauuaugugggcaugccagaaaggcaacauccgguguaauauaugcaucuga

SEQ ID NO: 130682 - RNA, 1701 nt, Artificial Sequence
  derived and/or modified sequence opt3 from hemagglutinin__InfluenzaA__AFH00395
augaaggccaucauugcucugagcuacauacucugccuuguguucgcacagaaacugcccggcaacgacaauuccaccgccacauuguguuuagggcaccaugcggucccuaacggaacucugguuaagacgaucaccaaugaucaaauugaggugacaaacgcuacugaauugguacagucuucaaguaccgguagaaucugcgacagcccacacaggauucucgauggcaaaaauuguacacugaucgacgcccuucugggggauccgcauugcgacggauuucagaacaaggagugggauuuguucguggaacgguccaaagcauauucuaauuguuaccccuaugacgucccugauuacgccucgcuccgcucacugguggcuagcaguggcacccuggaguuuacuaaggaagguuucaacuggacagggguugcacaggacggaaaguccuaugccugcaaacgaggcucugugaauggcuuuuucagccgucucaacugguuacacaagcuggaguacaaauauccagcucuuaaugucaccaugcccaacaaugauaaguuugacaaauuguacauauggggagugcaucacccuuccacggauucagaccaaaccagucuguacguacaggccagcgggagaguuacugugucuacaaagaggucccagcagacugucaucccaaacauugguucacggcccugggugcgcggcaucagcaguagaauuucuaucuauuggaccauagugaagccuggggacauucuacucaucaaauccacaggaaaucugauugcgccaaggggcuacuucaagauccggaacgguaaaagcucgaucaugcgcucugaugcaccgauugggaacuguaauuccgagugcauaacccccaacggaucaaucccuaaugacaagccauuucaaaacgucaaucgaauuacguauggcgccugucccagauacguuaaacagaacacucuuaagcuggcuacaggcaugaggaaugugccugaaaaacagacccgggggaucuucggagccauagcagguuuuauugagaacggcugggaagggaugguagauggaugguauggcuuccgucaccagaauagugaggguacugggcaagcugccgaccuaaagagcacacaggcggccaucgaucagaucaacggcaagcucaaucgccugauugagaaaaccaacgaaaaguuucaucaaaucgagaaagaguucuccgaaguggaaggaaggauucaggacuuagagaaguacgucgaggauacgaaaauagaccuguggucuuauaaugcagaacuccuuguggcucuggagaaccagcacaccaucgauuugacagacagcgaaaugaauaagcuauucgagagaacucggaagcagcugcgagaaaacgccgaggauaugggcaacgggugcuuuaaaauuuaccauaagugugacaaugcuugcaucggaucaauccgcaacgguaccuacgaccacgauguuuauagagacgaggcccucaauaacagguuccaaauuaaaggcguggaacugaagaguggguacaaagauuggauacuuuggaucuccuuugcaauuagcugcuuccuguugugugucgugcuccugggauuuaucaugugggccugccagaagggcaauauucgguguaacaucugcauauga

SEQ ID NO: 130683 - RNA, 1701 nt, Artificial Sequence
  derived and/or modified sequence opt3 from hemagglutinin__InfluenzaA__AFH00417
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaaauccuuuuucagccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugacaauuguaacucagagugcauaacgcccaaugguaguaucccuaacgauaaaccauuucaaaaugucaaccgaauuacuuauggggcaugucccagauacguuaagcagaauacacuuaaacuggccaccggaaugaggaacgugccugaaaagcagacucggggcaucuucggcgcuauagccggguuuauugagaauggaugggaagguaugguagacggcugguauggguuccgucaccagaacagcgagggaacaggccaagcagcugauuugaaauccacccaggccgcgaucgaccagaucaaugguaagcucaaccgccugauugagaagacgaaugaaaaauuucaucaaaucgagaaggaguucucugaaguggaagggaggauucaggauuuagagaaauacgucgaggacaccaagauagaucuguggagcuauaacgccgaacuccuuguggcacuggagaaucagcacacaaucgacuugacugauucagaaaugaacaaacuauucgagagaacccggaagcagcugcgagaaaacgcugaggacaugggcaauggaugcuuuaagauuuaccauaaaugugacaacgccugcaucggcaguauccgcaaugggacauacgaucacgacguuuauagagaugaggcucucaacaauagguuccaaauuaagggaguggaacugaaauccgguuacaaggacuggauacuuuggaucagcuuugccauuucuugcuuccuguugugugucgugcuccugggcuuuaucaugugggcaugccagaaagggaacauucgguguaauaucugcauauga

SEQ ID NO: 130684 - RNA, 1701 nt, Artificial Sequence; identical to SEQ ID NO: 123004
  derived and/or modified sequence opt3 from hemagglutinin__InfluenzaA__AFH00428

SEQ ID NO: 130685 - RNA, 1701 nt, Artificial Sequence
  derived and/or modified sequence opt3 from hemagglutinin__InfluenzaA__AFH00439
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugugaaguccuuuuucucccgucucaacugguuacacaaacuggaguacaaguauccagcccuuaaugucacuaugcccaacaaugauaaauuugacaaguuguacauauggggcgugcaucacccuucaaccgauagugaccaaacaagccuguacguacaggcuucugggagaguuacuguguccaccaaaaggucacagcagacagucaucccaaacauuggaagccggcccugggugcgcggugugaguucuagaaucuccauuuauuggaccaucgucaagccuggcgacauacuacucauuaauagcacggggaaccugaucgccccaaggggauacuucaagauucggucgggcaaaucuuccaucaugcgcucagaugcgccgaucgguaacuguaauagugagugcauuacucccaacgggagcauaccuaaugacaagccauuucaaaacguuaaucgaaucacauauggagcaugucccagauacgugaaacagaacacccuuaagcuggccacuggcaugaggaauguaccugaaaaacagacacggggcauuuucggggcuaucgccggauuuauagagaacgguugggaaggcaugguggaugggugguauggauuccgucaccagaauagcgagggcaccggucaagcagcugacuugaagucuacgcaggccgcgauuaaccagaucaaugggaaacucaaccgccugaucgagaagaccaaugaaaaguuucaucaaauugagaaagaguucagcgaagucgaaggcagaauccaggauuuagagaaguacguggaggacacaaaaauugaucuguggucauauaacgccgaacuccuuguugcacuggagaaucagcacacuauagacuugaccgauagugaaauguccaagcuauucgagaggacacggaaacagcugcgagaaaacgcugaggacaugggaaacggcugcuuuaagaucuaccauaagugugauaaugccugcauugggagcauccgcaacggaacuuacgaccacgacguguauagagaugaggcucucaauaacagguuccaaaucaaaggugucgaacugaagucuggcuacaaagacuggauucuuuggauaucauuugccaucaguugcuuccuguugugugugguacuccugggguuuauuaugugggcaugccagaagggaaauauccgguguaacauuugcaucuga

SEQ ID NO: 130686 - RNA, 1701 nt, Artificial Sequence
  derived and/or modified sequence opt3 from hemagglutinin__InfluenzaA__AFH00450
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacggcccacacaggauuaucgaugggaaaaauuguacccucauagacgcucugcuuggagauccgcauugcgacggcuuucagaacaaggagugggaucuguucguggaacggagcaaagccuauuccaauuguuaccccuaugacgucccugauuacgcaucuuugcgcucgcucguggccucaagcgguacucuggaguuuacaaacgaaaguuucaauuggaccgggguugcucagaacggaacguccuaugcaugcaagcgaggcucugucaagagcuuuuucucccgucugaauuggcuccacaaauuagaguacaaguauccagcccugaacgugacuaugcccaauaacgacaaauuugauaaguuguacaucuggggcgugcaucacccuucaaccgacagugaucaaacaagccuuuacguacagucuuccgggagaguuacugugucaaccaaaaggagccagcagacagucauuccaaauaucggaagucggcccugggugcgcggugugucuuccagaauuagcaucuauuggaccauagucaagccuggcgacauucugcuaaucaacucgacggggaaccucauugcuccaaggggauacuucaagauccggucuggcaaauccucaaucaugcgcagugacgccccgauugauaauuguaacagcgagugcauaacucccaaugguuccaucccuaacgacaagccauuucaaaauguuaaccgaauuacauauggggcgugucccagauacgugaaacagaauacccugaaacuugcaacuggaaugaggaacguaccugaaaagcagacacggggcaucuucggcgccauagcuggguuuauugagaauggaugggaagguaugaucgauggcugguauggguuccgucaccagaacucugagggaaccggccaagccgcagaccuaaagagcacgcaggcugccaucaaucagauuaacgguaaauugaaucgccucaucgagaagaccaacgaaaaguuucaucaaauugagaaagaguucucagaaguggaagggagaauacaggaucuggagaaguacgucgaggacacaaaaaucgauuuauggaguuauaaugcggaacugcucguggcccuugagaaccagcacacuauugaccugaccgauuccgaaaugaacaaguuguucgagaggacacggaaacagcuacgagaaaaugcagaggacaugggcaacggaugcuuuaagaucuaccauaagugugauaaugcuugcaucggcagcauucgcaacgggacuuacgaccacgacguuuauagagaugaggcccugaauaacagguuccaaauaaaaggaguggaacucaagucugguuacaaagacuggauccuguggauuucauuugcuaucaguugcuuccuucugugugucguguugcucggcuuuauuaugugggccugccagaaggggaauauccgguguaacauaugcaucuga

SEQ ID NO: 130687 - RNA, 1701 nt, Artificial Sequence
  derived and/or modified sequence opt3 from hemagglutinin__InfluenzaA__AFH00461
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuauaaacgaaaauuucaacuggacagguguugcucaggacgggaagaguuaugcaugcaagcgaggauccgugaauagcuuuuucagccgucucaacugguuacacaaacuggauuacaaguaucccgcccuuaaugucaccaugccuaacaauggcaaauuugacaaguuguacaucuggggcgugcaucacccauccacggauucagaccaaauuagucuguacguaagaagcucugggaggguuacuguguccaccaaacggucacagcagacagucauccccgacauuggauaucgcccuugggugagaggucuaagcaguaggaucucuauauacuggacuauugugaagccaggcgauauccuccugauuaacuccaccgggaaccuuaucgcuccgcggggauauuucaagcugcgcaauggcaaaagcucgaucaugcgaucugacgcccccauugguaacuguuccucagggugcauaacaccuaauggaaguaucccaaacgauaagcccuuucagaaugucaacagaauuaccuacggcgcguguccuagguauguuaaacaaaauacguugaagcucgcaacuggcaugcggaacgugccagagaaacagacacgugggaucuucggagccauagcugguuuuauugagaauggcugggaagggaugguagacggaugguacggcuuccgccaccagaacagcgaggguaccgggcaggccgcagaucugaaguccacucaagcugccaucgaccagaucaauggcaaauuaaacagacugguggaaaagacaaaugagaaguuucaucagauugagaaagaguucucugaagucgaaggaaggauccaagaucucgagaaguauguggaagacaccaaaauugaucuuuggagcuacaacgcggagcuguugguugcccuagagaaucagcacacgauagaccugaccgauucagaaaugaacaaacucuucgagcggacacgaaagcagcugcgcgaaaacgcagaggacaugggcaaugggugcuuuaagaucuaccauaagugugacaacgcuugcauuggaaguaucagaaaugguacuuaugaucacgacguguacagggaugaagcccuuaacaaucgguuccagaucaaaggcgucgagcugaaguccggguauaaagacuggauuuuguggauaucuuuugcuaucucuugcuuccuccugugugugguauuacugggauuuauuaugugggccugccaaaagggcaacauccgcuguaauauuugcaucuga

SEQ ID NO: 130688 - RNA, 1701 nt, Artificial Sequence
  derived and/or modified sequence opt3 from hemagglutinin__InfluenzaA__AFH00472
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucucggauuacgcaucacuccgcagccugguggccaguuccggcacucuggaguuuaacaaugaaucuuucaacuggacagguguugcucagaaugggaccagcuaugcaugcaagcgacguuccgugaagucauuuuucaguagacucaacugguuacacaaacuggaguacaaguauccugcccuuaaugucacgaugccaaacaaugacaaauuugauaaguuguacauauggggagugcaucaccccagcacugacucugaucaaaccucccuguacguacaggcuucaggcaggguuacagugagcacuaaacggagucagcagaccgucaucccuaacauuggcucucgcccaugggugagagggguguccagcaggaucucgauuuauuggacaaucgucaagcccggagacauacuacucauuaacucuaccgguaaucugaucgccccucggggcuacuucaagauucgcuccgggaaaucaaguaucaugcgaagcgacgcgccaaucggaaacuguaauuccgagugcauuacgccgaacggcucuauacccaaugauaagccuuuucaaaacguuaauagaaucacuuauggugcauguccaagguacgugaaacagaacacacuuaagcuggccaccgggaugcggaauguacccgaaaaacagacucguggaauuuucggcgcuaucgccggcuuuauagagaacgggugggaaggaaugguggacgguugguauggcuuccgccaccagaauagcgaggggacaggacaagcagcugauuugaagucaacccaggccgcgauuaaccagaucaauggcaaacucaacagacugaucgagaagacgaaugaaaaguuucaucaaauugagaaagaguucagugaagucgaagguaggauccaggacuuagagaaguacguggaggauaccaaaauugaccugugguccuauaacgccgaacuccuuguugcacuggagaaccagcacacaauagauuugacugacagcgaaaugaauaagcuauucgagcggacccgaaaacagcugcgcgaaaacgcugaggauauggggaauggcugcuuuaagaucuaccauaagugugacaacgccugcauuggaucuaucagaaauggcacauacgaucacgacguguauagggacgaggcucucaacaaucgguuccaaaucaaaggggucgaacugaagucaggauacaaagauuggauucuuuggauaaguuuugccaucagcugcuuccuguugugugugguacuccuggguuuuauuaugugggcaugccagaagggcaacauccgcuguaauauuugcaucuga

SEQ ID NO: 130689 - RNA, 1701 nt, Artificial Sequence
  derived and/or modified sequence opt3 from hemagglutinin__InfluenzaA__AFH00483
augaagaccaucauugcccugagcuacauacucugcaugguguucgcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguaaaaucugcgacagcccacacaggauucuagauggcaagaauuguacccucaucgacgcucugcuuggggauccgcauugcgacggauuucagaacaaagagugggaucuguucguggaaagauccaaggccuauucuaauuguuaccccuaugacgucccugauuacgcaucguugcggucacucguggccagcaguggcacucuggaguuuaacaaugaauccuucaacuggacagguguugcucagaaugggaccucuuaugcaugcaagcgcggaagcgugaaauccuuuuucucacgacugaacuggcuccacaaguuagaguacaaauauccagcccugaaugucacgaugcccaacaaugacaaguuugauaaacuuuacauauggggcgugcaucacccuaguacugacagcgaucaaaccucuuuguacguacaggcuuccggccguguuacagugucaacuaagagaagccagcagaccgucaucccaaacauugggaguaggcccugggugcggggagugucuucccgcaucagcauuuauuggacaaucgucaagccuggugacauacugcuaauuaacucgaccggcaaucucaucgccccaagaggguacuucaaaauuaggucuggaaaguccucaaucaugcggagugacgcgccgaucggcaacuguaauagcgagugcauuacgcccaacgguuccauaccuaaugauaaaccauuucaaaacguuaaucgcaucacuuauggggcauguccccgauacgugaagcagaacacacugaaacuugccaccggaaugagaaauguaccugaaaagcagacuaggggcauuuucggcgcuaucgccggguuuauagagaacggaugggaagguaugguggacggcugguauggguuccggcaccaaaauucugagggaacaggccaggcagcugaucugaaaagcacccaggccgcgauuaaccagaucaaugguaaguugaaccgucucaucgagaagacgaaugaaaaauuucaucaaauugagaaggaguucucagaagucgaagggcgcauccaggaccuggagaaauacguggaggauaccaagauugacuuauggaguuauaacgccgaacugcucguugcacuugagaaccagcacacaauagaucugacugacuccgaaaugaauaaauuguucgagagaaccaggaagcagcuacgggaaaacgcugaggauaugggcaauggaugcuuuaagaucuaccauaaaugugacaacgccugcauuggcagcauccgaaaugggacauacgaucacgacguguaucgcgacgaggcucugaacaauagauuccaaaucaagggagucgaacucaaaucugguuacaaggauuggauucuguggauaucauuugccaucaguugcuuccuucugugugugguauugcucggcuuuauuaugugggcaugccagaaagggaacaucagguguaauauuugcaucuga

SEQ ID NO: 130690 - RNA, 1701 nt, Artificial Sequence
  derived and/or modified sequence opt3 from hemagglutinin__InfluenzaA__AFH00494
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuauaaacgaaaauuucaacuggacagguguugcucaggacgggaagaguuaugcaugcaagcgaggauccgugaauaguuucuucagccgucucaacugguuacacaaacuggaguacaaguaucccgcccuuaaugucaccaugccuaacaauggcaaauuugauaaguuguacaucuggggcgugcaucacccauccacggacucagaucaaacuucucuguacguaagagcuagcgggaggguuaccgugucuacaaaacggucccagcagacugucauucccgacaucggauaucgcccuugggugagaggucagucaagcaggauuggcaucuacuggaccauagugaagccaggggacauucuacucaucaacaguacaggaaaccugauugccccgcggggcuauuucaagauccgcaaugguaaaucuuccaucaugcgaagcgaugcgcccauugggaacuguucgucugagugcauaaccccuaauggauccaucccaaacgacaagcccuuucaaaaugucaacagaauuacguacggcgcauguccuagguauguuaaacagaauacucuuaagcuggccacaggcaugcggaacgugccagaaaaacagacccgugggaucuucggagcuauagccgguuuuauugagaauggcugggaagggaugguagauggaugguacggcuuccgccaccagaacucagaggguacugggcaagcagcugacuugaagaguacacaggccgcgaucgaucagaucaauggcaaacucaacagacugguggagaagaccaaugaaaaguuucaucaaauugagaaagaauuuagcgaggucgaaggaaggauccaggacuuagagaaguauguggaggauacgaaaauugaccugugguccuacaacgccgaacuccuuguugcacuggagaaucagcacaccauagauuugacagacucugaaaugaacaagcuauucgagcggacucgaaaacagcugcgcgaaaacgcugaggauaugggcaaugggugcuuuaagaucuaccauaagugugacaacgccugcauuggaagcaucagaaaugguaccuauaaccacgacguguacagggaugaggcucucaauaaccgguuccaaaucaaaggcgucgaacugaagucaggguauaaagacuggauucuuuggauaaguuuugccaucuccugcuuccuguugugugugguacuccugggauuuauuaugugggcaugccagaagggcaauauccgcuguaacauuugcaucuga

SEQ ID NO: 130691 - RNA, 1701 nt, Artificial Sequence
  derived and/or modified sequence opt3 from hemagglutinin__InfluenzaA__AFH00505
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugugaaguccuuuuucucccgucucaacugguuacacaaacuggaguacaaguauccagcccuuaaugucacuaugcccaacaaugauaaauuugacaaguuguacauauggggcgugcaucacccuucaaccgauagugaccaaaucagccuguacguacaggcuucugggagaguuacaguguccacuaaaaggucacagcagaccgucauuccaaacaucggaagccggcccugggugcgcggugugaguucuauuaucuccauauauuggacaauugucaagccuggcgacauccuacucauuaauagcaccgggaaccugaucgccccaagaggauacuucaagaucaggucgggcaaaucuuccauuaugcggucagaugcgccgauagacaacuguaauagugagugcaucacgcccaacgguagcauuccuaaugauaagccauuucaaaacguuaaucgcaucacuuauggggcauguccccgauacgugaaacagaacacacuuaagcuggccaccggaaugagaaauguaccugaaaaacagacuaggggcauauucggcgcuauugccggguuuaucgagaacggaugggaagguaugguggacggcugguauggguuccggcaccagaauagcgagggaacaggccaagcagcugauuugaagucuacccaggccgcgaucaaccagauuaaugguaaacucaaccgucugaucgagaagacgaaugaaaaguuucaucaaauugagaaagaguucagcgaagucgaagggcgcauacaggacuuagagaaguacguggaggauaccaaaaucgaccuguggucauauaacgccgaacuccuuguugcacuggagaaucagcacacaauugauuugacugacagugaaaugaacaagcuauucgagagaaccaggaaacagcugcgggaaaacgcugaggauaugggcaauggaugcuuuaagaucuaccauaagugugacaacgccugcaucggcuccauucgaaaugggacauacgaccacgauguguaucgcgacgaggcucucaacaauagauuccaaauaaaaggagucgaacuuaagagcgguuacaaagauuggauccuuuggauuucuuuugccaucucaugcuuccuguugugugugguacuccugggcuuuauuaugugggcaugccagaaggggaacaucagguguaauauaugcaucuga

SEQ ID NO: 130692 - RNA, 1701 nt, Artificial Sequence
  derived and/or modified sequence opt3 from hemagglutinin__InfluenzaA__AFH00516
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuacaaacgaagguuucaauuggaccgggguugcucaagacggaaaguccuaugcaugcaagcgaggcucugugaacagcuuuuucucccgucugaauuggcuccacaaauuagaguacaaguauccagcccugaacgucacgaugcccaauaacgauaaauuugacaaacuuuacauauggggcgugcaucacccuucaacugauagugaccagaccagcuuguacguacaggcuucugggagaguuacaguguccacuaagaggucacagcaaaccgucaucccaaauauuggaagccggcccugggugcgcgguaucaguucuagaauuuccaucuauuggacaauagugaagccuggcgacauucugcuaaucaagagcaccgggaaccucauugccccaaggggauacuucaaaauccggaacggcaagucgucuaucaugcgcuccgaugcgccgauugacaauuguaacucagagugcauaacgcccaaugguaguaucccuaacgauaaaccauuucagaaugucaaccgaauuacuuauggggcaugucccagauacguuaagcagaauacacugaaacuugccaccggaaugaggaacgugccugaaaagcagacucggggcaucuucggcgcuauagccggguuuauugagaauggaugggaagguaugguagacggcugguauggguuccgucaccaaaacagcgagggaacaggccaggcagcugaucugaaauccacccaggccgcgaucgaccaaaucaaugguaaguugaaccgccucauugagaagacgaaugaaaaauuucaucagaucgagaaggaguucucugaaguggaagggaggauucaggaucuggagaaauacgucgaggacaccaagauagauuuauggagcuauaacgccgaacugcucguggcacuugagaaucagcacacaaucgaccugacugauucagaaaugaacaaauuguucgagagaacccggaagcaacuacgagaaaacgcugaggacaugggcaauggaugcuuuaagauuuaccauaaaugugacaacgccugcaucggcaguauccgcaaugggacauacgaucacgacguuuauagagaugaggcucugaacaauagguuccagauuaagggaguggaacucaaauccgguuacaaggacuggauacuguggaucagcuuugccauuucuugcuuccuucugugugucguguugcucggcuuuaucaugugggcaugccagaaagggaacauucgguguaauaucugcauauga

SEQ ID NO: 130693 - RNA, 1701 nt, Artificial Sequence
  derived and/or modified sequence opt3 from hemagglutinin__InfluenzaA__AFH00527
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuuaugcaugcaaacgacguagcaucaaguccuuuuucucaagacugaacuggcuccaccaauuaaaguacaaauauccagcccugaaugugacgaugcccaacaaugacaaguuugauaaacuuuacauuuggggaguccaucacccuaguacugacagcgaucagaccucuuuguacgcucaggccuccggcagggugacaguaucaacuaagcggagccagcaaaccguuaucccaaacauuggcagucgccccugggugagaggggucucuuccaggaucagcauacacuggacaauugugaaaccuggagacauccugcuaauuaacucgaccgguaaucucaucgcgccacggggcuauuucaagauccgcucugggaaguccucaauuaugcgaagugacgcaccgauaggaaaauguaacagcgagugcaucacgcccaauggcuccauuccuaacgauaagccauuucagaaugugaacagaaucacuuacggugccugucccagguaugucaaacagaauacacugaagcuggcuaccgggaugcggaacguuccugaaaaacagacucguggaauauucggcgccauugcaggcuuuaucgagaaugggugggaaggaaugguggacgguugguacggcuuccgccaucaaaacucugaggggacaggacaggcugccgaucuuaagagcacccaggcggccaucaaucaaauuaacggcaaauugaauagacucaucgagaagacgaacgaaaaguuucaccagauugagaaagaguucucagaaguagaagguaggauacaggaccuggagaaguauguggaggauaccaaaaucgacuuauggaguuacaaugcagaacugcucgucgcucuugagaaccagcauacaauugaucugacugacuccgaaaugaacaaguuguucgagcggacccgaaaacaacuacgcgaaaaugccgaggauauggggaacggcugcuuuaagaucuaucacaagugugacaaugcuugcaucggaagcauuagaaacggcacauacgaucacgacguguacagggacgaggcccugaauaaccgguuccagauaaaagggguugaacucaagucuggauauaaagauuggauccuguggauuucauuugcaaucaguugcuuccuucuguguguggucuugcucgguuuuauuaugugggccugccagaagggcaauauccgcuguaacauaugcaucuga

SEQ ID NO: 130694 - RNA, 1701 nt, Artificial Sequence
  derived and/or modified sequence opt3 from hemagglutinin__InfluenzaA__AFH00538
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagagaucuucaacagguaggauuugcgacaguccacaccggauccuagauggcgagaauuguacccucauagacgcucugcuuggggauccgcauugcgacggauuucagaacaaagaaugggaucuguucguggagcgcagcaaggccuauuccaauuguuaccccuaugacgucccugauuacgcaucuuugcgaucgcucguggccucaagcggcacucuggaauuuaacaaugagaguuucaacuggacagguguugcucagaaugggaccuccuaugcaugcaaacguagaucuaucaagagcuuuuucuccaggcugaacuggcuccaccaauuaaaguacaaauauccagcccugaaugugacgaugcccaacaaugacaaguuugauaaacuuuacauuuggggaguccaucacccuucaacugacagugaucagaccagcuuguacgcucaggccucuggccgggugacaguauccacuaagcgcucacagcaaaccguuaucccaaacauuggcagcagacccugggugaggggagucaguucucggaucuccauauauuggacaauugugaaaccuggggacauccugcuaauuaacagcaccgguaaucucaucgcgccacgcggcuacuucaagauccgaucggggaagucuuccauuaugagaucagacgcaccgauaggaaaauguaacagugagugcaucacgcccaauggcagcauuccuaacgauaagccauuucagaaugugaacaggaucacuuauggugccuguccccgguacgucaaacagaauacacugaaacuugcuaccgggaugcguaacguuccugaaaagcagacucgcggaauauucggcgccauugcaggcuuuaucgagaaugggugggaaggaaugguggacgguugguauggcuucagacaccaaaacuccgaggggacaggacaggcugccgaucugaagucuacccaggcggccaucaaucaaauuaacggcaaauugaauaggcucaucgagaagacgaacgaaaaguuucaucagauugagaaagaguucagcgaaguagaaggucggauacaggaccuggagaaguacguggaggauaccaaaaucgacuuauggucauauaaugcagaacugcucgucgcucuugagaaccagcacacaauugaucugacugacagugaaaugaacaaguuguucgagcgaacccgcaaacaacuaagagaaaaugccgaggauauggggaacggcugcuuuaagaucuaccauaagugugacaaugcuugcaucggauccauuaggaacggcacauacgaucacgacguguaucgggacgaggcccugaauaaccgcuuccagauaaaagggguugaacucaagagcggauacaaagauuggauccuguggauuucuuuugcaaucucaugcuuccuucuguguguggucuugcucgguuuuauuaugugggccugccagaagggcaauaucagauguaacauaugcaucuga

SEQ ID NO: 130695 - RNA, 1701 nt, Artificial Sequence
  derived and/or modified sequence opt3 from hemagglutinin__InfluenzaA__AFH00549
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucagaaugggaccucuagcgcaugcaaacgacguuccauaaagucauuuuucaguagacucaacugguuacaccaacugaaguauaaauacccagcccuuaaugugacgaugcccaacaaugacaaguuugauaaauuguauaucuggggaguccaucacccuagcacugacucugaucagaccucccuguacgcucaggccccaggcagggugacaguaucaacucggcgcagccagcaaaccguuauucccaacaucggcaguagaccuugggugaggggagucucuuccauuaucagcauauacuggacaauugugaagccaggggacauccuacucauuaacucgaccgguaaucugaucgcgccgcggggcuauuucaaaauccgcucugggaaguccucaauuaugcgaagugacgcacccauaagcaaguguaacuccgagugcaucacgccuaauggaucuauuccaaacgauaaacccuuucagaaugugaacagaaucacuuacggcgccuguccuagguaugucaagcagaauacacuuaaacuggcuaccgguaugcggaacguuccagaaaagcagacucgugggauauucggagccauugcaggcuuuaucgagaauggcugggaagggaugguggacggaugguacgguuuccgccaccaaaacagcgagggcacagggcaggcugccgauuugaaaucaacccaggcggccaucaaucaaauuaacggaaagcucaauagacugaucgagaaaacgaacgaaaaguuucaucagauugagaaggaguucagugaaguagaaggcaggauacaggacuuagagaaauauguggaggauaccaagaucgaccugugguccuacaaugcagaacuccuugucgcucuggagaaccagcacacaauugauuugacugacagcgaaaugaacaaacuauucgagcggacccgaaagcaacugcgcgaaaaugccgaggauauggguaacgggugcuuuaaaaucuaucauaagugugacaaugcuugcaucggcucuauuagaaacggaacauacgaucacgacguguacagggacgaggcccucaauaaccgguuccagauaaagggcguugaacugaaaucaggguauaaggauuggauccuuuggauuaguuuugcaaucagcugcuuccuguugugugugguccuccugggauuuauuaugugggccugccagaaagguaauauccgcuguaacauaugcaucuga

SEQ ID NO: 130696 - RNA, 1701 nt, Artificial Sequence
  derived and/or modified sequence opt3 from hemagglutinin__InfluenzaA__AFH00560
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacauuccacaucagauccucgauggugagaauuguacccugauagacgcucuacugggcgauccgcacugcgacggguuucagaacaaagaaugggauuuguucgucgagaggagcacugccuauuccaauuguuaccccuaugacgugccugauuacgcaucucuccggucgcugguugccucaagcggaacacuggaauuuaacaaugagaguuucaacuggaccggcguggcucagaaugguacguccucugcaugcaagcgccgaagcaucaaauccuuuuucucacgucucaacugguuacaucaacugaaguauaaguacccagcccuuaaugucacuaugcccaacaaugagaaauuugacaaguuguauauuuggggagugcaccacccuaguaccgauagcgaccagaucucucuguacgcucaggccccagggagaguaacaguuuccacuaaaaggucacagcaaaccgugauucccaacaucggcagccggccuuggguccgcggcgugaguucuagaauauccauuuacuggacaaucgugaagccaggggauauucuacucaucaacagcaccggaaaucugaucgcgccgagggguuauuucaaaauucggucgggcaagucuuccauaaugcgcucagacgcacccaucgggaaguguaacagugaaugcauuacgccuaauggaagcaucccaaacgacaaacccuuucagaaugucaaccgaauaacuuacggcgccuguccuagauauguuaagcagaauacacuuaaacuggcuaccgguaugaggaacgugccagagaagcagacucgggggauuuucggagccaucgcaggcuuuaucgaaaauggcugggaggggaugguagauggaugguacgguuuccgucaucaaaacuccgagggcacagggcaggcugccgacuugaaaucuacccaggcggccauuaaucaaaucaacggaaagcucaaucgccugauugagaaaacgaacgaaaaguuucaccagauagaaaaggaguucagcgaagcagagggcagaauccaggauuuagagaaauauguggaagacaccaagauugaucuguggucauacaaugcugagcuccuugucgcccuggaaaaccagcauacaaucgacuugacugauagugagaugaacaaacuauucgaaaggacccggaagcaacugcgagagaaugcugaggacauggguaacgggugcuuuaaaaucuaucacaagugugauaaugccugcauuggcuccauacgcaacggaacauacgaccacgauguguacagagacgaagcacucaauaacagguuccagaucaagggcguugagcugaaaagcggguauaaggacuggauucuuuggaucucuuuugccauuucaugcuuccuguuguguaucgugcuccugggauuuauaaugugggcuugccagaaagguaauauccgguguaacauuugcaucuga

SEQ ID NO: 130697 - RNA, 1701 nt, Artificial Sequence
  derived and/or modified sequence opt3 from hemagglutinin__InfluenzaA__AFH00571
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugauaacauugagguaacuaaugcgaccgaacuugugcaaucuucaaguacaggaagaaucugcgacagcccacaccagauucucgauggugagaacuguacccugaucgacgcucuacugggcgauccgcauugcgacggguuucagaauaaagaaugggauuuguucgucgagagguccacugccuauucuaacuguuaccccuaugacgugccugauuacgcaucgcuccggucacugguugccagcaguggaacacuggaauuuaauaacgaguccuucaauuggaccggcguggaccagaacgguacgucuagcgcuugcaagcgccgauccaauaaaucauuuuucagucgucucaacugguuacaccaacugaaguauaaguacccagcacuuaaugucacuaugcccaacaacgagaaauuugauaaguuguauauauggggagugcaucacccuagcaccgacucugaucagaucucccuguacgcccaggcuucagggagaguaacaguuagcacuaaaaggagucagcaaaccgugauuccaaauaucggcucucggcccuggguccgcggcguguccagcagaauuucgaucuacuggacaauagugaagccuggggacauucuacucaucaacucuaccggaaaucugauugccccaagggguuauuucaaaauccgguccggcaagucaaguaucaugcgcagcaacgcgccgauugggaaguguaauuccgaaugcauaacgcccaacggaucuaucccuaaugacaaaccauuucagaacgucaaucgaauuacuuacggcgcaugucccagauauguuaagcagaacacacuuaaacuggccaccgguaugaggaaugugccugagaagcagacucgggggaucuucggagcuauagccggcuuuauugaaaacggcugggaggggaugguagauggaugguacgguuuccgucaccaaaauagcgagggcacagggcaggcagcugacuugaaaucaacccaggccgcgaucaaccaaaucaauggaaagcucaaccgccugauugagaaaacgaacgaaaaguuucaucagaucgaaaaggaguucagugaaguggagggcaggauucaggauuuagagaaauaugucgaagacaccaagauagaucugugguccuacaaugccgagcuccuuguggcacuggaaaaccagcacacaaucgacuugacugauagcgagaugaauaaacuauucgaaagaacccggaagcaacugcgagagaacgcugaggacauggguaaugggugcuuuaaaauuuaucauaagugugauaacgccugcaucggcucuauccgcaauggaacauacgaccacgauguuuacagagacgaagcucucaacaauagguuccagauuaagggcguggagcugaaaucaggguauaaggacuggauacuuuggaucaguuuugccauuagcugcuuccuguugugugucgugcuccugggauuuaucaugugggcaugccagaaagguaacauucgguguaauaucugcauauga

SEQ ID NO: 130698 - RNA, 1701 nt, Artificial Sequence
  derived and/or modified sequence opt3 from hemagglutinin__InfluenzaA__AFH00582
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaagaaugggauuuguucguggagagauccaaggccuauucuaauuguuaccccuaugacgucccugauuacgcaucgcucaggucacugguggccagcagugguacucuggaauuuaacaaugaguccuucaacuggacagggguugcucaaaauggaaccucuagcgcaugcaaacggcgcuccaacaagucauuuuucagucgacucaauugguuacaccagcugaaguauaaauacccagcccuuaacgugacgaugcccaauaacgagaaguuugacaaauuguauauauggggcguccaucacccuagcacugauucugaccagaucucccuguacgcucaggccccaggccgugugaccguaucaacaaagagaagccaacagacuguuauucccaacaucgggaguaggccuugggugcggggagucucuucccgcauuagcaucuacuggaccauagugaaaccaggugauauucuacucaucaauuguacaggcaaccugauugcgccgagaggguauuucaagaucaggucgggaaagucuuccaucaugcggucagacgcaaguauuggcaaaugcaauagcgaauguauaacccccaacgguuccaucccuaaugacaagccauuucagaacgugaaucgcauuacguacggggccugcccccgauaugucaaacagaacacucuuaagcuggcuacaggaaugagaaauguuccugagaaacaaaccaggggcaucuucggcgccauagcaggguuuauugaaaacggaugggaggguaugguggauggcugguacggguuccggcaccagaauagcgagggaacuggccaggcugccgacuugaagucuacacaagcggccaucaaccagaucaaugguaaacucaaccgucugauugaaaagaccaaugagaaguuucaucagaucgaaaaagaguucucagaaguagaggggcgcauucaggauuuagagaaguauguggaagacacgaaaauagaucuguggaguuacaacgcagagcuccuugucgcucuggaaaaccaacacaccaucgacuugacagauuccgagaugaauaagcuauucgaaagaacuaaaaagcagcugagggagaacgccgaggacaugggcaauggauguuuuaagauuuaucauaaaugcgauaacgcuugcaucggcagcauccggaaugggaccuacgaccacgauguguaccgagacgaagcccucaacaaucgcuuccagauuaagggaguugagcugaaaucugguuauaaggacuggauacuuuggaucucauuugcaacaaguuguuuccuguugugcgugguccuccugggcuuuauuaugugggccugucagaaagggaacaucagaugcaauauuuguaucuga

SEQ ID NO: 130699 - RNA, 1701 nt, Artificial Sequence; identical to SEQ ID NO: 123321
  derived and/or modified sequence opt3 from hemagglutinin__InfluenzaA__AFH00593

SEQ ID NO: 130700 - RNA, 1701 nt, Artificial Sequence; identical to SEQ ID NO: 123321
  derived and/or modified sequence opt3 from hemagglutinin__InfluenzaA__AFH00604

SEQ ID NO: 130701 - RNA, 1701 nt, Artificial Sequence
  derived and/or modified sequence opt3 from hemagglutinin__InfluenzaA__AFH00615
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaagucauuuuucagucgacugaacuggcucacucauuuaaaauauaaguacccagcacugaaugugaccaugcccaacaacgagaaauuugauaaacuuuauaucuggggcguccaccauccuggcacagacagcgaucagauuucuuuguacgcccaggcuuccgggcguaucacugugucaaccaagagaagccaacagacaguaauuccaaauaucggaaguaggccccggguucgcgacauaucuuccagaauuagcaucuacuggaccauugugaagccuggugauauccugcuaaucaacucgacgggcaaucucauugccccaaggggguauuucaagauacggucuggaaaauccucaaucaugcgcagugacgcgccgauuggcaaguguaacagcgagugcaucacucccaaugguuccauaccuaacgacaaaccauuucagaaugucaaccgaauuacauacggggcaugucccagauaugugaagcagaauacccugaaacuugccacuggaaugaggaacgugccugaaaagcaaacacggggcaucuucggcgcuaucgccggguuuauugagaauggaugggaagguauggucgauggcugguacggguuccgucaccagaacucugagggaaccggccaggcagcugaccugaaaagcacgcaagccgcgaucaaucagauuaacgguaaguugaaucgccucauagggaagaccaacgagaaauuucaccagaucgaaaaggaguucucagaaguugagggcaggauucaggauaucgaaaaauauguggaggacacaaagaucgaucuguggaguuacaacgccgaguuacugguagcacucgaaaaucaacauacuauugaccuuaccgauuccgagaugaacaaacuguucgaaagaacaaagaagcaguugcgggagaaugcugaagacaugggaaacggcugcuuuaaaauauaucacaagugugauaaugccugcaucgagagcauucgaaacgggacuuacgaccaugauguguaccgcgacgaggcucuaaauaacagauuccagaucaaaggagucgaacugaagucugguuauaaagacuggauucucuggaucucauuugccauaaguugcuuccugcuuuguguggcacuguugggcuuuaucaugugggccugccagaaggggaauauuagguguaacaucugcauuuga

SEQ ID NO: 130702 - RNA, 1701 nt, Artificial Sequence; identical to SEQ ID NO: 130293
  derived and/or modified sequence opt3 from hemagglutinin__InfluenzaA__AFH00626

SEQ ID NO: 130703 - RNA, 1701 nt, Artificial Sequence
  derived and/or modified sequence opt3 from hemagglutinin__InfluenzaA__AFH00637
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcuccugcaagcggcgcucaaacaauagcuuuuucagucgacugaacuggcucacucauuuaaaguuuaaauauccagcucugaaugugaccaugcccaacaacgagaaguucgacaaacuuuacaucuggggcguccaccauccuggcacaaauaacgaucagauuucuuuguauacucaggcauccgggcguaucaccgugucaacaaagagaagccaacagaccguaauuccaaauaucggaaguaggccccggguucgcgacauaccuucuagaauuuccaucuacuggacgauugugaaaccaggugauauccugcuaaucaacagcacuggcaaucucauugccccgaggggguacuuuaagauacggucgggaaagucuuccaucaugcgcucagacgcucccauuggcaaauguaacagugagugcaucacaccuaaugguagcauaccaaacgacaagcccuuccagaaugucaaccgaauuaccuauggggccuguccuagauacgugaaacagaauacucugaaacuugcgacaggaaugaggaacgugccagaaaaacaaacccggggcaucuuuggcgcaaucgccggguucauugagaauggaugggaagguauggucgauggcugguauggguuucgucaccagaacuccgagggaaucggccaggcugccgaccugaagucuacgcaagcagcuauuaaucagauaaacgguaaauugaaccgccucaucgggaagaccaaugagaaguuccaccagauugaaaaagaguucagcgaaguugagggcagaauccaggaucuggaaaaguacguggaggacacaaaaaucgauuuauggucauauaacgccgagcugcucguagcgcuugaaaaucaacauacuauugaccugaccgauagugagaugaacaaguuguuugaaaggacaaagaagcagcuacgggagaaugccgaagacaugggaaacggcugcuucaagauauaccacaaaugugauaaugcaugcaucggguccauucgaaacggaacuuaugaccaugauguguaccgcgacgaggcucugaauaacagauuucagaucaagggugucgagcucaaaagcggcuacaaggacuggauucuguggaucucuuucgccauaucaugcuuucuucuguguguggcuuugcucggguucaucaugugggccugccagaaaggaaauauuagguguaacaucugcauuuga

SEQ ID NO: 130704 - RNA, 1701 nt, Artificial Sequence
  derived and/or modified sequence opt3 from hemagglutinin__InfluenzaA__AFH00648
augaagaccaucauugcccugagcuacauacucugccuuguguucgcucagaaacugcccggcaacgacgauuccacagcaacuuuguguuuagggcaccaugccgucccuaauggaacgaucguuaagaccauuacaaacgaccaaaucgaggugacuaaugcgaccgaacugguacagucuucaaguacagguggcauuugcgauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaaugaugaauccuucaacuggacagggguuacccagaauggaacgucuagcuccugcaagcggcgcucaaacaauagcuuuuucagccgacugaacuggcucacucauuuaaaguuuaaauauccagcucugaaugugaccaugcccaacaaugagaaguucgacaaacuuuacaucuggggcguccaccauccugugacagauaacgaccagauuuuucuuuaugcacaggccucuggccguaucacuguauccaccaagagaucacaacagacaguuauuccaaacaucgggagcaggccccggauacgcaauauuccuaguagaaucucuauuuacuggaccaucgugaaaccaggagacauccugcuaauuaacuccacggguaaucucauagcuccgaggggcuacuucaagauccggagcgggaagucgucuauuaugcgcuccgaugcccccaucggaaaauguaacucagagugcauaacuccuaauggcaguauuccaaacgacaagcccuuucagaaugucaaccgaaucacauauggugcguguccuagauacgugaaacagaauacccugaaguuggcaacugggaugaggaacgugccagaaaaacaaacacggggaaucuucggcgccauugcuggcuuuaucgagaaugggugggaaggaauggucgaugguugguauggcuuccgucaccagaacagcgaggggauuggacaggccgcagaccugaaguccacccaagcugccauaaaucagaucaacggcaaauugaaucgccucauugguaagacgaacgagaaguuccaccagaucgaaaaagaguuuucugaaguugaggggagaauccaggaucuggaaaaguacguggaggacaccaaaauugauuuauggagcuauaacgcggagcugcucguagcccuugaaaaucaacauacaauagaccugacugauucagagaugaacaaguuguucgaaaggaccaaaaagcagcuacgggagaaugcagaagacaugggcaacggaugcuuuaagaucuaccacaaaugugauaaugcuugcauuggcaguauccgaaacgggacauaugaccaugacguguaccgcgaugaggcccugaauaacagauuccagauuaagggagucgagcucaaauccgguuacaaggacuggauccuguggauaaguuuugcuaucucuugcuuccuucuguguguggccuugcucggcuuuauuaugugggcaugccagaaagggaauaucagguguaacauuugcaucuga

SEQ ID NO: 130705 - RNA, 1701 nt, Artificial Sequence
  derived and/or modified sequence opt3 from hemagglutinin__InfluenzaA__AFH00659
augaagaccaucauugcccugagcuacauacucugccuuguguucacacagaaacugcccggcaacgacaauuccacugcuacguuguguuuagggcaccaugcagucccuaacggaaccaugguuaagacaaucacuaaugaucaaauugaggugaccaacgccacagaacugguacagucuucaaguaccggugagaucugcgacagcccacaccagauucuagauggcgaaaauuguacucucaucgacgcgcugcuuggggauccgcagugcgacggauuucaaaacaaaaagugggaucuguucguggagagauccaaagcucauucuaauuguuaucccuacgacgucccugauuaugccucguugaggucacucauagcaagcaguggcacacuggaauuuaacaaugaguccuucaacuggaccggugugacgcagaaugggacuucuagcgccugcaagcggcgcuccgacaacucauuuuucagucgacugaauuggcucacccacuuaaaguuuaaauacccagcucugaacguuacaaugcccaauaacgaggaguucgauaaacuuuauaucuggggagugcaucacccuggcacugacaacgaucagauuagcuuguacgcacaggccucuggccguaucaccgucuccacaaagagaucacaacagaccgugauuccaaauaucgggagcaggccccggguacgcgacauaccuaguagaauuucuaucuauuggacgauuguuaagccaggagacauccugcuaaucaacuccacugguaaucucauugcuccgaggggcuacuuuaaaauacggagcgggaagucgucuaucaugcgcuccgaugcccccauuggaaaguguaacucaggcugcaucacaccuaaugguaguauaccaaacgacaaacccuuccagaaugugaaccgaauuaccuacggggcguguccuagauaugucaagcagaauacucugaaacuugcaacaggaaugaggaacgugccagaaaagcaaacccggggcaucuuuggcgccaucgcuggguucauugaaaauggaugggaggguaugguggauggcugguacggguuucgucaccagaacagcgagggaaucggccaggccgcagaccugaaauccacgcaagcugccauugaucagauaaaugguaaguugaaccgccucaucgggaaaaccaaugaaaaguuccaucagauugagaaggaguucucugaagucgaaggcagaauccaggaccuggagaaauauguugaggauacaaagaucgacuuauggagcuacaacgcggaacugcucguggcccuugagaaccaacacacuauugaucugaccgacucagaaaugaauaaauuguuugagaggacaaagaaacagcuacgggaaaacgcagaggauaugggaaauggcugcuucaagauauaucauaagugugacaacgcuugcaucgggaguauucgaaauggaacuuacgaccacgauguauaucgcgacgaggcccugaacaauagauuucagaucaaagguguggaacucaaguccggcuacaaagauuggauucuguggaucagcuucgcuauaucuugcuuucuucugugugucgccuugcucggguucaucaugugggcaugccagaagggaaacauuagguguaauaucugcauuuga

SEQ ID NO: 130706 - RNA, 1701 nt, Artificial Sequence
  derived and/or modified sequence opt3 from hemagglutinin__InfluenzaA__AFH00670
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagaacucuucaacagguggcaucugcgacaguccacaccagauacuagauggggagaauuguacccucaucgacgcucugcuuggagauccgcagugcgacggcuuucaaaacaaaaagugggaucuguucguggaaagaagcaaagccuauuccaauuguuaccccuaugacgucccugauuacgcaucuuugaggucgcucguggccucaagcgguacucuggaguuuaacaaugaaaguuucaacuggacagggguuacccagaauggaacguccucugcuugcaagcggggcagcaacaauuccuuuuucucacgccugaacuggcucacucauaguaaguuuaaauauccagcauuaaaugugaccaugcccaacaacgaggaguucgacaagcuguacauuuggggcguccuucacccugggacagauaaugaccagaucuuuuuguaugcccaggcuagcggacgaauuacugugucuaccaaacguucccaacagacaguaaucccaaacauagguucaagacccaggguucggaauauuccuagccgcaucaguauuuacuggaccaucgugaagccaggcgauauccugcuaauuaacucuacggggaaucucauagccccgagaggauacuucaaaaucagguccggcaagagcucgauuaugcggucugacgcgcccaucgguaaguguaacuccgaaugcauaacuccuaaugggucaauuccaaacgacaaacccuuucagaaugucaaccgcaucacauauggagcauguccucgauacgugaagcagaauacccugaaacuugccacuggcaugagaaacgugccagagaagcaaacaaggggcaucuucggggcuauugccggauuuaucgaaaaugguugggagggcauggucgaugggugguauggauuccggcaucagaacagugagggcauuggucaggcagcugaccugaaaagcacccaagccgcgauagaucagaucaaugggaaguugaaccgucucauuggcaaaacgaacgaaaaguuccaccagaucgagaaggaauuuuccgagguugaaggacgcauccaggaccuggagaaauacguggaggauaccaagauugacuuauggucuuauaaugccgaacugcucguagcacuugagaaccaacacacaauagaucugacugacagcgaaaugaauaaauuguucgagaagaccaaaaagcagcuaagagaaaacgcugaggauaugggcaaugggugcuuuaagaucuaccauaaaugugacaacgccugcauuggaucaaucaggaaugguacauaugaucacgacguguaccgggacgaggcucugaacaaucgauuccagauuaagggcgucgaacucaaaaguggguacaaggauuggauccuguggauauccuuugccaucagcugcuuccuucuguguguggcauugcucggauuuauuaugugggccugccagaaaggcaacauccgcuguaauauuugcaucuga

SEQ ID NO: 130707 - RNA, 1701 nt, Artificial Sequence
  derived and/or modified sequence opt3 from hemagglutinin__InfluenzaA__AFH00681
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucaucgagagauccaaagccuauucuaauuguuaccccuaugacgugccugauuacgcaucguugaggucacucgucgccagcaguggcacucuggaauuuaacaaugaguccuucaacuggacaggugugacccagaaugggacgucuagcgcuugcauucggcgcuccaacaauucauuuuucagucgacugaacuggcucacucauuuaaaguuuaaguauccagcacugaauguuaccaugcccaacaaagagaaguucgacaaacuuuacaucuggggagugcaccauccuggcacagauaacgaccagaucuuuuuguaugcccaggcuagcggccguauuacugucucuaccaagagaucccaacagacagugauaccaaauauugggucaaggccccggguacgcaacaucccuagcagaauuaguaucuacuggaccaucguuaaaccaggagauauucugcuaauaaauucuacggguaaccucaucgccccgaggggcuacuucaagauucgguccggaaagagcucgaucaugcgcucugacgcgcccauagggaaauguaauuccgaaugcauuacuccuaacggcucaaucccaaaugacaagcccuuucagaacgugaaucgaaucacauauggugcauguccuagauacgucaaacagaacacccugaagcuggccacugggaugaggaaugugccagagaaacaaacacggggaauuuucggcgcuaucgccggcuuuauugaaaacgggugggagggaaugguggaugguugguauggcuuccgucaccagaauagugaggggauaggacaggcagcugaccuuaagagcacccaagccgcgaucgaucagauuaacggcaaauugaaucgccucaucgguaagacgaacgaaaaguuccaccagaucgagaaagaauuuuccgaggucgaagggaggauucaggaccuggagaaguacguugaggauaccaaaauagacuuauggucuuauaacgccgaacugcucguggcacuugagaaucaacauacaaucgaucugacugacagcgaaaugaacaaguuguucgagaaaaccaagaagcagcuaagagaaaaugcugaggauaugggcaacggaugcuuuaaaauuuaccacaagugugacaaugccugcaucggcucaauucggaacgggacauaugaucaugacguauaccgagacgaggcucugaauaaccgcuuccagaucaaaggaguggaacucaagagugguuacaaagauuggauacuguggaucuccuuugccauuagcugcuuccuucugugugucgcauugcucggcuuuaucaugugggccugccagaaggggaauauuagauguaacaucugcauauga

SEQ ID NO: 130708 - RNA, 1701 nt, Artificial Sequence; identical to SEQ ID NO: 123944
  derived and/or modified sequence opt3 from hemagglutinin__InfluenzaA__AFH00692

SEQ ID NO: 130709 - RNA, 1701 nt, Artificial Sequence
  derived and/or modified sequence opt3 from hemagglutinin__InfluenzaA__AFH00703
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguaaaauuugcgacagcccacaccagauccuagauggcaagaauuguacccucauagacgcucugcuuggggauccgcagugcgacggauuucaaaacaaaaagugggaucuguucguggagagauccaaggccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaaaaacucauuuuucagucgacugaauuggcucacucauuuaaacuuuaaguauagcgcacugaaugugaccaugccaaacaacgaacaguucgacaaacuuuacauuuggggaguccaccaucccggcacagauaaggaccagaucuuuuuguaugcccaggcuucuggccguauuacuguguccaccaaaagaucacaacagacaguaaucccuaauauagggagcaggccacggguucgcaacauucccaguagaaucucuauuuacuggaccaucgugaagccuggagauauccugcuaauuaauuccacggguaaccucauagccccaaggggcuacuucaagaugcagagcgggaaaucgucuaucaugcgguccgacgcgccgauuggaaaguguaauucagagugcaucacucccaacggcaguauaccuaaugacaaaccauuucaaaacgucaaucgcauuacauauggugcauguccccgauacgugaagcagaacacccugaaacuugccacugggaugagaaaugugccugagaagcagacaaggggaaucuucggcgcuaucgccggcuuuauugaaaacgggugggagggaauggucgaugguugguauggcuuccggcaccaaaauagcgaagggcguggacaggcagcugaccugaaauccacccaggccgcgaucgaucagauuaacggcaaguugaaucgccucauagguaagacgaacgagaaauuccaccaaaucgagaaggaauuuucugagguugaagggaggauucaggaccuggagaaauacguggaagauaccaagaucgacuuauggagcuauaacgccgagcugcucguagcacuugagaaucagcauacaaucgaucugacugacucagaaaugaacaaauuguucgagaagaccaagaaacagcuaagagaaaaugcugaggauaugggcaacggaugcuuuaagauuuaccacaaaugugacaaugccugcauaggcaguauccggaacgggacauaugaucaugacguguaccgagacgaagcucugaauaaccgcuuccaaauuaagggagucgagcucaaauccgguuacaaggauuggauccuguggauuagcuuugccaucucuugcuuccuucuguguguggcauugcucggcuuuauaaugugggccugccagaaggggaauaucagauguaacauuugcaucuga

SEQ ID NO: 130710 - RNA, 1701 nt, Artificial Sequence
  derived and/or modified sequence opt3 from hemagglutinin__InfluenzaA__AFH00714
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucaucgacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuauaaaugaagguuucaacuggacagggguuacccaguccggaggcucuuacgcuugcaaacgaggcagcgacaaguccuuuuucucacgucugaauuggcucuaugagagugagagcaaguacccaguguuaaacgucacgaugcccaauaacgggaauuuugauaaacuguauaucuggggagugcaccauccuucuacugacaaggaacaaaccaaccuuuacguaagagcauccgguaggguuacagugucaacuaaacggagccagcagaccauuaucccaaacauuggcagucgccccugggucagaggguugucuuccggaaucagcauauacuggacaauugugaagccuggcgauauccugcuaauuaauucgaacgguaaucucaucgccccaaggggguauuucaaaauccggaccggaaagucuuccauuaugcgcucagacgcuccgauaggcacguguaguagcgagugcaucacucccaacggcuccauuccuaaugacaagccauuucagaacgugaauaaaaucacauacggggccugucccaaguaugucaaacaaaacacccugaagcuggcgacuggaaugcgaaauguuccugaaaaacagacaagagguauauucggcgcaauugccggguuuaucgagaacggaugggagggcaugguggaugguugguacggguucaggcaccaaaauucugaaggcaccggacaggcugccgaccuuaagagcacgcaggcagcuaucgaucagauuaacggcaaauugaaucggguaaucgagaagaccaacgaaaaguuccaccagauugagaaagaauuuucagagguggaggggcguauacaagaccucgaaaaguaugucgaggauacaaaaaucgaccuguggaguuacaaugccgaauuacugguggcgcucgagaaccagcauacuauugaucuuaccgacuccgaaaugaacaagcuguucgagaaaacacgcagacaguugagggagaaugccgaagauaugggaaacgguugcuuuaagaucuaucacaagugugacaaugcaugcaucggcagcauucggaacgggacuuacgaucaugacguuuaccgagacgaggcucuaaauaaccgcuuccagauaaaaggaguggaacugaagucuggcuauaaagauuggauccucuggauuucauuugccaucaguugcuuccugcuuugugucgugcuguuggguuuuauuaugugggcuugccaaaaggggaauaucagauguaacauaugcaucuga

SEQ ID NO: 130711 - RNA, 1701 nt, Artificial Sequence
  derived and/or modified sequence opt3 from hemagglutinin__InfluenzaA__AFH00725
augaagaccaucauugcccugagcuacauauucugccucaucuuugcucagaaccuucccggcaaugacaacuccacagcaacucuguguuuggggcaccaugccgugccuaauggaacguuagucaaaaccauuacaaacgaucaaaucgagguuacuaaugcgaccgaacuggugcagucuucaaguacagguagaauuugcgacagcccacacaggauccuagauggcaagaacuguacccucauagacgcucugcuuggggauccgcauugcgacggauuccagaaugagaaaugggaucuguuuguagaacgguccaaggccuucucuaacuguuaucccuacgacgugccugauuaugcaucguugcgcucacucgucgccagcaguggcacucuggaguuuaucaaugaagguuucaacuggacaggggugacccaguccggaggcucuuacgcuugcaaacgaggcagcgacaauuccuuuuucucacgucugaacuggcucuaugagagugagagcaaguacccaguuuuaaaugugacgaugcccaacaaugggaaguuugauaaacuguauauuuggggaguccaccauccuucuacugacaaggaacaaaccaaacuuuacgugagagcauccgguaggguaacaguuucaacuaagcggagccagcagaccgugaucccaaacauuggcagucgccccugggucagaggguugucuuccaggaucagcauauacuggacaauugugaaaccuggagauauccugcuaauuaacucgaccggcaaucucaucgccccacgggguuauuucaagauccgcacggggaagucuuccauuaugcgaucagacgcuccgauaggaacuuguaguagcgagugcaucacacccaacggcuccauuccuaaugacaaaccauuucagaacgugaauaagaucaccuacggcgccugucccagauaugucaaacaaaacacucugaagcuggcgacagggaugaggaauguuccugaaaaacagacccggggaauauucggugcaauugccggcuuuaucgagaacgggugggagggaaugguggauggcugguacgguuuccgucaccaaaauucugaagggacgggccaggcugccgaccuuaagagcacccaggcagcuaucgaucagauuaacggaaaauugaaucgcguaaucgagaagacaaacgaaaaguuccaccagauugagaaagaauuuucagagguggagggcagaauacaagaccucgaaaaguaugucgaggauacuaaaaucgaccuguggaguuacaaugccgaauuacugguggcgcucgagaaccagcauaccauugaucuuacagacuccgaaaugaauaagcuguucgagaaaacuaggaagcaguugcgggagaacgccgaagauauggggaacggaugcuuuaagaucuaucacaaaugugacaaugcaugcaucgguagcauucgaaacggcaccuacgaucaugacguuuaccgcgacgaggcucuaaauaacagauuccagauaaaggggguggaacugaaaucuggauauaaggauuggauccucuggauuucauuugccaucaguugcuuccugcuuugugucgugcuguugggcuuuauuaugugggcuugccaaaaagguaauaucagguguaacauaugcaucuga

SEQ ID NO: 130712 - RNA, 1701 nt, Artificial Sequence; identical to SEQ ID NO: 129082
  derived and/or modified sequence opt3 from hemagglutinin__InfluenzaA__AFH00736

SEQ ID NO: 130713 - RNA, 1701 nt, Artificial Sequence
  derived and/or modified sequence opt3 from hemagglutinin__InfluenzaA__AFH00747
augaagaccaucauugcccugagcuacauauucugccucguguuugcucagaaacuucccggcaacgacaauuccacagcaacucuguguuuggggcacuaugccgucccuaacggaacguuaguuaagaccaucacaaaugaucaaauugaggugacuaacgcgaccgaacugguacagucuucaaguacagguagaaucugcgacagcccacauaggauucuagauggcaaaaauuguacccucaucgacgcucugcuuggggauccgcacugcgacggauuccagaacgagaagugggaucuguuuguggaacgguccaaagccuacucuaauuguuaucccuacgacgucccugauuaugcaucguugcgcucacucguggccagcaguggcacucuggaguucauaaacgaagacuuuaauuggacagguguuacccaguccgggggaucuuacgcuugcaagcgaggcagcgugaaguccuucuuuucacgucugaacuggcuccaugagagugaguauaaauacccagcauuaaaugucacgaugcccaacaauggcaaguucgauaaacuguacaucuggggagugcaccauccuagcacugacagagaacaaaccaaccuuuauguaagggccucugggcggguuacaguguccacuaagcgcucacagcagaccgucauuccaaauaucgguagcagacccugggugaggggcuugaguucucggauuuccaucuacuggacaauagugaaaccuggggauauucugcuaaucaacagcaccggaaaccucauugcuccacgcggcuauuuuaagauccgaacggguaagucgucuaucaugagauccgacgccccgauugggacuuguucaagugagugcauaacacccaauggaagcaucccuaacgacaaaccauuccagaaugucaacaagauuaccuacggcgcgugucccagguauguuaaacaaaauacucugaaacuugcaacaggcaugcggaacgugccugaaaagcagacccgugggaucuuuggagccauagcugguuucauugagaauggcugggaggggaugguagauggaugguacggcuuucgccaccagaacuccgaagguacggggcaggccgcagaccugaagucuacccaagcugccaucgaucagaucaauggcaaauugaacagacucauugagaagacaaaugaaaaguuccaccagaucgagaaagaguucagcgaaguggagggaaggauucaagaccuggaaaaguaugucgaggauacuaaaauagacuuauggucauacaacgcggaacugcucguggcccuugagaaucagcauaccaucgaucugacagacagugaaaugaacaaguuguuugagaaaacucggaagcagcuacgagagaaugcagaagauaugggcaacgggugcuucaagauuuaccacaaaugugacaacgcuugcaucggauccauccgcaaugguaccuaugaucaugacguuuacagagacgaggcccugaacaauagguuucagauuaagggcguggaacucaaaagcggguauaaggauuggauacuguggaucucuuucgcuauuucaugcuuucuucugugugucguguugcucggauucaucaugugggccugccaaaaaggcaacauucgguguaauaucugcauauga

SEQ ID NO: 130714 - RNA, 1701 nt, Artificial Sequence
  derived and/or modified sequence opt3 from hemagglutinin__InfluenzaA__AFH00758
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggagucuuaugcaugcaagcgaggaagcgugaaguccuuuuucucacgucucaacugguuacacgagagugaauacaaauauccagcccugaaugucaccaugcccaacaauggcaaguuugauaaacuuuacaucuggggcgugcaucacccuagcacggacagagagcaaacuaaguuguacguaagggcuucugggcggguuaccguguccacaaaacgcucacagcagacugucauuccaaacaucggaagcagacccugggugaggggucugaguucucggauuuccaucuauuggaccauagugaagccuggcgauauucuacucaucaauagcacagggaaccugauugccccacgcggauacuucaagauccgaaccggcaaaucgucuaucaugagauccgacgcgccgauugguacguguucaagugaaugcauaacucccaacgggagcaucccuaaugacaagccauuucagaacgucaauaggauuacauauggagcauguccccgguacguuaaacaaaacacccuuaagcuggccacuggcaugcguaaugugccugagaaacagacacgcggcaucuucggggcuauagccggauuuauugagaacgguugggaaggcaugguagaugggugguauggauucagacaccaaaauuccgagggcaccggucaggcagcugacuugaagucuacgcaggccgcgaucgaucagaucaacgggaaacucaauaggcugauugaaaagaccaacgagaaguuucaucagaucgaaaaagaguucagcgagguggaaggccggauucaagacuuagagaaguacgucgaagauacaaaaauagaccuguggucauauaaugccgagcuccuuguggcacuggaaaaccagcacacuaucgauuugaccgacagugagaugaauaagcuauucgagaaaacacgaaagcagcugcgcgaaaacgcugaggauaugggaaauggcugcuuuaagauuuaccauaaaugugacaacgccugcaucggguccaucagaaacggaacuuacgaucacgacguuuauagggacgaagcucucaauaaccgguuccagauuaaggguguggagcugaaaagcggcuacaaggauuggauacuuuggaucucuuuugccauuucaugcuuccuguugugugucgugcuccugggguuuaucaugugggcaugccaaaaaggaaauauucgcuguaacaucugcauauga

SEQ ID NO: 130715 - RNA, 1701 nt, Artificial Sequence
  derived and/or modified sequence opt3 from hemagglutinin__InfluenzaA__AFH00769
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggagucuuauaccugcaagcgaggaagcgugaaguccuuuuucucacgucucaacugguuacacgagagugaauacaaauauccagcacugaaugucacgaugcccaacaaugauaaguuugacaaacuuuacaucuggggcgugcaucacccuagcacugauagagagcaaaccucuuuguacauuagggccuccggccggguaacaguuucaacuaagcgcagccagcagaccgugaucccaaacauugggaguagacccugggucaggggacugucuucccggaucagcauauauuggacaauugugaaaccuggugacauccuacucauuaauucgaccggcaaccugaucgcuccacgcggguacuucaagauccgaacgggaaagucuuccauuaugagaucagacgccccgauaggcacuuguaguagcgaaugcaucacacccaacgguuccauuccuaaugauaaaccauuucagaacgugaauaggaucaccuauggggcguguccccgguacgucaagcaaaacacucuuaaacuggcaacaggaaugcguaauguuccugagaagcagacccgcggcauauucggcgccauugcuggguuuaucgagaacggaugggaagguaugguggacggcugguauggguucagacaccaaaauucugagggaacgggccaggccgcagauuugaaaagcacccaggcugccaucgaccagauuaacgguaagcucaauaggcugaucgagaaaacaaacgaaaaguuucaucagauugaaaaggaguucucagagguagaagggcggauacaagauuuagagaaauacguggaagacacuaagaucgaucuguggaguuauaaugcggagcuccuugucgcccuggaaaaccagcacaccauugacuugacagauuccgagaugaauaaacuauucgagaagacucgaaaacagcugcgcgaaaacgcagaggacaugggcaauggaugcuuuaagaucuaccauaagugugauaacgcuugcaucggcagcauuagaaacgggaccuacgaccacgacguguauagggaugaagcccucaauaaccgguuccagauaaaaggaguugagcugaagucugguuacaaagacuggauccuuuggauuucauuugcuaucaguugcuuccuguugugugugguccuccugggcuuuauuaugugggccugccaaaaggggaauauccgcuguaacauaugcaucuga

SEQ ID NO: 130716 - RNA, 1701 nt, Artificial Sequence
  derived and/or modified sequence opt3 from hemagglutinin__InfluenzaA__AFH00780
augagagccaucauugcucugagcuacauacucugccuuguguucgcacagaagcugcccggcaacgacaauuccaccgccacauuguguuuagggcaccaugcggucccuaacggaacucugguuaaaacgaucaccaaugaucaaauugaggugacaaacgcuacugagcuaguacagucuucaaguaccgguaggaucugcgacagcccacaccggauucucgauggcaagaauuguacacugaucgacgcccuucugggggauccgcauugcgacggauuucagaacaaagaaugggauuuguucguggaacgcuccaaggcauauucugacuguuaccccuaugaugucccugacuacgccucgcuccgaucacugguggcuagcaguggcacccuggaguuuacuaaugaagguuucaacuggacagggguugcacaggauggaaccuccuaugccugcaaacguggcucugucaagagcuuuuucuccagacucaauugguuacacaagcuggaguacaaauauccagcucuuaacgugacgaugcccaauaacgacaaguuugauaaauuguacauauggggcgugcaucacccuucaacugacagugaccaaaccagccuguacguacaggccucugggaggguuacaguguccacuaagcggucacagcagaccgucaucccaaauauuggaagccgccccugggugagaggugugaguucuaggaucuccauuuauuggacaaucgucaaaccuggcgauauacuacucauuaacagcaccgggaaucugaucgcgccacggggauacuucaagauucgcucgggcaagucuuccaucaugcgaucagacgcaccgaucgguaacuguaacagugagugcauuacgcccaaugggagcauaccuaacgauaaaccauuucaaaauguuaacagaaucacuuauggagccugucccagguacgugaagcagaauacacuuaaacuggcuaccggcaugcggaacguaccugaaaagcagacucguggcauuuucggggccaucgcaggauuuauagagaaugguugggaaggcaugguggacgggugguauggauuccgccaccagaacuccgagggcacaggucaagcugccgauuugaaaucuacccaggcggccauuaaucagaucaacgggaagcucaauagacugaucgagaaaacgaacgaaaaguuucaucaaauugagaaggaguucagcgaagucgaaggcaggauccaggacuuagagaaauacguggaggauaccaagauugaccuguggucauauaaugcagaacuccuuguugcucuggagaaccagcacacaauagauuugacugacagugaaaugaauaaacuauucgagcggacccgaaagcagcugcgcgaaaacgccgaggauaugggaaacggcugcuuuaaaaucuaccauaagugugacaaugcuugcauuggguccaucagaaacggaacauacgaccacgauguguauagggacgaggcccucaauaaccgguuccaaaucaagggugucgaacugaaaagcggcuacaaggauuggauucuuuggauaucuuuugcaaucucaugcuuccuguugugugugguacuccugggguuuauuaugugggccugccagaaaggaaauauccgcuguaacauuugcaucuga

SEQ ID NO: 130717 - RNA, 1701 nt, Artificial Sequence
  derived and/or modified sequence opt3 from hemagglutinin__InfluenzaA__AFH00791
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacaggguucuucaacaggcagaaucugcgacaguccacaccagauucucgaugggaaaaauuguacccugaucgacgcucuacugggagauccgcauugcgacggcuuucagaacaaggagugggauuuguucguggaaaggagcacugccuauuccaauuguuaccccuaugacgucccugauuacgcaucucuccggucgcugguggccucaagcgguacacuggaguuuaccaaagaaggguucaacuggacgggaguugcucaagacggcacuagcuauaccugcaagcgcggcuccgugaagucuuucuucagccgacucaauugguuacacaaacuggaguacaaguauccagcacuuaacgucacaaugcccaauaacgauaaauuugacaaguuguacauauggggagugcaucacccuuccacugauucagaccagaccagucuguacguacaggccagcgggcguguuacagugucuaccaaaagaucccagcaaacggucaucccaaauauugguucaaggcccugggugcggggcgugagcagucgcaucucuauuuauuggacuaucgucaagccuggggacauacuacucauuaacuccacaggaaaucugaucgcuccaagaggcuacuucaagauuaggagcgguaaaucgucuaucaugcgguccgaugccccgaucgacaacuguaacucagagugcauuacccccaaugggaguauaccuaacgauaagccauuucagaauguuaaccgcaucacuuauggagcguguccccgauacgugaaacagaauacacuuaagcuggcaaccggcaugagaaacguaccugaaaaacagacgaggggcauuuucggggccaucgcuggauuuauagagaaugguugggaaggcaugguggacgggugguauggauuccggcaccaaaacagcgagggcaccggucaggccgcagauuugaaguccacacaggcugccauuaaucaaaucaacgggaaacucaaucgucugaucgagaagacuaacgaaaaguuucaucagauugagaaagaauuuucugaggucgaaggccgcauccaggacuuagagaaguacguggaggauaccaaaauugaccuguggagcuauaaugcggaacuccuuguugcccuggagaaccagcacacaauagauuugacugacucagaaaugaauaagcuauucgagagaaccaggaaacaacugcgggaaaacgcagaggauaugggaaacggcugcuuuaagaucuaccauaagugugacaaugcuugcauugggaguauccgaaacggaacauacgaccacgauguguaucgcgacgaggcccucaauaacagauuccagaucaaaggugucgaacugaaguccggcuacaaagauuggauucuuuggauaaguuuugcuaucucuugcuuccuguugugugugguacuccugggguuuauuaugugggccugccagaagggaaauaucagguguaacauuugcaucuga

SEQ ID NO: 130718 - RNA, 1701 nt, Artificial Sequence; identical to SEQ ID NO: 123358
  derived and/or modified sequence opt3 from hemagglutinin__InfluenzaA__AFH00802

SEQ ID NO: 130719 - RNA, 1701 nt, Artificial Sequence
  derived and/or modified sequence opt3 from hemagglutinin__InfluenzaA__AFH00813
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcgacauuccuagcagagugaguaucuauuggacaauugucaaaccaggagauauccugcuaaucaacucuaccgguaaucucauugcgccgaggggcuacuucaagauacgguccgggaaaagcucgaucaugcgcucugacgcacccauuggaaaguguaacuccgccugcaucacgccuaauggcucaauaccaaacgacaagcccuuucagaaugugaaccgaauuacuuacggugcuuguccuagauaugugaaacaaaauacacugaaacuugccaccgggaugaggaacgucccagaaaaacagacucggggaaucuucggcgcaaucgcuggcuuuauugagaaugggugggaaggaaugguugaugguugguacggcuuccgucaccagaacagugaggggcgcggacaagccgcggaccuuaagagcacacaggccgcaaucgaucagauuaauggcaaauugaacagacucauagguaagaccaacgagaaauuccaucagaucgaaaaggaguuuuccgaaguggaggggaggauucaagaccuggaaaaguauguagaggauacgaaaaucgacuuauggucuuacaaugcugagcugcucguggcccuugaaaaccagcacaccaucgaucugacagacagcgagaugaauaaguuguucgaaaagacuaagaaacagcuacgggagaacgcugaagauaugggcaauggaugcuuuaagauuuaucauaagugugacaacgccugcauaggcucaauccgaaaugggaccuacgaucacgacgucuaucgcgacgaggcacugaacaauagauuccagauuaaaggaguggagcucaagagugguuacaaagauuggauccuguggauuuccuuugccaucagcugcuuccuucuguguguugcuuugcucggcuuuauaaugugggcgugccaaaaggggaacaucagguguaauauuugcaucuga

SEQ ID NO: 130720 - RNA, 1701 nt, Artificial Sequence
  derived and/or modified sequence opt3 from hemagglutinin__InfluenzaA__AFH00824
augaagaccaucauugcccugagcuacauacucagacuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacaaaauucuucaauuggugagaucuguaacaguccacaccagauacuagacggcgaaaauugcacacucaucgaugcucugcuuggggacccgcagugugauggauuucagaacaaaaagugggaccuguucguggagaggagcaaagccuauuccaauugcuaccccuaugaugucccugacuacgcaucuuugcggucgcucguggccucaagcggcacccuggaauuuaacaaugagaguuucaacuggacugguguuacacagaaugggaccuccucugcuuguauucgccgaagcaacaauuccuuuuucucacgucugaacuggcucacgcauuuaaacuuuaaguauccagcacugaaugugacuaugcccaacaaugagcaguucgauaaguuguacaucuggggaguccaccauccuggcaccgacaaagaucagauuuuucuuuaugcccaaaguagcggcagaaucacagugucuacuaagaggucccagcaggcuguaauaccaaacauugggucacggccccgcaucagagacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaagugcaauuccgaauguaucaccccuaacggcucaaucccaaaugacaagcccuuucagaacgugaauagaauuacguauggugcaugcccuagguacgucaaacaaaguacucugaaacuugccacagggaugcggaacgugccagagaagcagacccguggaaucuucggcgcuauugccggcuuuauagaaaaugggugggagggaaugguggaugguugguauggcuuccgccaccagaacagcgaggggagaggacaagcagcugaccugaaguccacucaggccgcgaucgaucagauuaauggcaaauugaacaggcucaucgguaagacaaacgaaaaauuccaccagaucgagaaggaauuuucugaggucgaagggcggauucaagaccuggagaaguacguugaggauaccaaaauagacuuauggagcuauaaugccgaacugcucguggcacuugagaaccagcauacgaucgaucugaccgacucagaaaugaauaaguuguucgagaaaacaaagaaacagcuacgagaaaacgcugaggauaugggcaauggauguuuuaagauuuaccacaagugcgacaacgccuguaucggcaguauucgcaaugggacuuaugaucaugacguauacagagacgaggcucugaacaauagguuccagaucaaaggaguggaacucaaguccgguuacaaagauuggauacuguggaucagcuuugccauuucuugcuuccuucugugcgucgcauugcucggcuuuaucaugugggccugucaaaaggggaacauucggugcaauaucuguauauga

SEQ ID NO: 130721 - RNA, 1701 nt, Artificial Sequence
  derived and/or modified sequence opt3 from hemagglutinin__InfluenzaA__AFH01407
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaagucauuuuucagucgacugaacuggcucacucauuuaaaauauaaguacccagcacugaaugugaccaugcccaacaacgagaaauuugauaaacuuuauaucuggggcguccaccauccuggcacagacagcgaucagauuucuuuguacgcccaggcuuccgggcguaucacugugucaaccaagagaagccaacagacaguaauuccaaauaucggaaguaggccccggguucgcgacauaucuuccagaauuagcaucuacuggaccauugugaagccuggugauauccugcuaaucaacucgacgggcaaucucauugccccaaggggguauuucaagauacggucuggaaaauccucaaucaugcgcagugacgcgccgauuggcaaguguaacagcgagugcaucacucccaaugguuccauaccuaacgacaaaccauuucagaaugucaaccgaauuacauacggggcaugucccagauaugugaagcagaauacccugaaacuugccacuggaaugaggaacgugccugaaaagcaaacacggggcaucuucggcgcuaucgccggguuuauugagaauggaugggaagguauggucgauggcugguacggguuccgucaccagaacucugagggaaccggccaggcagcugaccugaaaagcacgcaagccgcgaucaaucagauuaacgguaaguugaaucgccucauagggaagaccaacgagaaauuucaccagaucgaaaaggaguucucagaaguugagggcaggauucaggaucuggaaaaauauguggaggacacaaagaucgauuuauggaguuacaacgccgagcugcucguagcacuugaaaaucaacauacuaucgaccugaccgauuccgagaugaacaaauuguucgaaagaacaaagaagcagcuacgggagaaugcugaagacaugggaaacggcugcuuuaaaauuuaucacaagugugauaaugccugcauagagagcauccgaaacgggacuuacgaccaugauguguaccgcgacgaggcucugaauaacagauuccagauuaaaggagucgaacucaagucugguuauaaagacuggauccuguggauuucauuugccaucaguugcuuccuucuguguguggcauugcucggcuuuauaaugugggccugccagaaggggaauaucagguguaacauuugcaucuga

SEQ ID NO: 130722 - RNA, 1701 nt, Artificial Sequence
  derived and/or modified sequence opt3 from hemagglutinin__InfluenzaA__AFH34940
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucugacaggcuccgaaaugaauaaguuguucgagaaaacuaagaaacagcuacgggaaaacgcugaggacaugggaaauggcugcuuuaagaucuaccacaagugugauaacgccugcauugggagcauccgaaauggaaccuauaaccaugacguauaccgcgaugaggcucugaauaacagauuccagauuaaagguguggaacucaagucuggcuacaaagacuggauccuguggauaucauuugccaucaguugcuuccuucugugugucgcauugcucggguuuauuaugugggccugccaaaagggaaauaucagguguaacauuugcaucuga

SEQ ID NO: 130723 - RNA, 1701 nt, Artificial Sequence
  derived and/or modified sequence opt3 from hemagglutinin__InfluenzaA__AFH34961
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccgcuagcggcacucuggaauuuaacaaugagaguuucaacuggacagguguuacccagaaugggacguccucugcaugcauccggcgcagcaacuccucauuuuucagucgacugaauuggcucacucauuuaaacuuuaaguauccagcccugaaugugaccaugcccaacaacgagcaguucgacaaacuuuacauuuggggaguccaccauccuggcacagauaaggaccagaucuuuuuguaugcucaaagcucuggccguauuacuguguccaccaagagaucacagcaggccguaaucccaaauauagggagcaggccccggauucgcaacaucccuaguagaauuucuaucuacuggacaaucguuaaaccaggagauauucugcuaauaaauuccaccgguaaccucaucgcgccgaggggcuacuucaagauucggagcgggaaaucgucuaucaugcgcuccgacgcacccauaggaaaguguaauucagaaugcauuacgccuaacggcaguaucccaaaugacaagcccuuucagaacgugaaucgaaucacuuauggugccuguccuagauacgucaaacaaagcacacugaaacuugcuaccgggaugaggaacgugccagagaagcagacucggggaauuuucggcgccaucgcaggcuuuauugaaaaugggugggagggaaugguggaugguugguauggcuuccgucaccagaacuccgaggggcgcggacaagcugccgaccugaagucuacacaggcggccauagaucagaucaauggcaaauugaacagacucauugguaagaccaaugaaaaauuccaccagaucgagaaggaauuuagcgaggucgaagggaggauccaagaccuggagaaguacguugaggauacgaaaauugacuuauggucauauaacgcagaacugcucguggcucuugagaaccagcauaccauagaucugacagacagugaaaugaauaaguuguucgagaaaacuaagaaacagcuacgggaaaacgccgaggauaugggcaauggaugcuuuaagaucuaccacaagugugacaacgcuugcauuggcuccauccgaaaugggaccuauaaccaugauguauaccgcgacgaggcccugaauaacagauuccagauuaaaggaguggaacucaagagcgguuacaaagacuggauccuguggauaucuuuugcaaucucaugcuuccuucugugugucgccuugcucggcuuuauuaugugggcuugccaaaaggggaauaucagguguaacauuugcaucuga

SEQ ID NO: 130724 - RNA, 1701 nt, Artificial Sequence
  derived and/or modified sequence opt3 from hemagglutinin__InfluenzaA__AFH34968
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccgcuagcggcacucuggaauuuaacaaugagaguuucaacuggacagguguuacccagaaugggacguccucugcaugcauccggcgcagcaacuccucauuuuucagucgacugaauuggcucacucauuuaaacuuuaaguauccagcccugaaugugaccaugcccaacaacgagcaguucgacaaacuuuacauuuggggaguccaccauccuggcacagauaaagaccagaucuuuuuguaugcucaaagcucuggccguauuacuguguccaccaagagaucacagcaggccguaaucccaaauauagggagcaggccccggauucgcgauaucccuaguagaauuucuaucuacuggacaaucguuaaaccaggagacauucugcuaauaaacuccaccgguaaucucaucgcgccgaggggcuacuucaagauucggagcgggaaaucgucuaucaugcgcuccgacgcacccauaggaaaguguaacucagccugcauuacgccuaauggcaguaucccaaacgauaagcccuuucagaaugugaaccgaaucacuuauggugcuuguccuagauacgucaaacaaagcacacugaaacuugccaccgggaugaggaaugugccagaaaagcagacucggggaauuuucggcgcaaucgcuggcuuuauugagaacgggugggaaggaaugguggacgguugguauggcuuccgucaccaaaauuccgaggggcgcggacaggccgcggaucugaagucuacacaggccgcaauagaccagaucaacggcaaauugaauagacucauugguaagaccaacgagaaauuccaccagaucgaaaaggaguuuagcgaagucgaggggaggauccaagaucuggaaaaguacguugaggacacgaaaauugauuuauggucauauaaugcugagcugcucguggcccuugaaaaccagcauaccauagaccugacagauagugagaugaacaaguuguucgaaaagacuaagaaacagcuacgggagaaugcugaagacaugggcaacggaugcuuuaagaucuaccacaagugugauaaugccugcauuggcuccauccgaaacgggaccuauaaucaugacguauaccgcgacgaggcacugaacaauagauuccagauuaaaggaguggagcucaagagcgguuacaaagauuggauccuguggauaucuuuugccaucucaugcuuccuucugugugucgcuuugcucggcuuuauuaugugggcgugccaaaaggggaacaucagguguaauauuugcaucuga

SEQ ID NO: 130725 - RNA, 1701 nt, Artificial Sequence
  derived and/or modified sequence opt3 from hemagglutinin__InfluenzaA__AFH34975
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggaacgguguuacucaaaaugggacauccucugcuugcauucgccgaagcaacaauuccuuuuucucacgucugaacuggcucacccauuuaaacuuuaaguauccagcacugaaugugacgaugcccaacaaugagcaguucgacaaguuguacaucuggggaguccaccauccuggcacugauaaagaccagauuuuucuuuaugcccagccaaguggcagaaucaccgugagcacaaagaggucucaacaggcuguaauacccaacauugggucccggccucgcaucagaaauauuccaucaaggaucagcaucuacuggacuauuguuaaaccgggagauauacugcuaaucaacaguaccgguaaucucauugcgccccggggcuacuucaagauccgcucugggaaauccagcauaaugcgaucggacgccccuauuggaaaguguaagucugaaugcaucacaccaaacggcuccauccccaaugacaaaccuuuucagaacgugaauagaauuaccuauggugcauguccaagguacgucaagcagucaacgcugaaacuugccacugggaugcggaacgugcccgagaagcaaacacguggaaucuucggcgcuauugccggcuuuauagaaaaugggugggagggaaugguggaugguugguauggcuuccgccaccagaacagugaggggagaggacaggcagcugaccugaaaagcacccaagccgcgaucgaucagauuaauggcaaguugaacaggcucaucgguaaaacuaacgaaaaguuccaccagaucgagaaggaauuuuccgaggucgaagggcggauucaggaccuggagaaauacguugaggauacaaagauagacuuauggucuuauaaugccgaacugcucguggcacuugagaaccaacauaccaucgaucugacggacagcgaaaugaauaaauuguucgagaagaccaaaaagcagcuacgagaaaacgcugaggauaugggcaauggaugcuuuaagauuuaccacaaaugugacaacgccugcaucggcucaauucgcaaugggacauaugaucaugacguauacagagacgaggcucugaacaauagguuccagaucaagggaguggaacucaaaagugguuacaaggauuggauacuguggaucuccuuugccauuagcugcuuccuucugugugucgcauugcucggcuuuaucaugugggccugccagaaagggaacauucgguguaauaucugcauauga

SEQ ID NO: 130726 - RNA, 1701 nt, Artificial Sequence; identical to SEQ ID NO: 125427
  derived and/or modified sequence opt3 from hemagglutinin__InfluenzaA__AFH74464

SEQ ID NO: 130727 - RNA, 1701 nt, Artificial Sequence; identical to SEQ ID NO: 124685
  derived and/or modified sequence opt3 from hemagglutinin__InfluenzaA__AFH74465

SEQ ID NO: 130728 - RNA, 1701 nt, Artificial Sequence; identical to SEQ ID NO: 125446
  derived and/or modified sequence opt3 from hemagglutinin__InfluenzaA__AFH74477

SEQ ID NO: 130729 - RNA, 1701 nt, Artificial Sequence
  derived and/or modified sequence opt3 from hemagglutinin__InfluenzaA__AFH74488
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacaauccacaccagauccuagauggcaaaaacuguacccucauagacgcucugcuuggggauccgcagugcgacggauuucaaaauaagaaaugggaucuguucguggaaagaagcaaggccuauuccaacuguuaccccuaugacgucccugauuacgcaucuuugaggucgcucguggccucaagcggcacucuggaguuuaauaacgaaaguuucaauuggacagguguuacccagaacgggacguccucugcuugcauccggcgcagcaaaaauuccuuuuucucacgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuaguggccguauuacugugagcaccaagagaucucagcagacaguaaucccaaacauaggguccaggccccggguucgcaauauuccuucaagaaucagcauuuacuggaccaucgugaaaccaggagauauccugcuaauuaacaguacggguaaucucauagccccgaggggcuacuucaagauccggucugggaaguccagcauuaugcgcucggacgcgcccaucggaaaauguaacucugagugcauaacuccuaauggcuccauuccaaacgacaagcccuuucagaaugucaaccgaaucacauauggugcauguccuagauacgugaaacaaaauacccugaaacuugccacugggaugaggaacgugccagaaaagcagacacggggaaucuucggcgcuauugccggcuuuaucgagaaugggugggaaggaauggucgaugguugguauggcuuccgucaccagaacucagaggggcgcggacaagcagcugaccugaagaguacccaggccgcgauugaucagauaaauggcaaauugaacagacucaucgguaagacgaacgagaaguuccaccagauugaaaaagaguuuagcgaaguugaggggaggauccaagaccuggaaaaguacguggaggauaccaaaaucgacuuaugguccuauaaugccgagcugcucguagcacuugaaaaccagcauacaauugaucugacugacucugagaugaauaaguuguucgaacggaccaaaaagcagcuacgagagaacgcugaagauaugggcaauggaugcuuuaagauauaccacaaaugugacaacgccugcaucggcagcauucgcaaugggacauaugaucaugacguguacagagacgaggcucugaacaauagguuccagaucaagggagucgagcucaaaucagguuacaaggauuggauucuguggaucaguuuugccauauccugcuuccuucuguguguggcauugcucggcuuuaucaugugggccugccaaaaagggaacauucgguguaauaucugcauuuga

SEQ ID NO: 130730 - RNA, 1701 nt, Artificial Sequence; identical to SEQ ID NO: 125427
  derived and/or modified sequence opt3 from hemagglutinin__InfluenzaA__AFH74499

SEQ ID NO: 130731 - RNA, 1701 nt, Artificial Sequence; identical to SEQ ID NO: 125629
  derived and/or modified sequence opt3 from hemagglutinin__InfluenzaA__AFH74510

SEQ ID NO: 130732 - RNA, 1701 nt, Artificial Sequence
  derived and/or modified sequence opt3 from hemagglutinin__InfluenzaA__AFH74521
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcaauagcccacaccagauacuggacggcgaaaacuguacccuaaucgaugcucuccugggggacccgcagugcgauggauuucaaaauaaaaagugggaccuuuucguggagagauccaaagccuauucuaacuguuaccccuaugaugucccugacuacgcaucgcugaggucauugguggccagcaguggcacucucgaauuuaauaacgaguccuucaauuggacagguguuacccagaacgggacgucuagcgcuugcauucggcgcuccaauaacucauuuuucagucgacugaauuggcugacucauagcaagucuaaguauccagcacucaacgugaccaugcccaacaaugagcaguuugauaaauuauacaucuggggaguccaccauccuggcacagacaacgaucagauuuuccuguaugcccaggcuuccggccguaucacugugucaaccaagagaagccaacagacaguaauaccaaauauugggaguaggccccggauccgcgacauuccuucuagaaucuccaucuacuggaccauuguuaaaccaggagauauacuuuugaucaacagcacggguaaucugauugccccgaggggcuacuuuaagauccggucggggaaaucuuccauaaugaagucagacgcgcccauuggaaaguguaacagugaaugcaucacuccuaauggcagcaucccaaacgacaaacccuuccagaaugugaaccgcauuacauauggugcauguccucgauacgucaagcaaaauacccuaaaacucgccacugggaugagaaacgugccagagaagcagacaaggggaaucuuuggcgcuauugccggcuucauagaaaaugggugggagggaaugguggaugguugguauggcuuucggcaccagaacuccgaggggcguggacaagcagcugaccugaaaucuacccaggccgcgaucgaucagauuaauggcaaacuuaaccgccugaucgguaagacgaacgaaaaguuccaccagaucgagaaggaguucagcgaagucgaagggaggauucaagacuuggagaaauacguugaggauaccaagguggaccucuggucauauaaugccgaacuguuaguagcacuggagaaccagcauacaauagaucucacugacagugaaaugaauaaacuuuuugagaagaccaaaaagcagcugagagaaaacgcugaggauaugggcaauggaugcuucaagaucuaccacaaaugugacaacgccugcauuggcuccauccggaaugggacauaugaucaugacguguaccgagacgaggcuuugaacaaucgcuuucagauuaagggagucgaacuaaaaagcgguuacaaggauuggauccuguggauaucuuucgccaucucaugcuuucuccuguguguggcacuucugggcuucauuaugugggccugccaaaaagggaacaucagauguaauauuugcaucuga

SEQ ID NO: 130733 - RNA, 1701 nt, Artificial Sequence; identical to SEQ ID NO: 129004
  derived and/or modified sequence opt3 from hemagglutinin__InfluenzaA__AFH74532

SEQ ID NO: 130734 - RNA, 1701 nt, Artificial Sequence; identical to SEQ ID NO: 125629
  derived and/or modified sequence opt3 from hemagglutinin__InfluenzaA__AFH74543

SEQ ID NO: 130735 - RNA, 1701 nt, Artificial Sequence; identical to SEQ ID NO: 125629
  derived and/or modified sequence opt3 from hemagglutinin__InfluenzaA__AFH74554

SEQ ID NO: 130736 - RNA, 1701 nt, Artificial Sequence; identical to SEQ ID NO: 125629
  derived and/or modified sequence opt3 from hemagglutinin__InfluenzaA__AFH74565

SEQ ID NO: 130737 - RNA, 1701 nt, Artificial Sequence; identical to SEQ ID NO: 125629
  derived and/or modified sequence opt3 from hemagglutinin__InfluenzaA__AFH74576

SEQ ID NO: 130738 - RNA, 1701 nt, Artificial Sequence; identical to SEQ ID NO: 125629
  derived and/or modified sequence opt3 from hemagglutinin__InfluenzaA__AFH74587

SEQ ID NO: 130739 - RNA, 1701 nt, Artificial Sequence
  derived and/or modified sequence opt3 from hemagglutinin__InfluenzaA__AFH74598
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagaugguaaaaauuguacccucauagacgcucugcuuggcgauccgcagugcgacggguuucaaaacaagaaaugggaucuguucguggagagauccaaggccuauucuaauuguuaccccuaugacgucccugauuacgcaucguugaggucacucguggccagcaguggaacucuggaauuuaacaaugaguccuucaacuggacaggcguuacccagaaugguacgucuagcgcuugcauccggcgcuccaagaacucauuuuucagucgacugaauuggcucacucauuuaaacuuuaaauauccagcacugaaugugaccaugcccaacaacgagcaguucgacaagcuguacauuuggggaguccaccauccugggacagauaaagaccagaucuuuuuguaugcccaagcuagcggccguauuacugugucuaccaagagaucccagcagacagccaucccaaauauaggcucaaggccccggguacgcaacauuccuagcagaaucaguauuuacuggaccaucguuaaaccaggggauauccugcuaauuaauucuacgggaaaccucauagcgccgagggguuacuucaagauccgguccggcaagagcucgauuaugcgcucugacgcacccaucgggaaauguaauuccgaaugcauaacuccuaacggaucaauuccaaaugacaagcccuuucagaacgugaaucgaaucacauauggcgccuguccuagauacgucaaacaaaacacccugaaacuugcuacugguaugaggaaugugccagagaagcagacacgggggaucuucggagccauugcaggcuuuaucgaaaacggcugggaggggaugguggauggaugguaugguuuccgucaccagaauagugagggccgcgggcaagcugccgaccuuaagagcacccaggcggccauugaucagauaaacggaaaauugaauagacucaucggcaagacgaacgaaaaguuccaccagauugagaaagaauuuuccgaggucgaagguaggauccaagaccuggagaaguacguugaggauaccaaaaucgacuuauggucuuauaacgcagaacugcucguggcucuugagaaucagcauacaauugaucugacugacagcgaaaugaacaaguuguucgagaaaaccaagaagcagcuacgggaaaaugccgaggauauggggaacggcugcuuuaaaauauaccacaagugugacaaugcuugcaucggaucaauucgaaacggcacauaugaucaugacguauaccgcgacgaggcccugaauaacagauuccagaucaaagggguggaacucaagaguggauacaaagauuggauucuguggaucuccuuugcaauaagcugcuuccuucugugugucgccuugcucgguuuuaucaugugggcuugccaaaagggcaauauuagguguaacaucugcauuuga

SEQ ID NO: 130740 - RNA, 1701 nt, Artificial Sequence; identical to SEQ ID NO: 125427
  derived and/or modified sequence opt3 from hemagglutinin__InfluenzaA__AFH74609

SEQ ID NO: 130741 - RNA, 1701 nt, Artificial Sequence; identical to SEQ ID NO: 125629
  derived and/or modified sequence opt3 from hemagglutinin__InfluenzaA__AFH74620

SEQ ID NO: 130742 - RNA, 1701 nt, Artificial Sequence
  derived and/or modified sequence opt3 from hemagglutinin__InfluenzaA__AFH74631
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaccaauuguacucucauagacgcucugcuuggggauccgcagugcgacggauuucaaaacaaaaagugggaucuguucguggaaagauccaaagccuauucuaauuguuaccccuaugacgucccugauuacgcaucguugaggucacucguggccagcaguggcacacuggaguuuaacaaugaauccuucaacuggaccgguguuacgcagaaugggacuucuagcgcuugcauccggcgcuccaagaacucauuuuucagucgacugaauuggcucacccauuuaaacuuuaaguauccagcacugaaugugacaaugcccaacaacgagcaguucgacaaacuuuacauuuggggaguccaccauccuggcacugauaaggaccagaucuuuuuguaugcccaagcuagcggccguauuaccgugucuacaaaaagaucccagcagaccgccaucccaaauauagggucaaggccccggguacgcaacauuccuagcagaaucaguauuuacuggacgaucguuaagccaggagauauccugcuaauuaauucuacugguaaccucauagcgccgaggggcuacuucaaaauccgguccgggaaaagcucgauuaugcgcucugacgcacccaucggaaaguguaauuccgagugcauaacaccuaacggcucaauuccaaaugacaaacccuuucagaacgugaaucgaaucaccuauggugccuguccuagauacgucaagcaaaacacucugaaacuugcuacagggaugaggaaugugccagaaaagcagacccggggaaucuucggcgccauugcaggcuuuaucgagaacgggugggaaggaaugguggaugguugguauggcuuccgucaccagaauagugaggggcgcggacaagcugccgaccugaaaagcacgcaggcggccauugaucagauaaacggcaaguugaauagacucaucgguaaaaccaacgagaaguuccaccagauugaaaaggaguuuuccgaagucgaggggaggauccaagaccuggaaaaauacguugaggauacaaagaucgacuuauggucuuauaacgcagagcugcucguggcucuugaaaaucagcauacuauugaucugaccgacagcgagaugaacaaauuguucgaaaagacaaagaagcagcuacgggagaaugccgaagauaugggcaacggaugcuuuaagauauaccacaaaugugacaaugcuugcaucggcucaauucgaaacgggacuuaugaucaugacguauaccgcgacgaggcccugaauaacagauuccagaucaagggaguggagcucaaaagugguuacaaggauuggauucuguggaucuccuuugcaauaagcugcuuccuucugugugucgccuugcucggcuuuaucaugugggcuugccaaaaagggaauauuagguguaacaucugcauuuga

SEQ ID NO: 130743 - RNA, 1701 nt, Artificial Sequence; identical to SEQ ID NO: 125427
  derived and/or modified sequence opt3 from hemagglutinin__InfluenzaA__AFH74642

SEQ ID NO: 130744 - RNA, 1701 nt, Artificial Sequence; identical to SEQ ID NO: 125427
  derived and/or modified sequence opt3 from hemagglutinin__InfluenzaA__AFH74653

SEQ ID NO: 130745 - RNA, 1701 nt, Artificial Sequence; identical to SEQ ID NO: 125427
  derived and/or modified sequence opt3 from hemagglutinin__InfluenzaA__AFH74664

SEQ ID NO: 130746 - RNA, 1701 nt, Artificial Sequence; identical to SEQ ID NO: 125427
  derived and/or modified sequence opt3 from hemagglutinin__InfluenzaA__AFH74675

SEQ ID NO: 130747 - RNA, 1701 nt, Artificial Sequence; identical to SEQ ID NO: 130175
  derived and/or modified sequence opt3 from hemagglutinin__InfluenzaA__AFH74686

SEQ ID NO: 130748 - RNA, 1701 nt, Artificial Sequence; identical to SEQ ID NO: 130175
  derived and/or modified sequence opt3 from hemagglutinin__InfluenzaA__AFH74697

SEQ ID NO: 130749 - RNA, 1701 nt, Artificial Sequence; identical to SEQ ID NO: 125629
  derived and/or modified sequence opt3 from hemagglutinin__InfluenzaA__AFH74708

SEQ ID NO: 130750 - RNA, 1701 nt, Artificial Sequence; identical to SEQ ID NO: 125629
  derived and/or modified sequence opt3 from hemagglutinin__InfluenzaA__AFH74719

SEQ ID NO: 130751 - RNA, 1701 nt, Artificial Sequence; identical to SEQ ID NO: 125629
  derived and/or modified sequence opt3 from hemagglutinin__InfluenzaA__AFH74730

SEQ ID NO: 130752 - RNA, 1701 nt, Artificial Sequence
  derived and/or modified sequence opt3 from hemagglutinin__InfluenzaA__AFH74741
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcaaaaacuguacccucauagacgcucugcuuggggauccgcagugcgacggauuucagaauaagaaaugggaucuguucguggaaagaagcaaggccuauuccaacuguuaccccuaugacgucccugauuacgcaucuuugaggucgcucguggccucaagcggcacucuggaguuuaauaacgaaaguuucaauuggacagguguuacccagaacgggacguccucugcuugcauccggcgcagcaaaaauuccuuuuucucacgacugaacuggcucacucauuuaaauuuuaaauauccagcacugaacgugaccaugcccaacaaugagcaguucgacaaacuuuacauuuggggaguccaccauccuggcacagauaaggaccagaucuuuuuguaugcccaagcuaguggccguauuacugugagcaccaagagaucucagcagacagccaucccaaacauaggguccaggccccggguacgcaauauuccuucaagaaucagcauuuacuggaccaucguuaaaccaggagauauccugcuaauuaacaguacggguaaucucauagcgccgaggggcuacuucaagauccggucugggaaguccagcauuaugcgcucggacgcacccaucggaaaauguaacucugagugcauaacuccuaauggcuccauuccaaacgacaagcccuuucagaaugugaaccgaaucacauauggugccuguccuagauacgucaaacaaaauacccugaaacuugcuacugggaugaggaacgugccagaaaagcagacacggggaaucuucggcgccauugcaggcuuuaucgagaaugggugggaaggaaugguggaugguugguauggcuuccgucaccagaacucagaggggcgcggacaagcugccgaccugaagaguacccaggcggccauugaucagauaaauggcaaauugaacagacucaucgguaagacgaacgagaaguuccaccagauugaaaaagaguuuagcgaagucgaggggaggauccaagaccuggaaaaguacguugaggauaccaaaaucgacuuaugguccuauaaugcagagcugcucguggcucuugaaaaccagcauacaauugaucugacugacucugagaugaauaaguuguucgaaaagaccaagaagcagcuacgggagaacgccgaagauaugggcaauggaugcuuuaaaauauaccacaagugugacaacgcuugcaucggcagcauucgaaaugggacauaugaucaugacguauaccgcgacgaggcccugaacaauagauuccagaucaaaggaguggagcucaagucagguuacaaagauuggauucuguggaucaguuuugcaauauccugcuuccuucugugugucgccuugcucggcuuuaucaugugggcuugccaaaaggggaacauuagguguaauaucugcauuuga

SEQ ID NO: 130753 - RNA, 1701 nt, Artificial Sequence; identical to SEQ ID NO: 125629
  derived and/or modified sequence opt3 from hemagglutinin__InfluenzaA__AFH74752

SEQ ID NO: 130754 - RNA, 1701 nt, Artificial Sequence; identical to SEQ ID NO: 125629
  derived and/or modified sequence opt3 from hemagglutinin__InfluenzaA__AFH74763

SEQ ID NO: 130755 - RNA, 1701 nt, Artificial Sequence; identical to SEQ ID NO: 125629
  derived and/or modified sequence opt3 from hemagglutinin__InfluenzaA__AFH74774

SEQ ID NO: 130756 - RNA, 1701 nt, Artificial Sequence; identical to SEQ ID NO: 129004
  derived and/or modified sequence opt3 from hemagglutinin__InfluenzaA__AFH74785

SEQ ID NO: 130757 - RNA, 1701 nt, Artificial Sequence; identical to SEQ ID NO: 125629
  derived and/or modified sequence opt3 from hemagglutinin__InfluenzaA__AFH74796

SEQ ID NO: 130758 - RNA, 1701 nt, Artificial Sequence; identical to SEQ ID NO: 130185
  derived and/or modified sequence opt3 from hemagglutinin__InfluenzaA__AFH74807

SEQ ID NO: 130759 - RNA, 1701 nt, Artificial Sequence; identical to SEQ ID NO: 130185
  derived and/or modified sequence opt3 from hemagglutinin__InfluenzaA__AFH74818

SEQ ID NO: 130760 - RNA, 1701 nt, Artificial Sequence; identical to SEQ ID NO: 130185
  derived and/or modified sequence opt3 from hemagglutinin__InfluenzaA__AFH74829

SEQ ID NO: 130761 - RNA, 1701 nt, Artificial Sequence; identical to SEQ ID NO: 130185
  derived and/or modified sequence opt3 from hemagglutinin__InfluenzaA__AFH74840

SEQ ID NO: 130762 - RNA, 1701 nt, Artificial Sequence
  derived and/or modified sequence opt3 from hemagglutinin__InfluenzaA__AFH74851
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauggcaauuguuaccccuaugacgucccugauuacgcaucuuugaggucgcucguggccucaagcgguacucuggaguuuaacaaugaaaguuucaacuggacagggguuacccagaauggaacguccucugcuugcauccggcgcagcaagaacuccuuuuucucacgacugaauuggcucacucauuuaaacuuuaaauauccagcacugaaugugaccaugcccaacaacgagcaguucgacaaacuuuacauuuggggcguccaccauccuggcacagauaaggaccagaucuuuuuguaugcccaagcuagugggcguauuacugugagcaccaagagaucucagcagacagccaucccaaauauaggauccaggccccggguacgcaacauuccuucaagaaucagcauuuacuggaccaucguuaaaccaggugauauccugcuaauuaauaguacgggcaaccucauagcgccgaggggguacuucaagauccggucuggaaaguccagcauuaugcgcucggacgcacccaucggcaaauguaauucugagugcauaacuccuaacgguuccauuccaaaugacaagcccuuucagaacgugaaucgaaucacauauggggccuguccuagauacgucaaacaaaacacccugaggcuugcuacuggaaugcggaaugugccagaaaagcagacacguggcaucuucggcgccauugcaggguuuaucgagaacggaugggaagguaugguggauggcugguauggguuccgccaccaaaauucagagggaagaggccaggcugccgaccugaaaaguacccaggcggccauugaucagauaaacgguaaguugaauaggcucaucgggaaaacgaacgagaaguuccaccagauugaaaaggaguuuagcgaagucgagggccggauccaagaccuggaaaaauacguugaggauaccaagaucgacuuaugguccuauaacgcagagcugcucguggcucuugaaaaucagcauacaauugaucugacugacucugagaugaacaaauuguucgaaaagaccaaaaagcagcuacgagagaaugccgaagauaugggaaacggcugcuuuaagauauaccacaaaugugacaaugcuugcaucgggagcauucgcaacggaacauaugaucaugacguauacagagacgaggcccugaauaacagguuccagaucaaggguguggagcucaaaucaggcuacaaggauuggauucuguggaucaguuuugcaauauccugcuuccuucugugugucgccuugcucggguuuaucaugugggcuugccaaaaaggaaauauucgguguaacaucugcauuuga

SEQ ID NO: 130763 - RNA, 1701 nt, Artificial Sequence; identical to SEQ ID NO: 130188
  derived and/or modified sequence opt3 from hemagglutinin__InfluenzaA__AFH74862

SEQ ID NO: 130764 - RNA, 1701 nt, Artificial Sequence; identical to SEQ ID NO: 130188
  derived and/or modified sequence opt3 from hemagglutinin__InfluenzaA__AFH74873

SEQ ID NO: 130765 - RNA, 1701 nt, Artificial Sequence; identical to SEQ ID NO: 125629
  derived and/or modified sequence opt3 from hemagglutinin__InfluenzaA__AFH74884

SEQ ID NO: 130766 - RNA, 1701 nt, Artificial Sequence; identical to SEQ ID NO: 125629
  derived and/or modified sequence opt3 from hemagglutinin__InfluenzaA__AFH74895

SEQ ID NO: 130767 - RNA, 1701 nt, Artificial Sequence; identical to SEQ ID NO: 125629
  derived and/or modified sequence opt3 from hemagglutinin__InfluenzaA__AFH74906

SEQ ID NO: 130768 - RNA, 1701 nt, Artificial Sequence; identical to SEQ ID NO: 125427
  derived and/or modified sequence opt3 from hemagglutinin__InfluenzaA__AFH74917

SEQ ID NO: 130769 - RNA, 1701 nt, Artificial Sequence; identical to SEQ ID NO: 125629
  derived and/or modified sequence opt3 from hemagglutinin__InfluenzaA__AFH74928

SEQ ID NO: 130770 - RNA, 1701 nt, Artificial Sequence; identical to SEQ ID NO: 125629
  derived and/or modified sequence opt3 from hemagglutinin__InfluenzaA__AFH74939

SEQ ID NO: 130771 - RNA, 1701 nt, Artificial Sequence
  derived and/or modified sequence opt3 from hemagglutinin__InfluenzaA__AFH74950
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauggcaauuguuaccccuaugacgucccugauuacgcaucuuugaggucgcucguggccucaagcgguacucuggaguuuaacaaugaaaguuucaacuggacagggguuacccagaauggaacguccucugcuugcauccggcgcagcaagaacuccuuuuucucacgacugaauuggcucacucauuuaaacuuuaaauauccagcacugaaugugaccaugcccaacaacgagcaguucgacaaacuuuacauuuggggcguccaccauccuggcacagauaaagaccagaucuuuuuguaugcccaagcuagugggcguauuacugugagcaccaagagaucucagcagacagccaucccaaauauaggauccaggccccggguacgcaacauuccuucaagaaucagcauuuacuggaccaucguuaaaccaggugauauccugcuaauuaauaguacgggcaaccucauagcgccgaggggguacuucaagauccggucuggaaaguccagcauuaugcgcucggacgcacccaucggcaaauguaauucugagugcauaacuccuaacgguuccauuccaaaugacaagcccuuucagaacgugaaucgaaucacauauggggccuguccuagauacgucaaacaaaacacccugaaacuugcuacuggaaugaggaaugugccagaaaagcagacacggggcaucuucggcgccauugcaggguuuaucgagaacggaugggaagguaugguggauggcugguauggguuccgucaccaaaauucagagggacgcggccaggcugccgaccugaagaguacccaggcggccauugaucagauaaacgguaaauugaauagacucaucgggaagacgaacgagaaguuccaccagauugaaaaagaguuuagcgaagucgagggcaggauccaagaccuggaaaaguacguugaggauaccaaaaucgacuuaugguccuauaacgcagagcugcucguggcucuugaaaaucagcauacaauugaucugacugacucugagaugaacaaguuguucgaaaagaccaagaagcagcuacgggagaaugccgaagauaugggaaacggcugcuuuaaaauauaccacaagugugacaaugcuugcaucgggagcauucgaaacggaacauaugaucaugacguauaccgcgacgaggcccugaauaacagauuccagaucaaagguguggagcucaagucaggcuacaaagauuggauucuguggaucaguuuugcaauauccugcuuccuucugugugucgccuugcucggguuuaucaugugggcuugccaaaagggaaauauuagguguaacaucugcauuuga

SEQ ID NO: 130772 - RNA, 1701 nt, Artificial Sequence; identical to SEQ ID NO: 130188
  derived and/or modified sequence opt3 from hemagglutinin__InfluenzaA__AFH74961

SEQ ID NO: 130773 - RNA, 1701 nt, Artificial Sequence; identical to SEQ ID NO: 125629
  derived and/or modified sequence opt3 from hemagglutinin__InfluenzaA__AFH75388

SEQ ID NO: 130774 - RNA, 1701 nt, Artificial Sequence
  derived and/or modified sequence opt3 from hemagglutinin__InfluenzaA__AFH97140
augaaggccauccuggugguccuccuuuacauuuucgcuaccgcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuagcuccuggcccaaucacgauucaaacaagggugucacagccgcuuguccucaugcaggggccaaaaguuuuuauaagaaucugauauggcucgugaaaaagggaaacagcuacccaaaauuaucuaaguccuauaucaaugacaagggcaaagaaguacugguucuuuggggcauucaccaccccucaaccagcgcugaucaacagaguuuguaccagaacgccgacgcguacguguucgucgggacgucucgcuauuccaagaaauuuaagccugagaucgcaauucgaccaaaagugcgugaucaggagggaagaaugaauuacuauuggacucugguggaacccggugacaagaucaccuucgaggccacaggcaaccuagucguuccuagguacgcuuuugccauggaacggaacgcagggagcggaauaauuaucucggauacuccagugcaugacugcaauaccacaugucaaaccccgaaaggcgcuauuaacacgucucuccccuuccagaauauccacccuaucacuauugguaagugcccaaaguauguaaaauccacaaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 130775 - RNA, 1701 nt, Artificial Sequence
  derived and/or modified sequence opt3 from hemagglutinin__InfluenzaA__AFJ05142
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugagugcuucaacuggacagguguuacccagaaugggacguccucugcuuguauucggcgcagcaacuccucauuuuucagucgacugaauuggcugacucaucucaacuuuaaguauccagcauuaaaugugaccaugcccaacaacgagcaguucgacaagcuguacaucuggggaguccaccauccuggcacagauaaagaccagauuuuucuuuaugcccaaagcucuggccguaucacuguguccaccaagagaucacagcaggcuguaauaccaaauauugggagcaggccccggauccgcaacauuccuaguagaaucucuaucuacuggacaauuguuaaaccaggagauauauugcugaucaauuccaccgguaaccuaauugccccgaggggcuacuucaagauccggagcgggaaaucgucuauaaugcgcuccgacgcgcccauuggaaagugcaauucaggcuguaucacgccuaacgguaguaucccaaaugacaagcccuuucagaacgugaaucgaauuacuuauggggcaugcccuagauacgucaaacaaagcacacucaagcuggccaccggaaugaggaacgugccagaaaaacagacucggggcaucuucggcgcuauugccggguuuauagagaauggaugggaagguaugguggauggcugguauggguuccgucaccagaacuccgagggacgcggccaagcagcugaccuuaagucuacacaggccgcgaucgaucagauuaaugguaaacugaacagauugaucgggaagaccaaugagaaauuccaccagaucgaaaaggaguuuagcgaagucgagggcaggauucaagaccucgaaaaguacguugaggauacgaaaauagaccuguggucauauaacgccgaguuacugguggcacucgaaaaccagcauaccaucgaucuuacagacagugagaugaauaagcuguucgaaaagacuaagaaacaguugcgggagaacgcugaagauaugggaaauggcuguuuuaagauuuaccacaagugcgacaacgccugcaucggguccauucgaaauggaaccuauaaccaugauguauaccgcgacgaggcucuaaauaacagauuccagaucaaagguguggagcugaaaagcggcuacaaagacuggauacucuggaucucuuuugccauuucauguuuccugcuuugcgucgcacuguugggguuuaucaugugggccugucaaaagggaaauauuaggugcaacaucuguauauga

SEQ ID NO: 130776 - RNA, 1701 nt, Artificial Sequence
  derived and/or modified sequence opt3 from hemagglutinin__InfluenzaA__AFJ05144
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggguucgcaacauuccuucuagaaucuccauuuacuggacaaucgugaaaccaggagauauccugcuaauuaauagcaccgguaaccucauagccccgaggggcuacuucaagauccggucggggaaaucuuccauuaugcgcucagacgcgcccaucggaaaguguaauagugaaugcauaacgccuaacggcagcauuccaaaugacaagcccuuucagaacgucaaucgaaucacuuauggugcauguccuagauacgugaaacaauccacacugaaacuugccaccgggaugaggaacgugccagagaagcagacucggggaaucuucggcgcuauugccggcuuuaucgaaaaugggugggagggaauggucgaugguugguauggcuuccgucaccagaacucugaggggcgcggacaagcagcugaccuuaagagcacacaggccgcgauugaucagauaaauggcaaauugaacagacucaucgguaagaccaaugaaaaauuccaccagauugagaaggaauuuucagagguugaagggaggauccaagaccuggagaaguacguggaggauacgaaaaucgacuuauggaguuauaacgccgaacugcucguagcacuugagaaccagcauaccauugaucugacagacuccgaaaugaauaaguuguucgagaaaacuaagaaacagcuacgggaaaacgcugaggauaugggcaauggaugcuuuaagauauaccacaagugugacaacgccugcaucggcagcauucgaaaugggaccuauaaccaugauguguaccgcgacgaggcucugaauaacagauuccagaucaaaggagucgaacucaagucugguuacaaagacuggauucuguggaucucauuugccauaaguugcuuccuucuguguguggcauugcucggcuuuaucaugugggccugccaaaaggggaauauuagguguaacaucugcauuuga

SEQ ID NO: 130777 - RNA, 1701 nt, Artificial Sequence
  derived and/or modified sequence opt3 from hemagglutinin__InfluenzaA__AFJ11706
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccgguccucaaacaauagcuuuuucagucgccugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaggcuucuggccgaauuacuguguccaccaagcguucacagcaggccguaaucccaaacauagggagcagacccaggguucggaauauuccuagucgcaucucuauuuacuggacaaucgugaaaccaggagauauccugcuaauuaacuccaccgguaaucucauagcgccgagaggcuacuucaagaucaggagcgggaaaucgucuauuaugcgguccgacgcacccaucggaaaguguaacucagaaugcauaacgccuaauggcaguauuccaaacgacaagcccuuucagaaugucaaccgcaucacuuauggugccuguccucgauacgugaaacaaagcacacugaaacuugcuaccgggaugagaaaugugccagagaagcagacuaggggaaucuucggcgccauugcaggcuuuaucgaaaacgggugggagggaauggucgaugguugguauggcuuccggcaccaaaauuccgaggggcguggacaagcugccgaccugaagucuacacaggcggccauugaucagauaaacggcaaauugaaucgccucaucgguaagaccaacgaaaaauuccaccagauugagaaggaauuuagcgagguugaagggagaauccaagaccuggagaaguacguggaggauacgaaaaucgacuuauggucauauaacgcagaacugcucguagcucuugagaaucagcauaccauugaucugacagacagugaaaugaacaaguuguucgagaaaacuaagaaacagcuaagggaaaaugccgaggauaugggcaacggaugcuuuaccauauaccacaagugugacaaugcuugcaucggcuccauucggaacgggacauaugaucauaauguguaccgagacgaggcccugaacaaucgcuuccagaucaagggagucgaacucaaaagcgguuacaaggacuggauucuguggaucucuuuugcaauaucaugcuuccuucuguguguggccuugcucggcuuuaucaugugggcuugccaaaaagggaacauuagauguaauaucugcauuuga

SEQ ID NO: 130778 - RNA, 1701 nt, Artificial Sequence; identical to SEQ ID NO: 128998
  derived and/or modified sequence opt3 from hemagglutinin__InfluenzaA__AFJ11728

SEQ ID NO: 130779 - RNA, 1701 nt, Artificial Sequence
  derived and/or modified sequence opt3 from hemagglutinin__InfluenzaA__AFJ19842
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaaaaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaacccguggaaucuucggcgcaauugcuggcuuuaucgaaaacgggugggagggaaugauggaugguugguauggcuuccgccaccagaauagcgaggggagaggacaggccgcggaccugaaauccacucaagccgcaauugaucagauaaacggcaaguugaauaggcucaucgguaaaacaaacgaaaaguuccaucagauugagaaagaauuuucugaggucgaagggcggauccaggaccuggagaaguacguugaggauaccaagaucgacuuauggagcuauaacgcugaacugcucguggcccuugagaaucaacacacgauugaucugaccgacucagaaaugaacaaauuguucgagaagacaaagaagcagcuacgagaaaaugcugaggauaugggcaacggaugcuuuaaaauauaccauaagugugacaaugccugcaucggcaguauucgcaacgggacuuaugaucacgacguauacagagacgaggcacugaauaacagguuccagaucaagggaauugaacucaaauccgguuacaaggauuggauccuguggaucagcuuugccauaucuugcuuccuucuguguguggcuuugcucggcuuuauuaugugggcgugccagaaagggaauauccgguguaacauuugcaucuga

SEQ ID NO: 130780 - RNA, 1701 nt, Artificial Sequence; identical to SEQ ID NO: 130377
  derived and/or modified sequence opt3 from hemagglutinin__InfluenzaA__AFJ20171

SEQ ID NO: 130781 - RNA, 1701 nt, Artificial Sequence; identical to SEQ ID NO: 128998
  derived and/or modified sequence opt3 from hemagglutinin__InfluenzaA__AFJ20182

SEQ ID NO: 130782 - RNA, 1701 nt, Artificial Sequence
  derived and/or modified sequence opt3 from hemagglutinin__InfluenzaA__AFJ74386
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccaaucuuagcaagucuuacgucaacaauaaagagaaggaaguguugguacuguggggcguucaucacccuuccaacaucggcgaucagcgcgcaauuuaccacaccgagaacgccuaugugucagucaugagcagucauuacucucgacguuuuacaccagaaaucgcuaagagacccaaagugagggaccaggaggggcggauaaauuauuacuggacucuacucgagccuggagauaccaucauuuucgaagccaacgguaaucugaucgcgccaugguaugcauuugcccuuucccgcggcuucgggagcggaauuaucacaucgaacgcuucuaugggcgagugugacgccaagugccagaccccgcaaggugcaauaaauuccucacugcccuuucagaacgugcacccugucacgauuggggaauguccaaaauacguuagaaguacuaaguugaggauggugacaggacuccggaauauccccagcauucagucccgcggccuguucggcgcuaucgccggguuuaucgagggagguuggaccggcaugauugaugggugguauggauaccaucaccagaacgaacaaggcucugguuacgcggccgaccagaaaagcacucagaaugcaauagaugggaucacaaacaagguaaauucagugauugagaaaaugaacacccaguucacggcugucggcaaggaguucaauaaguuagaacgaagaauggagaaccugaauaaaaagguggacgauggauuucucgacaucuggaccuauaacgccgaacuucugguuuugcuagagaacgaaaggacacuggacuuccacgauaguaaugugaaaaaccucuacgagaaggucaaaaaucaacugaagaacaaugcuaaggagauaggcaacgggugcuuugaguucuaucauaaauguaauaacgaaugcauggaauccgugaagaauggaacuuacgacuauccuaaauacagcggugagucuaaacuuaaccgggagaaaauugauggcguaaagcuggaaucaauggggguuuaucagaucuuggccaucuacaguaccguggcaagcucccucguccuguuagugucucugggagccauuucguuuuggaugugcagcaauggcucccuacagugucguaucugcauuuga

SEQ ID NO: 130783 - RNA, 1701 nt, Artificial Sequence
  derived and/or modified sequence opt3 from hemagglutinin__InfluenzaA__AFJ74407
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcuuugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugucaagagcuuuuucucccgucucaacugguuacacaaacuggaguacaaguauccagcccuuaaugugacuaugcccaacaaugauaaauuugacaaguuguacauauggggcgugcaucacccuucaaccgauagugaccaaacaagccuguacguacaggcuucugggagaguuacuguguccaccaaaaggucacagcagacagucaucccaaacauuggaagccggcccugggugcgcggugugaguucuagaaucuccauuuauuggaccaucgucaagccuggcgacauacuacucauuaauagcacggggaaccugaucgccccaaggggauacuucaagauucggucgggcaaaucuuccaucaugcgcucagaugcgccgaucgguaacuguaguagcgagugcauuacucccaauggguccauaccuaacgacaagccauuucaaaauguuaaccgaaucacauauggagcaugucccagauacgugaaacagaauacccuuaagcuggccacuggcaugaggaacguaccugaaaaacagacacggggcauuuucggggcuaucgccggauuuauagagaaugguugggaaggcaugguggaugggugguauggauuccgucaccagaacucugagggcaccggucaagcagcugaccuuaagagcacgcaggccgcgauuaaucagaucaacgggaaacucaaucgccugaucgagaagaccaacgaaaaguuucaucaaauugagaaagaguucucagaagucgaaggcagaauccaggauuuagagaaguacguggaggacacaaaaauugaucuguggaguuauaaugccgaacuccuuguugcacuggagaaccagcacacuauagacuugaccgauuccgaaaugaauaagcuauucgagaggacacggaaacagcugcgagaaaacgcugaggacaugggaaacggcugcuuuaagaucuaccauaagugugauaaugccugcauugggagcauccgcaacggaacuuacgaccacgacguguauagagaugaggcucucaauaacagguuccaaaucaaaggugucgaacugaagucuggcuacaaagacuggauucuuuggauaucauuugccaucaguugcuuccuguugugugugguacuccugggguuuauuaugugggcaugccagaagggaaauauccgguguaacauuugcaucuga

SEQ ID NO: 130784 - RNA, 1701 nt, Artificial Sequence
  derived and/or modified sequence opt3 from hemagglutinin__InfluenzaA__AFJ74418
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccauaaagucauuuuucagucgucucaacugguuacaccagcugaaguauaaauacccagcccuuaaugugacgaugcccaacaaugagaaguuugacaaauuguauaucuggggaguccaucacccuagcacugauucugaccagauuucccuguacgcucaggccucaggcagagugaccguaagcacaaagaggagucaacagacuguuaucccaaacauuggcucucggcccugggugcgcggggucuccagcagaaucucgauauacuggaccauugugaaaccuggagauauccuacucauuaacucuacagguaaucugaucgcgccaaggggcuauuucaagauccgguccgggaagucaaguauuaugcgcagcgacgcaccgauaggaaaauguaacuccgaaugcaucacccccaauggcucuauuccuaacgacaagccauuucagaaugugaaccgaaucacguacggugccugucccagauaugucaaacagaauacucuuaagcuggcuacagggaugaggaacguuccugagaaacaaacccggggaauauucggcgccauugcaggcuuuaucgaaaaugggugggagggaaugguggaugguugguacggcuuccgucaccagaacagcgaggggacuggacaggcugccgacuugaagucaacacaagcggccaucaaucagauuaacggcaaacucaaucgccugaucgaaaagaccaacgagaaguuucaucagauugaaaaagaguucagugaaguagaggguagaauacaggauuuagagaaguauguggaagacacgaaaaucgaucugugguccuacaaugcagagcuccuugucgcucuggaaaaccaacacaccauugacuugacagauagcgagaugaacaagcuauucgaaaggacuaaaaagcagcugcgggagaaugccgaggacauggggaacggcugcuuuaagaucuaucauaaaugugauaaugcuugcaucggaucuauucgaaacggcaccuacgaccacgauguguaccgcgacgaagcccucaauaacagauuccagauaaaggggguugagcugaaaucaggauauaaggacuggauccuuuggauuaguuuugcaaucagcugcuuccuguugugugugguccuccuggguuuuauuaugugggccugccagaaaggcaauaucagguguaacauaugcaucuga

SEQ ID NO: 130785 - RNA, 1701 nt, Artificial Sequence
  derived and/or modified sequence opt3 from hemagglutinin__InfluenzaA__AFJ74437
augaagaccaucauugcccugagcuacauacucugcaaaguguucgcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacaccagauucuagauggcgagaauuguacccucaucgacgcucugcuuggggauccgcauugcgacggauuucagaacaaggaaugggaucuguucguggagagguccaaagccuauucuaauuguuaccccuaugacgucccugauuacgcaucguugcggucacucguggccagcaguggcacucuggaauuuaacaaugaguccuucaacuggacagguguugcucaaaaugggaccucuagcgcaugcaagcgccgauccauaaagucauuuuucagucgucugaacuggcuccaccaguuaaaauauaaguacccagcccugaaugugacgaugcccaacaaugagaaauuugacaaacuuuauaucuggggaguccaucacccuagcacugauucugaccagauuuccuuguacgcucaggccucaggcagagugaccguaagcacaaagaggagucaacagacuguuaucccaaacauuggcucucggcccugggugcgcggggucuccagcagaaucucgauauacuggaccauugugaagccuggagauauccugcuaauuaacucuacagguaaucucaucgcgccaaggggcuauuucaagauccgguccgggaaaucaaguauuaugcgcagcgacgcaccgauaggaaaguguaacuccgaaugcaucacccccaauggcucuauuccuaacgacaaaccauuucagaaugugaaccgaaucacguacggugccugucccagauaugucaagcagaauacucugaaacuugcuacagggaugaggaacguuccugagaagcaaacccggggaauauucggcgccauugcaggcuuuaucgaaaaugggugggagggaaugguggaugguugguacggcuuccgucaccagaacagcgaggggacuggacaggcugccgaccugaaaucaacacaagcggccaucaaucagauuaacggcaaguugaaucgccucaucgaaaagaccaacgagaaauuucaucagauugaaaaggaguucagugaaguagaggguagaauacaggaucuggagaaauauguggaagacacgaagaucgauuuaugguccuacaaugcagagcugcucgucgcucuugaaaaccaacacaccauugaccugacagauagcgagaugaacaaauuguucgaaaggacuaagaagcagcuacgggagaaugccgaggacauggggaacggcugcuuuaaaaucuaucauaagugugauaaugcuugcaucggaucuauucgaaacggcaccuacgaccacgauguguaccgcgacgaagcccugaauaacagauuccagauaaaagggguugagcucaagucaggauauaaagacuggauccuguggauuaguuuugcaaucagcugcuuccuucuguguguggucuugcucgguuuuauuaugugggccugccagaagggcaauaucagguguaacauaugcaucuga

SEQ ID NO: 130786 - RNA, 1701 nt, Artificial Sequence
  derived and/or modified sequence opt3 from hemagglutinin__InfluenzaA__AFJ74448
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacugguacagucuucaaguacagguagaaucugcgacagcccacaccagauucucgauggcgagaauuguacccugaucgacgcccuucuagggggaccgcauugcgauggcuuucagaacaaagaaugggacuuguucguggagagguccaaggcuuauucuaauuguuaccccuaugaugucccugacuacgcaucgcuccggucacugguggccagcagugguacucuggaauuuaacaaugaguccuucaacuggacagggguugcucaaaauggaaccucuagcgcaugcaaacgccgauccaacaagucauuuuucagucgucucaauugguuacaccagcugaaguauaaauacccagcccuuaacgugacgaugcccaauaacgagaaguuugauaaauuguauauauggggcguccaucacccuagcacugacucugaucagaucucccuguacgcucaggccucaggcagagugaccguaagcacaaagaggagucaacagacuguuauuccaaacaucgggucucggcccugggugcgcggagucuccagcagaauuucgaucuacuggaccauagugaaaccuggugacauucuacucaucaauucuacaggcaaccugauugcgccaaggggguauuucaagauccgguccggaaagucaaguaucaugcgcagcgaugcaccgauuggcaaauguaauuccgaaugcauaacccccaacgguucuaucccuaaugacaagccauuucagaacgugaaucgaauuacguacggggccugucccagauaugucaaacagaacacucuuaagcuggcuacaggaaugaggaauguuccugagaaacaaacccggggcaucuucggcgccauagcaggguuuauugaaaacggaugggaggguaugguggacggcugguacggguuccgucaccagaauagcgagggaacuggccaggcugccgauuugaagucaacacaagcggccaucaaccagaucaaugguaaacucaaccgccugauugaaaagaccaaugagaaguuucaucagaucgaaaaagaguucagugaaguagaggggaggauucaggacuuagagaaguauguggaagauacgaaaauagaccugugguccuacaacgcagagcuccuugucgcucuggaaaaccaacacaccaucgauuugacagacagcgagaugaauaagcuauucgaaagaacuaaaaagcagcugcgggagaacgccgaggauaugggcaauggaugcuuuaagauuuaucauaaaugugacaacgcuugcaucggcucuauccgaaaugggaccuacgaucacgacguguaccgcgaugaagcccucaacaauagauuccagauuaagggaguugagcugaaaucagguuauaaggacuggauacuuuggaucaguuuugcaauuagcugcuuccuguugugugugguccuccugggcuuuaucaugugggccugccagaaagggaacauuagguguaauaucugcauauga

SEQ ID NO: 130787 - RNA, 1701 nt, Artificial Sequence
  derived and/or modified sequence opt3 from hemagglutinin__InfluenzaA__AFJ74459
auggaggccaagcugcucgugcuucugugcgcuuucaccgcaacauacgccgacacuaucuguauuggcuaucacgcgaacaauagcacggauaccgucgacacaguuuuggaaaagaacgugacuguaacccauuccgugaauuuacuggaggauucucacaacgggaagcuaugcagacucaaaggaacagcuccccugcagcuugguaauuguucaauagccggcuggauccuggggaacccugaaugcgagaguuuguuuagcaaggaauccuggucuuacauugcagagaccccaaauccggagaacggaacuuguuaucccggcuacuucgccgacuaugaagaacucagggaacaacugucgucagucagcaguuuugagcgguucgagaucuuuccuaaagaauccucuuggccaaaucauacagugaccaaggguguuacggcuagcugcucccacaacgggaagucaaguuucuacaaaaaucugcucugguuaacugagaagaacggacuguaucccaaucuuagcaaaucuuacgugaacaauaaggaaaaagaggucuuggugcuguggggcguacaucacccuuccaacauuggcgaucagcgcgcaaucuaccacaccgaaaacgccuauguuucaguggucagcagucauuacucucgacguuuuacaccagagauagcuaagagacccaaggugaggaaucaggaggggcggaucaacuauuacuggacucuacucgaaccuggagacaccauuaucuucgaggccaaugguaaccugauugcgccaugguaugcauuugcccuuucccgcggcuucgggagcggaaucauaacaucgaaugcuucuaugggcgaaugugaugccaaaugccagaccccgcaaggugcaauuaacuccucacugcccuuucagaaugugcacccugucacgaucggggaguguccaaaguacguuagaaguacuaaauugaggauggugacaggacuccggaacauucccagcauccagucccgcggccuguucggcgcuaucgccggguuuauugaaggagguuggaccggcaugauagacgggugguauggauaccaucaccagaaugagcaaggcucugguuacgcggccgaucagaaaagcacucagaacgcaaucaaugggauuacaaacaaaguaaauucaaucauagagaagaugaacacccaguucacggcugugggcaaagaguucaauaaguuagagcgaagaauggaaaaccugaacaagaaagucgacgauggauuucucgacauuuggaccuauaaugccgagcuucugguguugcuagaaaacgagaggacacuggauuuccacgacaguaauguuaagaaccucuacgagaaagugaagaaucaacugaaaaacaaugcuaaggaaaucggcaacgggugcuuugaguucuaucauaaguguaauaacgaaugcauggaguccgucaaaaauggaacuuacgacuauccuaaguacagcaaagagucuaaacuuaaccgggaaaagaucgauggugugaagcuggagucaaugggcguauaucagauuuuggccaucuacaguaccguugcaagcucccucgugcuguuagucucucugggggccauuucguuuuggaugugcagcaauggaucccuacagugucguauaugcaucuga

SEQ ID NO: 130788 - RNA, 1701 nt, Artificial Sequence
  derived and/or modified sequence opt3 from hemagglutinin__InfluenzaA__AFJ74470
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuaacaaugaauccuucaacuggacagguguugcucagaaugggaccucuuaugcaugcaagcgacguagcgugaaguccuuuuucucaagacucaacugguuacacaaacuggaguacaaguauccagcccuuaaugucacgaugcccaacaaugacaaauuugauaaguuguacauauggggagugcaucacccuaguacugacagcgaucaaaucucucuguacgcucagaccuccggcaggguaacaguuucaacuaaacggagccagcagaccgugauuccaaacaucggcagucgccccugggucagaggggugucuuccaggauuagcaucuauuggacaauagugaagccuggagacauucuacucaucaacucgaccgguaaucugauugccccacggggcuacuucaagauccgcucugggaaauccucaaucaugcgaagugacgcgccgauuggaaacuguagcuccgagugcauaacgcccaauggcucuaucccuaacgauaagccauuucaaaaugucaacagaauuacuuauggugcaugucccagguacguuaaacagaauacacuuaagcuggccaccgggaugcggaacgugccugaaaaacagacucguggaaucuucggcgcuauagccggcuuuauugagaaugggugggaaggaaugguagacgguugguauggcuuccgccaccagaacagcgaggggacaggacaagcagcugauuugaagucaacccaggccgcgaucaaucagaucaacggcaaacucaauagacugauugagaagacgaacgaaaaguuucaucaaaucgagaaagaguucagugaaguggaagguaggauucaggacuuagagaaguacgucgaggauaccaaaauagaccugugguccuauaaugccgaacuccuuguggcacuggagaaccagcacacaaucgauuugacugacagcgaaaugaacaagcuauucgagcggacccgaaaacagcugcgcgaaaaugcugaggauauggggaacggcugcuuuaagauuuaccauaagugugacaaugccugcaucggaucuaucagaaacggcacauacaaucacgauguuuauagggacgaggcucucaacaaucgguuccaaauuaaagggguggaacugaagucaggauacaaagacuggauacuuuggaucaguuuugccauuagcugcuuccuguugugugucgugcuccuggguuuuaucaugugggcaugccagaagggcaacauucgcuguaauaucugcauauga

SEQ ID NO: 130789 - RNA, 1701 nt, Artificial Sequence
  derived and/or modified sequence opt3 from hemagglutinin__InfluenzaA__AFJ74492
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacaagaaauuugacaaguuguauauauggggaguccaucacccuagcacugauucugaccagaucucccuguacgcucaggccucaggcagagugaccguaagcacaaaaaggagucaacagacuguuauuccaaacaucggcucucggcccugggugcgcggggucuccagcauuaucucgauauacuggaccauugugaagccuggagauauccuacucauuaauucuacagguaaccugaucgcgccaagaggcuauuucaagaucaggaaugggaaauccucaauuaugcggagugacgcaccgauaggaaaguguaacagcgagugcaucacccccaauggcuccauuccuaacgacaaaccauuucagaaugugaaccgcaucacguacggugccuguccccgauaugucaagcagaauacucuuaaacuggcuacagggaugagaaacguuccugaaaagcaaaccaggggaauauucggcgccauugcaggcuuuaucgagaaugggugggaaggaaugguggaugguugguacggcuuccggcaccagaacucugaggggacuggacaggcugccgacuugaaaagcacacaagcggccaucaaucagauuaacggcaagcucaaucgucugaucgguaagaccaacgagaaauuucaucagauugaaaaggaguucucagaaguagaggggcgcauacaggauuuagaaaaauauguggaggacacgaagaucgaucuguggaguuacaacgcagagcuccuugucgcucuggaaaaucaacacaccauugacuugacagauuccgagaugaacaaacuauucgaaagaacuaagaagcagcugagggagaaugccgaagacaugggcaacggaugcuuuaaaaucuaucauaagugugauaaugcuugcaucggcagcauucggaacgggaccuacgaccacgauguguaccgagacgaggcccucaauaaccgcuucaaaauaaagggaguugagcugaaaucugguuauaaggacuggauccuuuggauuucauuugcaaucaguugcuuccuguugugugugguccuccugggcuuuauuaugugggccugccagaaggggaauaucagauguaacauaugcaucuga

SEQ ID NO: 130790 - RNA, 1701 nt, Artificial Sequence
  derived and/or modified sequence opt3 from hemagglutinin__InfluenzaA__AFJ74525
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcgagaauuguacccugaucgacgcucuacugggggauccgcauugcgacggauuucagaacaaagaaugggauuuguucguggagcgguccaaggccuauucuaauuguuaccccuaugacgucccugauuacgcaucgcuccgcucacugguggccagcaguggcacucuggaauuuaacaaugaguccuucaacuggacagguguugcucaggacgggaccucuagcgcaugcaaacgacguuccauaaagucauuuuucaguagacucaauugguuacaccaacugaaguauaaauacccagcccuuaacgugacgaugcccaauaacgauaaguuugacaaauuguauaucuggggaguccaucacccuagcacugauucugaccagaccucccuguacgcucaggccucaggcagggugacaguaagcacuaagcggagucagcaaaccguuauuccaaauaucggcucucgccccugggugagaggggucuccagcauuaucucgauauacuggacaauugugaaaccuggagacauccuacucauuaacucuaccgguaaccugaucgcgccaaggggcuauuucaagauccgguccgggaagucaaguauuaugcgcagcgaugcaccgauaggaaaauguaauuccgagugcaucacgcccaacggcucuauuccuaaugacaagccauuucagaacgugaaucgaaucacuuacgguacaugucccagauaugucaaacagaacacccuuaagcuggccacugggaugaggaauguuccugaaaaacagacacggggaauauucggcgcuauugccggcuuuaucgagaacgggugggaaggaaugguggaugguugguacggcuuccgucaccaaaauagcgaggggaccggacaggcagcugacuugaagucaacgcaggccgcgaucaaccaaauuaauggcaaacucaaccgccugaucgagaagaccaaugaaaaguuucaucagauugagaaagaguucagugaaguagaagguagaauacaggauuuagagaaguauguggaggacacaaaaaucgaucugugguccuacaacgccgaacuccuugucgcacuggagaaucagcacacuauugacuugaccgauagcgaaaugaacaagcuauucgagaggacacggaaacaacugcgagaaaacgcugaggacauggggaauggcugcuuuaagaucuaucauaagugugauaacgccugcaucggaucuauucgcaauggcacuuacgaccacgacguguacagagaugaggcucucaacaauagguuccagauaaaagggguugaacugaagucaggauauaaagacuggauccuuuggauuaguuuugccaucagcugcuuccuguugugugugguccuccuggguuuuauuaugugggcaugccagaagggcaacauccgguguaauauaugcaucuga

SEQ ID NO: 130791 - RNA, 1701 nt, Artificial Sequence; identical to SEQ ID NO: 130789
  derived and/or modified sequence opt3 from hemagglutinin__InfluenzaA__AFJ74535

SEQ ID NO: 130792 - RNA, 1701 nt, Artificial Sequence
  derived and/or modified sequence opt3 from hemagglutinin__InfluenzaA__AFJ74560
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaauugguacagucuucaaguacagguagaaucugcgacagcccacaccagauucucgauggcgagaauuguacccugaucgacgcccuucugggggauccgcauugcgacggauuucagaacaaagaaugggauuuguucguggagagguccaaggcuuauucuaauuguuaccccuaugacgucccugauuacgugucgcuccggucacugguugcaagcaguggcacucuggaauuuaacaaugaguccuucaacuggacagguguggcccaaaaugggaccucuagcgcuugcaaacgccgauccgacaagucauuuuucagucgucucaacugguuacaccagcugaaguauaaauacccagcacuuaaugucacgaugcccaacaaugagaaguuugauaaauuguauauauggggagugcaucacccuggcacugacagcgaucagaucucucuguacgcccagaccuccggcagaguaacaguuucaacuaagaggagccaacagaccgugauuccaaacaucgggaguggacccuggguccggggugugucuucccgcauuagcaucuacuggacaauagugaaaccuggcgacauucuacucaucaacucgaccgggaaucugauugcuccaagaggauauuucaagaucaggucuggcaaguccucaaucaugcggagugacgccccgauugguaaauguaacagcgaaugcauaacgcccaauggguccaucccuaacgauaagccauuucagaaugucaaccgcauuacuuacggacccuguccucgauauguuaaacagaauacacuuaagcuggcgaccggcaugagaaacgugccagagaaacaaacuaggggcaucuucggggcaauagccggauuuauugaaaaugguugggagggcaugauggacgggugguacggauuccggcaccagaacucugagggcacaggucaggcugccgaucuaaagagcacccaagcagcuaucaaucagaucaacgggaaacucaaucgucugguagaaaagacgaacgagaaguuucaucagauugaaaaagaguucucagaaguggagggccgcauccaggacuuagagaaguaugucgaagauaccaaaauugaccuguggaguuacaaugccgagcuccuuguggcgcuggaaaaccaacacacaauagauuugacugacuccgagaugaacaagcuauucgaaagaaccaaaaagcagcugagggagaaugccgaggauaugggaaacggcugcuuuaagaucuaucauaaaugugacaaugcaugcauugggagcauccggaacggaacauacgaucacgacguuuaccgagacgaagcucucaauaaccgcuuccagaucaaggguguggagcugaaaucuggcuauaaggauuggauucuuuggauaucauuugccaucaguugcuuccuguuguguauuguccuccugggguuuaucaugugggcuugccagaaaggaaauauuagauguaacaucugcauauga

SEQ ID NO: 130793 - RNA, 1701 nt, Artificial Sequence
  derived and/or modified sequence opt3 from hemagglutinin__InfluenzaA__AFJ74634
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucaguuaaaauauaaguacccagcacugaacgugaccaugcccaauaacgagaaauuugacaaacuuuauaucuggggcguccaucacccuggcacagauagcgaccagauuucuuuguacgcccaggcuuccgggcguaucacugugucaaccaagagaagccagcagacaguaauuccaaacaucggaaguaggccccggguucgcgaugugucuuccagaauaagcauuuacuggaccaucgucaagccuggugacauucugcuaaucaauucgacgggcaaccucaucgccccaaggggguauuucaagauucggucuggaaaauccucaauaaugcgcagugacgcgccgaucggcaaguguaauagcgagugcauuacucccaacgguuccaucccuaaugauaaaccauuucagaacgugaaucgaauaacauacggggcaugucccagauaugugaagcaaaacacccugaaacuugccacuggaaugaggaaugucccugaaaagcagacacggggcauuuucggcgcuaucgccggguuuaucgagaacggaugggaagguaugguugacggcugguacggguuccgucaucaaaauucugagggaaccggccaagcagcugaucugaaaagcacgcaggccgcgauuaaccagaucaaugguaaguugaaccgccucauugggaagaccaaugagaaauuucaccagauagaaaaggaguucucagaaguggagggcagaauccaagaccuggaaaaauauguagaggauacaaagauugacuuauggaguuacaacgccgagcugcucguggcacuugaaaaccagcacacuaucgaucugaccgacuccgagaugaauaaauuguucgaaaggacaaagaagcagcuacgggagaacgcugaagauaugggaaauggcugcuuuaaaaucuaucauaagugugacaacgccugcauugggagcauacgaaauggaacuuacgaucacgacgucuaccgcgacgaggcucugaacaauagauuccagaucaaagguguggagcucaagucuggcuauaaagauuggauucuguggaucucauuugccauuaguugcuuccuucuguguguugcauugcucggguuuaucaugugggccugccaaaagggaaacauaagguguaauaucugcauuuga

SEQ ID NO: 130794 - RNA, 1698 nt, Artificial Sequence
  derived and/or modified sequence opt3 from hemagglutinin__InfluenzaA__AFJ74653
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggcuacuuugcugacuaugaggaacugagagagcaacucucuucggugagcucauucgaaagguuugagauuuucccuaaggagaguuccuggccaaaucauacugucacaggugugucugccagcugcucccacaacgggaaaucaaguuuuuacaagaauuuacuguggcuuaccggcaaaaacggauuguaucccaaucugagcaagucuuacgcaaacaauaaagaaaaggaggugcuaguucucuggggcgugcaucacccuccaaacaucggggaucagcgggcccuguaccacacggacaacgcuuaugucuccguggugucaagccauuacagucgcaaguucacucccgaaauagcaaaacgaccuaagguccgugaucaggagggaagaaucaauuauuacuggacccuucuggaaccaggugacacaauuaucuuugaggccaacggcaauuugauugcuccgagguaugccuucgcgcucucucggggguuuggauccggcaucauaaacagcaaugcacccauggaugagugugacgccaaaugccagacuccucaaggugcuauuaacucgucucugccauuccagaauguucaccccgugaccaucggggaauguccuaaguacguacgcuccgccaaauuaagaauggugacaggacugaggaacauuccaucaauccagagucggggccucuuuggcgcaaucgcuggguucauugagggagguuggaccggcauggucgaugggugguauggauaccaucaccagaaugaacaaggcagcgguuacgccgcggaccagaaguccacgcagaacgccauaaaugggaucacuaacaaaguaaauucuguuauugagaagaugaacacacaguuuaccgcagugggcaaggaguucaauaaacuugaacgccgaauggagaaccugaacaagaaagucgaugacggauucaucgacauauggacuuauaaugcugaauugcuagugcugcucgagaacgaaagaacacuggauuuucacgacagcaauguaaagaaccuuuacgagaaaguuaagucacaacugaagaauaacgccaaagaaauuggcaaugggugcuucgaguuuuaucauaaguguaacgaugagugcauggaaagugugaaaaauggaaccuacgacuaucccaaguacuccgaggaaagcaaauugaacagggagaagaucgauggugucaagcucgagucuaugggcguguaucagauccuggcuauuuacucaacggucgccaguagcuuagugcugcuaguuucccucggggcaaucucuuucuggaugugcucgaauggaagccugcagugucggauuugcauauga

SEQ ID NO: 130795 - RNA, 1698 nt, Artificial Sequence
  derived and/or modified sequence opt3 from hemagglutinin__InfluenzaA__AFJ74673
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggcuacuuugcugacuaugaggaacugagagagcaacucucuucggugagcucauucgaaagguuugagauuuucccuaaggagaguuccuggccaaaucauacugucacaggugugucugccagcugcucccacaacgggaaaucaaguuuuuacaagaauuuacuguggcuuaccggaaagaacggcuuguaucccaaucugcggaaaagcuacgcaaacaauaaagaaaaggaggugcuaguucucuggggcgugcaucacccuccaaacaucggggaucagcgcgcccuguaccacacggacaacgcuuaugucucugugguguccucacauuacagccgaaaguucacucccgaaauagcaaaacguccuaaggucagagaucaggagggaaggaucaauuauuacuggacccuucuggaaccaggugacacaauuaucuuugaggccaacggcaauuugauugcuccgcgguaugccuucgcgcucagucgcggguuuggaucuggcaucauaaacuccaaugcacccauggaugagugugacgccaaaugccagacuccucaaggugcuauuaacagcucgcugccauuccagaauguucaccccgugaccaucggggaauguccuaaguacguaagaucugccaaauuaaggauggugacaggacugcggaacauuccauccauccagucacgcggccucuuuggcgcaaucgcuggguucauugagggagguuggaccggcauggucgaugggugguauggauaccaucaccagaaugaacaaggcagugguuacgccgcggaccaaaagagcacgcagaacgccauaaaugggaucacuaacaaaguaaauuccguuauugagaagaugaacacacaguuuaccgcagugggcaaggaguucaauaaacuugaacgaagaauggagaaccugaacaagaaagucgaugacggauucaucgacauauggacuuauaaugcugaauugcuagugcugcucgagaacgaaaggacacuggauuuucacgacucuaauguaaagaaccuuuacgagaaaguuaagagccagcugaagaauaacgccaaagaaauuggcaaugggugcuucgaguuuuaucauaaguguaacgaugagugcauggaaucagugaaaaauggaaccuacgacuaucccaaguacagugaggaauccaaauugaaccgggagaagaucgauggugucaagcucgagagcaugggcguguaucagauccuggcuauuuacucuacggucgccucaaguuuagugcugcuaguuagccucggggcaaucuccuucuggaugugcucuaauggaucgcugcagugucguauuugcauauga

SEQ ID NO: 130796 - RNA, 1701 nt, Artificial Sequence
  derived and/or modified sequence opt3 from hemagglutinin__InfluenzaA__AFJ74674
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguggcaucugcgacagcccacaccagauucucgauggggagaauuguacccugaucgacgcucuacugggagauccgcauugcgacggcuuucagaacaaaaagugggauuuguucguggaaagauccaaagccuauucuaauuguuaccccuaugacgucccugauuacgcaucgcucaggucacugguggccagcagugguacucuggaguuuaacaaugaauccuucaacuggacagggguugcucaaaauggaaccucuagcgcaugcaagcggcgcuccaacaagucauuuuucagucgacucaauugguuacaccagcugaaauauaaguacccagcccuuaacgugacgaugcccaauaacgagaaauuugacaaguuguauauauggggcguccaucacccuggcacugauagcgaccagaucucucuguacgcucaggccuccgggcguauuaccgugucaacaaaaagaagccaacagacuguaaucccaaacauuggaaguaggccccggguucgcgaugugucuuccagaaucagcauauacuggaccauugucaagccuggugacauccuacucauuaauucgacaggcaaccugaucgcgccaaggggguauuucaagauccggucuggacgcuccucaauuaugcgaagugacgcaccgauaggcaaauguaauagcgagugcaucacccccaacgguuccauuccuaaugauaagccauuucagaacgugaauagaaucacguacggggccugucccagguaugugaaacagaacacucuuaagcuggcuacaggaaugcggaaugucccugaaaaacaaccacguggcauauucggcgccauugcaggguuuaucgagaacggaugggaagguaugguugacggcugguacggguuccgccaccaaaauucugagggaaccggccaggcugccgauuugaaaagcacucaggcggccaucaaccagauuaaugguaaacucaacagacugaucgggaagacaaaugagaaguuucaucagauugaaaaagaguucucagaaguggagggcaggauacaggacuuagaaaaguauguagaggauaccaaaaucgaccuguggaguuacaacgcagagcuccuuguggcucuggaaaaccaacacacgauugauuugaccgacuccgagaugaauaagcuauucgaacggacaaagaagcagcugcgagagaacgccgaagauaugggaaauggcugcuuuaagaucuaucauaaaugugacaacgcuugcaucgggagcauucgcaauggaacuuacgaucacgacgucuacagagacgaggcccucaacaauagguuccagauaaaggguguggagcugaaaucuggcuauaaggauuggauccuuuggauuucauuugcaaucaguugcuuccuguuguguguugcccuccugggguuuauuaugugggcuugccagaaaggaaacauccgguguaauauaugcaucuga

SEQ ID NO: 130797 - RNA, 1698 nt, Artificial Sequence; identical to SEQ ID NO: 130794
  derived and/or modified sequence opt3 from hemagglutinin__InfluenzaA__AFJ74694

SEQ ID NO: 130798 - RNA, 1701 nt, Artificial Sequence
  derived and/or modified sequence opt3 from hemagglutinin__InfluenzaA__AFJ74695
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagaauagcucaacagguagaaucugcgacaguccacaccagauucucgauggcgagaacuguacccugaucgacgcucuacugggggauccgcauugcgacggauuucagaauaaagaaugggauuuguucguggagaggagcaaggccuauuccaacuguuaccccuaugacgucccugauuacgugucucuccggucgcugguugcaucaagcggcacucuggaauuuaauaacgagaguuucaauuggacagguguggcccaagacgggaccuccucugcuugcaaacgccgaagcgauaaguccuuuuucucacgucucaacugguuacaccagcugaaguauaaauacccagcacuuaaugucacgaugcccaacaaugagaaguuugacaaauuguauauauggggagugcaucacccuggcacugauagugaccagaucagccuguacgccagagcuucuggcaggguaaccguuuccacaaagcggucacagcaaacugugauuccaaacaucgggagccgccccugggucagaggagugaguucuaaaauuuccaucuacuggaccauagugaagccuggugacauucuacucaucaacagcacaggcaaucugauugccccaaggggguauuucaagauccggucgggaaaaucuuccaucaugcgcucagaugcgccgauuggcaaguguaacagugaaugcauaacccccaaugguagcaucccuaacgacaaaccauuucagaaugucaaccgaauuacguacgggcccuguccuagauauguuaagcagaauacucuuaaacuggcaacaggaaugaggaacgugccagagaagcagacccggggcaucuucggcgccauagcuggguuuauugaaaauggaugggaggguaugguagauggcugguacggguuccgucaccaaaacuccgagggaacuggccaggccgcagacuugaaaucuacacaggcugccaucaaucaaaucaacgguaagcucaaucgccugauugaaaagaccaacgagaaauuucaucagaucgaaaaggaguucagcgaaguggaggggaggauucaggauuuagagaaauaugucgaagacacgaagauagaucuguggucauacaaugcggagcuccuuguggcccuggaaaaccagcacaccaucgacuugacagauagugagaugaacaaacuauucgaaagaacuaagaagcaacugcgggagaaugcagaggacaugggcaacggaugcuuuaaaauuuaucauaagugugauaaugcuugcaucggcuccauccgaaacgggaccuacgaccacgacguuuaccgcgaugaagcccucaauaacagauuccagauuaaaggaguggagcugaagucugguuauaaagacuggauacuuuggaucucuuuugcuauuucaugcuuccuguuguguaucguccuccugggcuuuauuaugugggccugccagaaggggaauaucagguguaacauaugcaucuga

SEQ ID NO: 130799 - RNA, 1701 nt, Artificial Sequence
  derived and/or modified sequence opt3 from hemagglutinin__InfluenzaA__AFJ74727
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucaguuaaaauauaaguacccagcacugaacgugaccaugcccaauaacgagaaauuugacaaacuuuauaucuggggcguccaucacccuggcacagauagcgaccagauuucuuuguacgcccaggcuuccgggcguaucacugugucaaccaagagaagccagcagacaguaauuccaaacaucggaaguaggccccggguucgcgauauaucuuccagaauuagcaucuacuggaccauugugaagccuggugacauccugcuaaucaauucgacgggcaaccucauugccccaaggggguauuucaagauacggucuggaaaauccucaaucaugcgcagugacgcgccgauuggcaaguguaauagcgagugcaucacucccaacgguuccauaccuaaugauaaaccauuucagaacgucaaucgaauuacauacggggcaugucccagauaugugaagcaaaacacccugaaacuugccacuggaaugaggaaugugccugaaaagcagacacggggcaucuucggcgcuaucgccggguuuauugagaacggaugggaagguauggucgacggcugguacggguuccgucaucaaaauucugagggaaccggccaagcagcugaucugaaaagcacgcaggccgcgaucaaccagauuaaugguaaguugaaccgccucauagggaagaccaaugagaaauuucaccagaucgaaaaggaguucucagaaguugagggcaggauucaagaccuggaaaaauauguggaggauacaaagaucgacuuauggaguuacaacgccgagcugcucguagcacuugaaaaccagcacacuaucgaucugaccgacuccgagaugaauaaauuguucgaaagaacaaagaagcagcuacgggagaacgcugaagauaugggaaauggcugcuuuaaaauuuaucauaagugugacaacgccugcauagggagcauccgaucuggaacuuacgaucacgacguguaccgcgacgaggcucugaauaacagauuccagauuaaaggugucgagcucaagucaggcuauaaagauuggauccuguggauuaguuuugccaucagcugcuuccuucuguguguggcauugcucggguuuauaaugugggccugccaaaagggaaauaucagguguaacauuugcaucuga

SEQ ID NO: 130800 - RNA, 1698 nt, Artificial Sequence; identical to SEQ ID NO: 130794
  derived and/or modified sequence opt3 from hemagglutinin__InfluenzaA__AFJ74743

SEQ ID NO: 130801 - RNA, 1701 nt, Artificial Sequence; identical to SEQ ID NO: 130793
  derived and/or modified sequence opt3 from hemagglutinin__InfluenzaA__AFJ74744

SEQ ID NO: 130802 - RNA, 1698 nt, Artificial Sequence; identical to SEQ ID NO: 130794
  derived and/or modified sequence opt3 from hemagglutinin__InfluenzaA__AFJ74760

SEQ ID NO: 130803 - RNA, 1701 nt, Artificial Sequence
  derived and/or modified sequence opt3 from hemagglutinin__InfluenzaA__AFJ74761
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucaguuaaaauauaaguacccagcacugaacgugaccaugcccaauaacgagaaauuugacaaacuuuauaucuggggcguccaucacccuggcacagauagcgaccagauuucuuuguacgcccaggcuuccgggcguaucacugugucaaccaagagaagccagcagacaguaauuccaaacaucggaaguaggccccggguucgcgauauaucuuccagaauuagcaucuacuggaccauugugaagccuggugacauccugcuaaucaauucgacgggcaaccucauugccccaaggggguauuucaagauacggucuggaaaauccucaaucaugcgcagugacgcgccgauuggcaaguguaauagcgagugcaucacucccaacgguuccauaccuaaugauaaaccauuucagaacgucaaucgaauuacauacggggcaugucccagauaugugaagcaaaacacccugaaacuugccacuggaaugaggaaugugccugaaaagcagacacggggcaucuucggcgcuaucgccggguuuauugagaacggaugggaagguauggucgacggcugguacggguuccgucaucaaaauucugagggaaccggccaagcagcugaucugaaaagcacgcaggccgcgaucaaccagauuaaugguaaguugaaccgccucauagggaagaccaaugagaaauuucaccagaucgaaaaggaguucucagaaguugagggcaggauucaagaccuggaaaaauauguggaggauacaaagaucgacuuauggaguuacaacgccgagcugcucguagcacuugaaaaccagcacacuaucgaucugaccgacuccgagaugaauaaauuguucgaaagaacaaagaagcagcuacgggagaacgcugaagauaugggaaauggcugcuuuaaaauuuaucauaagugugacaacgccugcauagggagcauccgaaauggaacuuacgaucacgacguguaccgcgacgaggcucugaacaauagauuccagauuaaaggugucgagcucaagucuggcuauaaagauuggauccuguggauuucauuugccaucaguugcuuccuucuguguguggcauugcucggguuuauaaugugggccugccaaaagggaaacaucagguguaauauuugcaucuga

SEQ ID NO: 130804 - RNA, 1698 nt, Artificial Sequence; identical to SEQ ID NO: 130794
  derived and/or modified sequence opt3 from hemagglutinin__InfluenzaA__AFJ74779

SEQ ID NO: 130805 - RNA, 1701 nt, Artificial Sequence; identical to SEQ ID NO: 130793
  derived and/or modified sequence opt3 from hemagglutinin__InfluenzaA__AFJ74780

SEQ ID NO: 130806 - RNA, 1701 nt, Artificial Sequence
  derived and/or modified sequence opt3 from hemagglutinin__InfluenzaA__AFJ74804
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacagaaaaugggaucuguucguggaaagguccaaggccuauucuaauuguuaccccuaugacgucccugauuacgcaucguugcggucacucguggccagcagugguacucuggaguuuaacaaugaauccuucgacuggacagggguuacccagaacggaacgucuagcgcuugcaaacgccgauccaauaagucauuuuucagucgucugaacuggcucacucauuuaaaguauaaauacccagcacugaaugugaccaugcccaacaaugagaaguuugauaaacuuuauaucuggggcguccaccauccuggcacagacagcgaucagauuucuuuguacgcccaggcuuccgggagaaucacugugucaaccaagaggagccaacagacaguaauuccaaacaucggaagucggccccgcguuagagacgugucuuccaggauaagcauuuacuggaccaucgucaaaccuggugacauucugcuaaucaacucgacgggcaaucucaucgccccacggggguauuucaagauucgcucuggaaaguccucaauaaugcgaagugaugcgccgaucggcaaauguaacagcgagugcauuacucccaaugguuccaucccuaacgacaagccauuucagaaugugaacagaauaacauacggggcaugucccagguaugugaaacagaauacccugaagcuggccacuggaaugcggaacgucccugaaaaacaaacacguggcauuuucggcgcuaucgccggguuuaucgagaauggaugggaagguaugguugauggcugguacggguuccgccaccagaacucugagggaaccggccaggcagcugaccuuaagagcacgcaagccgcgauuaaucagaucaacgguaaauugaauagacucauugggaagaccaacgagaaguuucaccagauagaaaaagaguucucagaaguggagggcaggauccaggaucuggaaaaguauguagaggacacaaaaauugauuuauggaguuacaaugccgagcugcucguggcacuugaaaaccaacauacuaucgaccugaccgauuccgagaugaacaaguuguucgaacggacuaaaaagcagcuacgagagaaugcugaagacaugggaaacggcugcuuuaagaucuaucacaaaugugauaaugccugcauugggagcauacgcaacggaacauacgaccaugacgucuacagagaugaggcucugaauaacagguuccagaucaaggguguggagcucaaaucuggcuauaaggacuggauucuguggaucucauuugccauuaguugcuuccuucuguguguugcauugcucggguuuaucaugugggccugccagaaaggaaauauacgguguaacaucugcauuuga

SEQ ID NO: 130807 - RNA, 1701 nt, Artificial Sequence
  derived and/or modified sequence opt3 from hemagglutinin__InfluenzaA__AFJ74819
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccuggcacagacagcgaucagauuaacuuguacgcccaggcuucugggcguaucacuguguccaccaagagaucacaacagacaguaauuccaaacaucggaagcaggccccggguucgcgacgugaguucuagaauauccauuuacuggaccaucgucaagccuggugacauucugcuaaucaauagcacgggcaaccucaucgccccaaggggguauuucaagauucggucgggaaaaucuuccauaaugcgcucagaugcgccgaucggcaaguguaauagugagugcauuacucccaacgguagcaucccuaaugacaaaccauuucagaacgugaaucgaauaacauacggggcaugucccagauaugugaagcagaacacccugaaacuugccacuggaaugaggaaugucccugaaaagcaaacacggggcauuuucggcgcuaucgccggguuuaucgagaacggaugggaagguaugguugauggcugguacggguuccgucaccaaaauuccgagggaaccggccaggcagcugaccugaaaucuacgcaggccgcgauuaaccagaucaaugguaaguugaaccgccucauugggaagaccaaugagaaauuucaccagauagaaaaggaguucagcgaaguggagggcagaauccaggaucuggaaaaauauguagaggacacaaagauugauuuauggucauacaacgccgagcugcucguggcacuugaaaaccaacauacuaucgaccugaccgauagugagaugaauaaauuguucgaaaggacaaagaagcagcuacgggagaacgcugaagacaugggaaauggcugcuuuaaaaucuaucacaagugugauaacgccugcauuggguccauacgaaauggaacuuacgaccaugacgucuaccgcgaugaggcucugaacaauagauuccagaucaaagguguggagcucaagagcggcuauaaagacuggauucuguggaucucuuuugccauuucaugcuuccuucuguguguugcauugcucggguuuaucaugugggccugccagaagggaaacauaagguguaauaucugcauuuga

SEQ ID NO: 130808 - RNA, 1701 nt, Artificial Sequence; identical to SEQ ID NO: 124661
  derived and/or modified sequence opt3 from hemagglutinin__InfluenzaA__AFJ74842

SEQ ID NO: 130809 - RNA, 1698 nt, Artificial Sequence
  derived and/or modified sequence opt3 from hemagglutinin__InfluenzaA__AFJ75036
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaauaguuggccaaaccacacugucacagguguguccgccucuugcagccauaaugggaaguccucauuuuauaaaaacuuacuguggcuuaccggaaagaauggcuuguaccccaaccugaguaaaagcuaugcaaauaacaaggaaaaagagguucuaguacucuggggcgugcaccacccuccaaacaucggggaucagcgcgcccuguaccauacggaaaaugcuuacgucucugugguguccucacacuauagccgaaaguucacucccgagauagcaaagcguccuaaagucagagaccaggaaggaaggaucaacuacuauuggacccuucuggagccaggugauacaauuaucuuugaggccaauggcaacuugauugcuccgcgguacgccuucgcgcucagucgcggguuuggaucuggcaucauaaauuccaacgcacccauggacgaaugugaugccaagugccagacuccucaaggugcuauuaauagcucgcugccauuccagaacguucaucccgugaccaucggggaguguccuaaauauguaagaucugccaaguuaaggauggugacaggacugcggaauauuccauccauccagucacgcggccucuuuggcgcaaucgcuggguucauugaaggagguuggaccggcauggucgacgggugguacggauaucaccaccagaacgagcaaggcagugguuacgccgcggaucagaaaagcacgcagaaugccauaaacgggaucacuaauaaggugaacuccguuauugaaaagaugaauacacaguuuaccgcagugggcaaggaguucaacaaacuugagcgaagaauggaaaaccugaauaaaaaggucgacgauggauucaucgacauauggacuuacaacgcugaguugcuagugcugcucgaaaaugagaggacacuggacuuucaugauucuaacguuaaaaaucuuuaugaaaagguaaaaagccaacugaagaacaaugccaaggagauuggcaacgggugcuucgaguuuuaccacaaauguaaugacgaaugcauggagucagugaagaacggaaccuaugauuaccccaaauauagugaagaguccaaguugaaucgggagaaaaucgacggugucaagcucgaaagcaugggcguguaccagauccuggcuauuuauucuacggucgccucaaguuuagugcugcuaguuagccucggggcaaucuccuucuggaugugcucuaacggaucgcugcagugucguauuugcauauga

SEQ ID NO: 130810 - RNA, 1701 nt, Artificial Sequence; identical to SEQ ID NO: 122646
  derived and/or modified sequence opt3 from hemagglutinin__InfluenzaA__AFJ75047

SEQ ID NO: 130811 - RNA, 1698 nt, Artificial Sequence
  derived and/or modified sequence opt3 from hemagglutinin__InfluenzaA__AFJ75058
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacugucacaggugugucugccagcugcucccauaacgggaagucaaguuuuuauaaaaauuuacuguggcuuaccggaaagaacggcuuguaccccaaucugagcaaaucuuaugcaaacaauaaggaaaaagaggugcuaguucucuggggcgugcaccacccuccaaacaucggggaucagcgcgcccuguaccauacggaaaacgcuuacgucuccguggugucaagccacuauagucgaaaguucacucccgagauagcaaagcguccuaaagucagagaccaggaaggaaggaucaauuacuauuggacccuucuggagccaggugauacaauuaucuuugaggccaacggcaauuugauugcuccgcgguacgccuucgcgcucucucgcggguuuggauccggcaucauaaacagcaaugcacccauggacgaaugugaugccaagugccagacuccucaaggugcuauuaacucgucucugccauuccagaauguucaucccgugaccaucggggaguguccuaaauauguaagauccgccaaguuaaggauggugacaggacugcggaacauuccaucaauccagagucgcggccucuuuggcgcaaucgcuggguucauugaaggagguuggaccggcauggucgacgggugguacggauaucaccaccagaaugagcaaggcagcgguuacgccgcggaucagaaauccacgcagaacgccauaaaugggaucacuaacaagguaaauucuguuauugaaaagaugaacacacaguuuaccgcagugggcaaggaguucaauaaacuugagcgaagaauggaaaaccugaacaaaaaggucgacgauggauucaucgacauauggacuuacaaugcugaguugcuagugcugcucgaaaacgagaggacacuggacuuucaugauagcaauguuaaaaaccuuuaugaaaagguaaaaucacaacugaagaauaacgccaaggagauuggcaaugggugcuucgaguuuuaccacaaauguaacgacgaaugcauggagagugugaagaauggaaccuaugauuaccccaaauauuccgaagagagcaaguugaaccgggagaaaaucgacggugucaagcucgaaucuaugggcguguaccagauccuggcuauuuauucaacggucgccaguagcuuagugcugcuaguuucccucggggcaaucucuuucuggaugugcucgaauggaagccugcagugucguauuugcauauga

SEQ ID NO: 130812 - RNA, 1698 nt, Artificial Sequence
  derived and/or modified sequence opt3 from hemagglutinin__InfluenzaA__AFJ75069
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaucuaauccagagaacggaaccuguuauccgggccauuuugcugacuacgaggaacugagggagcaacucucgucagugagcaguuucgaacgguuugagauuuuccccaaggaguccucuuggccuaaucacacuacaaccggugucagcgccuccugcucacauaacggggaaaguagcuuuuauaagaauuuacuguggcuuacgggaaagaacggcuuguacccaaaucugucuaaguccuaugcaaacaauaaagagaaggaagugcuaguacucuggggcguucaccaucccccuaacaucggggaucagcgcgcccuguaccacacugagaacgcuuacgugucagucgugagcagucacuauucucgaaaauucaccccagaaauagcaaagcgucccaaggugagagaccaggagggaaggaucaauuacuauuggacacuucuggagccuggugauacuauuaucuuugaagccaacggcaauuugauugcuccacgguacgccuucgcgcucucccgcggguuuggaagcggcaucauaaacucgaaugcaccgauggacgagugugaugccaaaugccagacaccccaaggugcuauuaacucuucccugccuuuccagaauguccauccaguuaccaucggggaaugucccaaguaugugagaucagccaaauuaaggaugguaaccggacugcggaacauuccuaguauccagagccgcggccucuuuggcgcaaucgcuggguucauugagggagguuggacgggcaugguggacgggugguacggauaucaccaccagaaugaacaaggcuccgguuacgccgcggaucagaagucuacucagaacgccauaaaugggaucacaaacaaagucaauagcgugauugagaagaugaacacccaguuuacugcaguuggcaaagaguucaauaaacuugaacgaagaauggagaaccugaacaagaaaguggacgauggauucaucgacauauggacauacaaugcugaauugcuaguccugcucgagaacgaaaggacccuggacuuucaugauucaaaugugaagaaccuuuaugagaaaguaaagagucaacugaaaaauaacgccaaggagauuggcaaugggugcuucgaauuuuaccacaaguguaacgacgagugcauggaauccguuaaaaauggaacguaugauuacccaaaguauagcgaggagucuaaauugaaccgggaaaagaucgacggugugaaacucgagucaaugggcgucuaccagauccuggcuauuuauaguaccguggccagcuccuuaguccugcuagugucucucggggcaaucucguucuggaugugcagcaauggaucccugcagugucguauuugcauauga

SEQ ID NO: 130813 - RNA, 1701 nt, Artificial Sequence
  derived and/or modified sequence opt3 from hemagglutinin__InfluenzaA__AFJ75091
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagauuucccaacagacaguaaucccaaacauaggaucaagacccaggguucggaauauuccuagccgcaucaguauuuacuggaccaucgugaaaccaggugauauccugcuaauuaacucuacgggcaaucucauagccccgagaggguacuucaagaucagguccggaaagagcucgauuaugcggucugacgcgcccaucggcaaauguaacuccgagugcauaacuccuaaugguucaauuccaaacgacaagcccuuucagaaugucaaccgcaucacauauggggcauguccucgauacgugaaacagaauacccugaagcuggccacuggaaugagaaacgugccagaaaaacaaacaaggggcaucuucggcgcuauugccggguuuaucgagaauggaugggaagguauggucgauggcugguauggguuccggcaccagaacagugagggaauuggccaggcagcugaccuuaagagcacccaagccgcgauagaucagaucaaugguaaauugaaccgucucauugggaagacgaacgagaaguuccaccagaucgaaaaagaguuuuccgaaguugagggccgcauccaggaccuggaaaaguacguggaggauaccaaaauugacuuauggucuuauaaugccgaucugcucguagcacuugagaaccaacauacaauagaccugacugauagcgaaaugaauaaguuguucgagaaaaccaagaagcagcuaagagaaaacgcugaggacaugggaaauggcugcuuuaaaaucuaccacaagugugauaacgccugcauugggucaaucaggaauggaacauaugaccaugacguguaccgggaugaagcucugaacaaucgauuccagauuaaaggugucgagcucaagaguggcuacaaagacuggauccuguggauauccuuugccaucagcugcuuccuucuguguguggcauugcucggguuuauuaugugggccugccagaagggaaacauccgcuguaauauuugcaucuga

SEQ ID NO: 130814 - RNA, 1701 nt, Artificial Sequence
  derived and/or modified sequence opt3 from hemagglutinin__InfluenzaA__AFJ75449
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaagcuguacauuuggggaguccaccauccuggcacagauaaugaccagaucuuuuuguaugcccaggcuagcggcaaaauuacugugucuaccaagcguucccaacagacaguaaucccaaacauagggucaagacccaggguucggaauauuccuagccgcaucaguauuuacuggaccaucgugaaaccaggagauauccugcuaauuaacucuacggguaaucucauagccccgagaggcuacuucaagaucagguccggaaagagcucgauuaugcggucugacgcgcccaucgggaaauguaacuccgaaugcauaacuccuaauggcucaauuccaaacgacaagcccuuucagaaugucaaccgcaucacauauggugcauguccucgauacgugaaacagaauacccugaaacuugccacugggaugagaaacgugccagagaagcaaacaaggggaaucuucggcgcuauugccggcuuuaucgaaaaugggugggagggaauggucgaugguugguauggcuuccggcaccagaacagugaggggaccggacaggcagcugaccuuaagagcacgcaagccgcgauugaucagauaaauggcaaauugaaccgucucaucgguaagaccaacgaaaaguuccaccagauugagaaagaauuuuccgagguugaagggcgcauccaggaccuggagaaguacguggaggauacaaaaaucgacuuauggucuuauaaugccgaacugcucguagcacuugagaaccaacauacuauugaucugaccgacagcgaaaugaauaaguuguucgagaaaacaaagaagcagcuaagagaaaacgcugaggauaugggcaauggaugcuuuaaaauauaccacaagugugacaacgccugcaucggcucaauuaggaaugggacuuaugaucaugacguguaccgggacgaggcucugaacaaucgauuccagaucaaaggagucgaacucaagagugguuacaaagauuggauucuguggaucuccuuugccauaagcugcuuccuucuguguguggcauugcucggcuuuaucaugugggccugccagaaggggaacauucgcuguaauaucugcauuuga

SEQ ID NO: 130815 - RNA, 1701 nt, Artificial Sequence
  derived and/or modified sequence opt3 from hemagglutinin__InfluenzaA__AFJ75460
augaagaccaucauugcccugagcuacauacucugccuuguguucacacagaaacugcccggcaacgacaauuccacugcuacguuguguuuagggcaccaugcagucccuaacggaaccaucguuaagacaauuacuaaugaucaaaucgaggugaccaacgccacagaacugguacagucuucaaguaccggugagauuugcgacagcccacaccagauccuagauggcgaaaauuguacucucauagacgcgcugcuuggggauccgcagugcgacggauuucaaaacaaaaagugggaucuguucguggagagauccaaggcuuauucuaauuguuaccccuaugacgucccugauuacgccucguugaggucacucguggcaagcaguggcacacuggaauuuaacaaugaguccuucaacuggaccgguguuacgcagaaugggacuucuagcgccugcauccggcgcuccaacaauucauuuuucagucgacugaacuggcucacccauuuaaaauuuaaguauccagcucugaaugugacaaugcccaacaacgagaauuucgacaaacuuuacauuuggggaguccaccauccuggcacugauaacgaccagaucuuuuuguaugcacaggccagcggccguauuaccgugucuacaaagagaucccaacagaccguaaucccaaauauagggucaaggccccggguucgcaacauuccuagcagaaucaguauuuacuggacgaucgugaaaccaggagauauccugcuaauuaauucuacugguaaccucauagcuccgaggggcuacuucaagauccgguccgggaaaagcucgauuaugcgcucugacgcccccaucggaaaguguaauuccgaaugcauaacaccuaacggcucaauuccaaaugacaagcccuuucagaacgucaaucgaaucaccuauggugcguguccuagauacgugaaacagaacacucugaagcuggcaacagggaugaggaaugugccagagaaacaaacccggggaaucuucggcgccauugcuggcuuuaucgaaaacgggugggagggaauggucgaugguugguauggcuuccgucaccagaauagugaggggauuggacaggccgcagaccuuaagagcacgcaagcugccguugaucagauaaacggcaaauugaaccgccucaucgguaagaccaaugaaaaauuccaccagauugagaaggaauuuuccgagguggaagggagaauccaggaccuggagaaguacguagaggauacaaaaaucgacuuauggucuuauaacgcggaacugcucguggcccuugagaaucaacauacuauugaucugaccgacagcgaaaugaacaaguuguucgagaaaacaaagaaacagcuaagggaaaaugcagaggauaugggcaacggaugcuuuaagauauaccacaagugugacaaugcuugcaucggcucaauucggaacgggacuuaugaucaugacgucuaccgagacgaggcccugaauaaccgcuuccagaucaaaggaguggaacucaagagugguuacaaagauuggauucuguggaucuccuuugcuauaagcugcuuccuucuguguguugccuugcucggcuuuaucaugugggcaugccagaaggggaauauuagauguaacaucugcauuuga

SEQ ID NO: 130816 - RNA, 1698 nt, Artificial Sequence
  derived and/or modified sequence opt3 from hemagglutinin__InfluenzaA__AFJ75517
augaaggugaaacugcucguccuucugugcaccuucacagccacuuacgcugacacgaucuguauuggcuaucacgcaaacaauagcaccgauacaguugacacuguguuggagaagaacguaaccgugacauacuccgucaauuuacuggaagauaaccauaaugggaaacuaugccuccugaagggaauagcgccccuucagcuggguaacuguucuguggccggcuggaucuuggggaauccugagugcgaacuccugauuucaaaagagaguuggagcuauaucguugaaagaccaaacccggagaauggaaccuguuaccccggccacuuugcugacuaugaggaacugagggagcaacucuccucugugucgucauucgaacgguuugagauuuucccuaaggagagcaguuggccaaaccauacugucacagguguguccgccucuugcagccacaauggggaauccucauuuuacaagaacuuacuguggcuuaccggcaaaaauggauuguaucccaaccugaguaagagcuacgcaaauaacaaagagaaggaaguucuaguacucuggggcgugcaucacccuccaaacaucggggaucagaugacgcuguaccacaaaaagaaugccuaugucucugugguguccucacauuacagccgcaaguucacucccgagauagcuaaacgaccuaagguccgugaccaggaaggaagaaucaacuauuacuggacccuucuggagccaggugauacaauuaucuuugaggcaaauggcaacuugauugccccgagguaugcuuucgcccucaaucggggguuuggaaguggcaucauaaacucuaaugcgcccauggacgaaugugaugcaaaaugccagacuccucaaggugccauuaacuccagccugccauuccagaauguucaccccgugaccaucggggaguguccuaaguacguacgcucggcuaaauuaagaauggugacaggacugaggaacauuccaucuauccagucccggggccucuuuggcgccaucgcaggguucauugaaggagguuggaccggcauggucgacgggugguauggauaccaucaccagaaugagcaaggcucagguuacgcugccgaucagaagaguacgcagaacgcgauaaaugggaucacuaacaaagugaauagcguuauugaaaagaugaacacacaguuuaccgccgugggcaaggaguucaacaaacuugagcgccgaauggaaaaucugaacaagaaagucgacgauggauucaucgacguguggacuuauaaugcagaguugcuaguacugcucgaaaacgagagaacacuggacuuucacgauuccaauguuaagaaccuuuacgaaaaagugaagacccaacugaagaauaacgcuaaagagauaggcaaugggugcuucgaguuuuaucauaaguguaacgacgaaugcauggagucugucaaaaauggaacguacgauuaucccaaguacagcgaagagucaaaauugaguagggagaagauugacggugugaagcucgaauccaugggcgucuaucagauccuggccaucuacagcaccguggcuucuucauuaguucugcuagugagucucggggccauuagcuucuggaugugcuccaacggaucucugcagugucggaucugcauuuga

SEQ ID NO: 130817 - RNA, 1698 nt, Artificial Sequence
  derived and/or modified sequence opt3 from hemagglutinin__InfluenzaA__AFJ75560
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaagaccaaacccggagaauggaaccuguuaucccggccauuuugcugacuacgaggaacugagggagcaacucuccucugugucgucauucgaacgguuugagauuuucccuaaggagagcaguuggccaaaccacacugucacagguguguccgccucuugcagccauaauggggaauccucauuuuauaagaacuuacuguggcuuaccggaaagaauggcuuguaccccaaccugaguaagagcuaugcaaauaacaaagagaaggaaguucuaguacucuggggcgugcaccacccuccaaacaucggggaucagaugacgcuguaccauaaagagaaugccuacgucucugugguguccucacacuauagccgcaaguucacucccgaaauagcuaagcgaccuaaaguccgugaccaggagggaagaaucaacuacuauuggacccuucuggagccaggugauacaauuaucuuugaagcaaauggcaacuugauugccccgagguacgcuuucgcccucagucggggguuuggaucuggcaucauaaauuccaacgcgcccauggacgagugugaugcaaagugccagacuccucaaggugccauuaauagcucgcugccauuccagaacguucaucccgugaccaucggggaauguccuaaauuuguacgcucugcuaaguuaagaauggugacaggacugaggaauauuccauccauccagucacggggccucuucggcgccaucgcaggguuuauugagggagguuggaccggcauggucgacgggugguauggauaccaccaccagaacgaacaaggcagugguuaugcugccgaucagaaaagcacgcagaaugcgauaaacgggaucacuaauaaggugaacuccguuauugagaaaaugaauacacaguucaccgccgugggcaaggaguucaacaaacuugaacgccgaauggagaaccugaauaaaaaggucgacgauggauuuaucgacguguggacuuacaacgcagaauugcuaguacugcucgagaaugaaagaacacuggacuuccaugauucuaacguuaaaaaucuuuacgagaaggugaaaaaccaacugaggaauaacgcuaaggagauaggcaaugggugcuuugaguucuaucacaaguguaacgacgaaugcauggaaagcgucaaaaauggaaccuacgauuaucccaaguacucagaggagaguaaauugucccgggaaaagauugacggugugaaacucgagagcaugggcgucuaucagauccuggccaucuacucuacgguggcuucaaguuuaguucugcuagugagccucggggccauuuccuuuuggaugugcucuaacggaucgcugcagugucguaucugcauuuga

SEQ ID NO: 130818 - RNA, 1698 nt, Artificial Sequence
  derived and/or modified sequence opt3 from hemagglutinin__InfluenzaA__AFJ75571
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaagaccaaacccggagaauggaaccuguuaucccggccauuuugcugacuacgaggaacugagggagcaacucuccucugugucgucauucgaacgguuugagauuuucccuaaggagagcaguuggccaaaccacacugucacagguguguccgccucuugcagccauaauggggaaaacuccuuuuauaagaauuuacuguggcuuaccggaaagaacggcuuguaccccaaucugucaaagaguuaugcaaacaacaaagagaaggaaguucuaguacucuggggcgugcaccacccuccaaauaucggggaucagaugacgcuguaccauaaagagaacgccuacgucagcguggugucuucccacuauucacgcaaguucacucccgaaauagcuaagcgaccuaaaguccgugaccaggagggaagaaucaauuacuauuggacccuucuggagccaggugauacaauuaucuuugaagcaaacggcaauuugauugccccgagguacgcuuucgcccucagccggggguuuggaaguggcaucauaaacucuaaugcgcccauggacgagugugaugcaaagugccagacuccucaaggugccauuaacuccagccugccauuccagaauguucaucccgugaccaucggggaauguccuaaauauguacgcucggcuaaguuaagaauggugacaggacugaggaacauuccaucuauccagucccggggccucuuuggcgccaucgcaggguucauugagggagguuggaccggcauggucgacgggugguacggauaucaccaccagaaugaacaaggcucagguuacgcugccgaucagaaaaguacgcagaacgcgauaaaugggaucacuaacaaggugaauagcguuauugagaaaaugaacacacaguuuaccgccgugggcaaggaguucaacaaacuugaacgccgaauggagaaucugaacaaaaaggucgacgauggauucaucgacguguggacuuacaaugcagaauugcuaguacugcucgagaacgaaagaacacuggacuuucaugauuccaauguuaaaaaccuuuaugagaaggugaaaaaucaacugaagaacaaugcuaaggagauaggcaacgggugcuucgaauuuuaccacaaauguaaugacgagugcauggaaucugucaagaacggaaccuaugauuaccccaaauauagcgaggagucaaaguugaguagggaacggauugacggugugaaacucgaguccaugggcgucuaccagauccuggccaucuauagcacgguggcuucuucauuaguucugcuagugagucucggggccauuagcuucuggaugugcuccaauggaucucugcagugucguaucugcauuuga

SEQ ID NO: 130819 - RNA, 1701 nt, Artificial Sequence
  derived and/or modified sequence opt3 from hemagglutinin__InfluenzaA__AFJ75593
augaagaccaucauugcccugagcuacauacucugccuuguguucgcucagaaacugcccggcaacgacuccucuacagcaacuuuguguuuagggcaccaugccgucccuaauggaacgaucguuaagaccauuacaaacgaucaaaucgaggugacuaaugcgaccgaacugguacagucaaguagcacaggugagauuugcaacuccccacaccagauccuagacggcgaaaauuguacccucauagaugcucugcuuggggacccgcagugcgauggauuucaaaacaaaaagugggaccuguucguggagagaucuaaagccuauucgaauuguuaccccuaugaugucccugacuacgcaucauugaggagccucguggccaguuccggcacucuggaauuuaacaaugagucuuucaacuggacagguguuacccagaaugggacgagcuccgcuugcauccggcgcucaaacaauagcuuuuucagucgacugaacuggcucacucauuuaaaguuuaaguauccagcacugaaugugaccaugcccaacaacgagaaauucgauaaacuuuacauuuggggaguccaccauccuggcacagacaaugaucagaucuuuuuguaugcccaggcuucuggccguauuacuguguccaccaagagaucacaacagacaguaaucccaaacauagggagcaggccccggguucgcaauauuccuaguagaaucucuauuuacuggaccaucgugaagccaggagacauccugcuaauuaacuccacggguaaucucauagccccgaggggcuacuucaaaauccggagcgggaagucgucuauuaugcgcuccgaugcgcccaucggaaaguguaacucagaaugcauaacuccuaauggcaguauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgacgguugguauggcuuccgucaccagaacagcgaggggauuggacaggcagcugaucugaaauccacccaagccgcgauagaccagaucaauggcaaguugaaccgccucauugguaaaacgaacgaaaaguuccaccagaucgagaaggaauuuucugagguugaagggagaauccaggaucuggagaaauacguggaggacaccaagguagauuuauggagcuauaaugccgaacugcucguggcacuugagaaccaacauacaauugaccugacugauucagaaaugaauaaauuguucgagaagaccaaaaagcagcuaagggaaaacgcugaggacaugggcaauggaugcuuuaagauauaccacaaaugugauaacgccugcaucggcaguauucggaaugggacauaugaccaugaugucuaccgagacgaggcucugaacaaucgcuuccagaucaagggaguggaacucaaauccgguuacaaggacuggauucuguggaucagcuuugccauaucuugcuuccuucuguguguugcauugcucggcuuuaucaugugggccugccagaaagggaacauuagauguaauaucugcauuuga

SEQ ID NO: 130820 - RNA, 1698 nt, Artificial Sequence
  derived and/or modified sequence opt3 from hemagglutinin__InfluenzaA__AFJ75615
augaaggugaaacugcucguccuucugugcaccuucacagccacuuacgcugacacgaucuguguuggcuaucacgcaaacaauagcaccgauacaguggacacuguauuggagaagaacgugaccgucacacauuccgugaauuuacuggaaaacucucacaaugggaaacuaugccuccugaagggaauugcgccccuucagcuggguaacuguucaguugccggcuggauauuggggaauccugagugcgaacuccugaucaguaaagagagcugguccuacauuguggaaaagccaaacccggagaauggaaccuguuaucccggccauuuugcugauuacgaggaacugagagagcaacucucuucggucagcucauucgaaagguuugagaucuucccuaaggagaguuccuggccaaaccacacugugacagguguaucugccagcugcucccauaauggggaaucaaguuuuuaucggaacuuacuguggcuuaccggcaaaaauggauuguaccccaaccugagcaagucuuaugcaaauaacaaagagaaggaaguucuagugcucuggggcguccaccacccuccaaacauuggggaccagaaagcccuguaccauacggagaaugcuuacguguccguggucucaagccacuauagucgcaaguucacucccgaaaucgcaaagcgaccuaaaguucgugaucaggagggaagaauaaacuacuauuggacccuucuggagccaggugacacaaucauuuuugaagccaauggcaacuugaucgcuccgagguacgccuucgcgcucucucggggguuuggauccggcauuaucaauagcaacgcacccauggauaagugugacgccaaaugccagacuccucaaggugcuauaaauucgucucugccauuccagaacgugcaucccguaaccauuggggaguguccuaaguaugugcgcuccgccaaauuaagaauggucacaggacugaggaauaucccaucaauucagagucggggccucuuuggcgcaaucgcuggguucaucgaaggagguuggaccggcaugguggaugggugguacggauaucaccaccagaacgagcaaggcagcgguuacgccgcggaccagaaguccacgcagaaugccauuaacgggauaacuaauaaaguuaacucugugaucgaaaagaugaauacacaguuuaccgaggucggcaaggaguucaacaaacuugaacgccgaauggagaaccugaauaagaaaguggaugacggauucauugauaucuggacuuacaacgcagaauugcuaguacugcucgagaaugaaagaacacuggacuuucaugacagcaacguuaagaaucuuuaugagaaagugaagucacaacugaagaacaaugcuaaagagauaggcaacgggugcuucgaauuuuaccacaaguguaaugaugagugcauggaaagugucaaaaacggaaccuaugacuaccccaaguauuccgaggagagcaaauugaauagggaaaagauugauggugugaagcucgagucuaugggcgucuaccagauccuggccaucuauucaacgguggcuaguagcuuaguucugcuagugucccucggggccauuucuuucuggaugugcucgaacggaagccugcagugucggaucugcauuuga

SEQ ID NO: 130821 - RNA, 1701 nt, Artificial Sequence; identical to SEQ ID NO: 127368
  derived and/or modified sequence opt3 from hemagglutinin__InfluenzaA__AFJ75630

SEQ ID NO: 130822 - RNA, 1701 nt, Artificial Sequence; identical to SEQ ID NO: 127368
  derived and/or modified sequence opt3 from hemagglutinin__InfluenzaA__AFJ75641

SEQ ID NO: 130823 - RNA, 1698 nt, Artificial Sequence
  derived and/or modified sequence opt3 from hemagglutinin__InfluenzaA__AFJ75651
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucggggaccagaaagcccuguaccgcacggagaaugcuuacgucuccguggugucaagccauuauagucgaaaguucacucccgaaauagcaaagcguccuaaagucagagaucaggagggaaggaucaacuacuauuggacccuucuggagccaggugacacaauuaucuuugaagccaauggcaacuugauugcuccgcgguacgccuucgcgcucucucgcggguuuggauccggcaucauaaauagcgaugcacccauggacaagugugaugccaaaugccagacuccucaaggugcuauuaacucgucucugccauuccagaauguucaccccgugaccaucggggaguguccuaaguauguaagauccgccaaauuaaggauggugacaggacugcggaacauuccaucaauccagagucgcggccucuuuggcgcaaucgcuggguucauugaaggagguuggaccggcauggucgacgggugguacggauaucaucaccagaaugagcaaggcagcgguuacgccgcggaucagaaguccacgcagaacgccauaaaugggaucacuaacaaaguaaauucuguuauugaaaagaugaacacacaguuuaccgcagugggcaaggaguucaauaaacuugagcgaagaauggaaaaccugaacaagaaagucgacgauggauucaucgacauauggacuuacaaugcugaguugcuagugcugcucgaaaacgagaggacacuggacuuucacgauagcaauguaaagaaccuuuaugaaaaaguuaagucacaacugaagaauaacgccaaagagauuggcaaugggugcuucgaguuuuaccauaaguguaacgacgaaugcauggagagugugaaaaauggaaccuaugauuaccccaaguauuccgaagagagcaaauugaaccgggagaagaucgacggugucaagcucgaaucuaugggcguguaccagauccuggcuauuuauucaacggucgccaguagcuuagugcugcuaguuucccucggggcaaucucuuucuggaugugcucgaauggaagccugcagugucguauuugcauauga

SEQ ID NO: 130824 - RNA, 1701 nt, Artificial Sequence
  derived and/or modified sequence opt3 from hemagglutinin__InfluenzaA__AFJ75662
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacagaauacccugaagcuggccacugggaugaggaacgugccagaaaaacaaacacggggaaucuucggcgcuauugccggcuuuaucgagaaugggugggagggaauggucgaugguugguauggcuuccgucaccagaacagugaagggaccggacaggcagcugaccuuaagagcacgcaagccgcgauugaucagauaaauggcaaauugaaccgccucaucgguaagaccaacgagaaauuccaccagauugaaaaggaguuuuccgaaguugaggggagaauccaggaccuggagaaguacguggaagauacaaaaaucgacuuauggucuuauaaugccgagcugcucguagcacuugaaaaccaacauacuauugaucugaccgacagcgagaugaauaaguuguucgagaaaacaaagaaacagcuaagggaaaacgcugaggauaugggcaauggaugcuuuaagauauaccacaagugugacaacgccugcaucggcucaauucggaaugggacuuaugaucaugacguguaccgagacgaagcucugaacaaucgcuuccagaucaaaggagucgagcucaagagugguuacaaagauuggauucuguggaucuccuuugccauaagcugcuuccuucuguguguggcauugcucggcuuuaucaugugggccugccagaaggggaacauuagauguaauaucugcauuuga

SEQ ID NO: 130825 - RNA, 1698 nt, Artificial Sequence
  derived and/or modified sequence opt3 from hemagglutinin__InfluenzaA__AFJ75673
augaaggugaaacugcucguccuucugugcaccuucacagccacuuacgcugacacgaucuguauuggcuaucacgcaaacaauagcaccgauacaguugacacuguguuggagaagaacguaaccgugacauacuccgucaauuuacuggaagauaaccauaaugggaaacuaugccuccugaagggaauagcgccccuucagcuggguaacuguucuguggccggcuggaucuuggggaauccugagugcgaacuccugauuucaaaagagaguuggagcuauaucguugaaagaccaaacccggagaauggaaccuguuaccccggccacuuugcugacuaugaggaacugagggagcaacucuccucugugucgucauucgaacgguuugagauuuucccuaaggagagcaguuggccaaaccauacugucacagguguguccgccucuugcagccacaauggggaauccucauuuuacaagaacuuacuguggcuuaccggaaagaauggcuuguaucccaaccugaguaagagcuacgcaaauaacaaagagaaggaaguucuaguacucuggggcgugcaucacccuccaaacaucgggaaucagaugacgcuguaccacaaagagaacgccuaugucucugugguguccucacauuacagccgcaaguucacucccgaaauagcuaagcgaccuaaaguccgugaucaggagggaagaaucaauuauuacuggacccuucuggagccaggugacacaauuaucuuugaagcaaacggcaauuugauugccccgagguaugcuuucgcccucaaccggggguuuggaaguggcaucauaaauucuaacgcgcccauggaugagugugacgcaaagugccagacuccucaaggugccauuaauuccagccugccauuccagaacguucaccccgugaccaucggggaauguccuaaauacguacgcucggcuaaguuaagaauggugacaggacugaggaauauuccaucuauccagucccggggccucuuuggcgccaucgcaggguucauugagggagguuggaccggcauggucgaugggugguauggauaccaucaccagaacgaacaaggcucagguuacgcugccgaccagaaaaguacgcagaaugcgauaaacgggaucacuaauaaggugaacagcguuauugagaaaaugaacacacaguuuaccgccgugggcaaggaguucaauaaacuugaacgccgaauggagaaccugaauaaaaaggucgaugacggauucaucgauguguggacuuauaacgcagaauugcuaguacugcucgagaaugaaagaacacuggacuuucacgacuccaacguuaaaaaucuuuacgagaaggugaaaacccaacugaagaacaaugcuaaggagauaggcaacgggugcuucgaauuuuaucauaaauguaaugaugagugcauggaaucugucaagaacggaacguacgacuaucccaaauacagcgaggagucaaaguugaguagggagaaaauugauggugugaagcucgaauccaugggcgucuaucagauccuggccaucuacagcaccguggcuucuucauuaguucugcuagugagucucggggccauuagcuucuggaugugcuccaauggaucucugcagugucggaucugcauuuga

SEQ ID NO: 130826 - RNA, 1701 nt, Artificial Sequence; identical to SEQ ID NO: 124685
  derived and/or modified sequence opt3 from hemagglutinin__InfluenzaA__AFJ76119

SEQ ID NO: 130827 - RNA, 1701 nt, Artificial Sequence; identical to SEQ ID NO: 125038
  derived and/or modified sequence opt3 from hemagglutinin__InfluenzaA__AFJ76131

SEQ ID NO: 130828 - RNA, 1701 nt, Artificial Sequence
  derived and/or modified sequence opt3 from hemagglutinin__InfluenzaA__AFJ76155
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugagcaggaaggaagaaugaauuacuauuggacccugguggagcccggugauaagaucacauucgaagccacuggcaaccuaguggucccuagguacgcuuuugccauggagcggaaagcagggagcggaauaauuaucucggacaccccaguucaugauugcaacacaaccugucaaacgccgaagggcgcuauuaauacuucucuccccuuccagaacauccacuccaucacaauugguaagugcccuaaauaugugaagucaaccaaacugcgccuugccacugggcugagaaauguaccaaguauacagagcaggggauuguuuggcgcgaucgccggcuucauugaagggggauggacagguaugguggacggcugguacggguaucaucaccagaacgagcaaggauccggcuacgcagcugaccucaagucuacccagaaugccaucgaugagauaacgaacaaagucaauagcgugauugaaaagaugaacacccaguuuacagcuguugguaaggaguucaaucaccuggaaaaacggaucgagaacuuaaauaagaaaguggacgauggguuccuggacaucuggacuuacaacgccgaacuccuuguccuguuggagaaugagcgcacccuagauuaucaugacucaaacgugaagaaucuguacgaaaaaguacgaagucagcucaagaacaacgcaaaggagauuggcaauggauguuuugaguucuaucacaaaugcgauaacacauguauggaguccguuaagaauggcacuuacgacuaucccaaauacagcgaagaggccaagcugaacagagaggaaaucgauggggugaaacuugagucuaccaggauuuaucaaauacuggcuaucuacucaacagucgcgaguagcuuggugcucgucgugucccugggagcaauuucuuuuuggaugugcucgaaugguagcuuacagugccggaucuguaucuga

SEQ ID NO: 130829 - RNA, 1698 nt, Artificial Sequence
  derived and/or modified sequence opt3 from hemagglutinin__InfluenzaA__AFJ76186
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaagugcuaguucucuggggcgugcaccacccuccaaacaucggggaccagaaagcccuguaccauacggagaaugcuuacgucuccguggugucaagccacuauagucgcaaguucacucccgaaauaaccaagcgaccuaaaguccgugaucaggagggaagaaucaacuacuauuggacacuucuggagccaggugacacuauuaucuuugaagcaaauggcaacuugauugccccgagguacgcuuucgcccucucucggggguuuggauccggcaucauaaauagcgaugcgcccauggacaagugugaugcaaaaugccagaccccucaaggugccauuaacucgucucugccauuccagaauguucaucccgugacaaucggggaguguccuaaguauguacgcuccgcuaaauuaagaauggugaccggacugaggaacauuccaucaauccagagucggggccucuuuggcgccaucgcaggguucauugaaggagguuggacgggcauggucgacgggugguacggauaucaccaccagaaugagcaaggcagcgguuacgcugccgaucagaaguccacucagaacgcgauaaaugggaucacaaacaaaguaaauucuguuauugaaaagaugaacacccaguuuacugccgugggcaaggaguucaauaaacuugagcgccgaauggaaaaccugaacaagaaagucgacgauggauucaucgacauauggacauacaaugcagaguugcuagugcugcucgaaaacgagagaacccuggacuuucaugauagcaauguaaagaaccuuuaugaaaaaguuaagucacaacugaagaauaacgcuaaagagauuggcaaugggugcuucgaguuuuaccacaaguguaacgacgaaugcauggagagugugaaaaauggaacguaugauuaccccaaguauuccgaagagagcaaauugaacagggagaagaucgacggugucaagcucgaaucuaugggcguguaccagauccuggccauuuauucaaccgucgcuaguagcuuagugcugcuaguuucccucggggccaucucuuucuggaugugcucgaauggaagccugcagugucggauuugcauauga

SEQ ID NO: 130830 - RNA, 1701 nt, Artificial Sequence; identical to SEQ ID NO: 124685
  derived and/or modified sequence opt3 from hemagglutinin__InfluenzaA__AFJ76203

SEQ ID NO: 130831 - RNA, 1701 nt, Artificial Sequence
  derived and/or modified sequence opt3 from hemagglutinin__InfluenzaA__AFJ76213
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauagcaaauauaaguacccagcauuaaaugugaccaugcccaacaaugagaaauuugauaagcuguauaucuggggcguccaccauccuggcacagacucugaucagauuucccuuuacgcccaggcuucagggcguaucacugugagcaccaaaagaagucaacagacaguaauuccaaacaucggaucuaggccccggguucgcgacguguccagcagaauaucgauuuacuggaccaucgucaagccuggugacauuuugcugaucaacucuacgggcaaucuaaucgccccaaggggguauuucaagauucgguccggaaaaucaaguauaaugcgcagcgaugcgccgaucggcaaguguaacuccgagugcauuacucccaaugguucuaucccuaacgacaaaccauuucagaaugugaaccgaauaacauacggggcaugucccagauaugugaagcagaauacccucaaacuggccacuggaaugaggaacgucccugaaaagcaaacacggggcauuuucggcgcuaucgccggguuuaucgagaauggaugggaagguaugguugauggcugguacggguuccgucaccagaacagcgagggaaccggccaggcagcugaccuuaaaucaacgcaagccgcgauuaaucagaucaacgguaagcugaaucgcuugauugggaagaccaacgagaaauuucaccagauagaaaaggaguucagugaaguggagggcagaauccaggaucucgaaaaauauguagaggacacaaagauugaucugugguccuacaaugccgaguuacugguggcacucgaaaaccaacauacuaucgaccuuaccgauagcgagaugaacaaacuguucgaaaggacaaagaagcaguugcgggagaaugcugaagacaugggaaacggcugcuuuaaaaucuaucacaagugugauaaugccugcauugggucuauacgaaacggaacuuacgaccaugacgucuaccgcgaugaggcucuaaauaacagauuccagaucaaagguguggagcugaagucaggcuauaaagacuggauucucuggaucaguuuugccauuagcugcuuccugcuuuguguugcacuguugggguuuaucaugugggccugccagaagggaaauauaagguguaacaucugcauuuga

SEQ ID NO: 130832 - RNA, 1701 nt, Artificial Sequence
  derived and/or modified sequence opt3 from hemagglutinin__InfluenzaA__AFJ77408
augaagaccaucauugcccugagcuacauacucugccuuaucuucgcucagaaacugcccggcaacgacaauuccacagcaacuuuguguuuagggcaccaugccgugccuaacggaacgcuggucaagaccauuacaaaugaucaaaucgagguuacuaacgcgaccgaacuugugcagucuucaaguacagguagaauuugcaauagcccacacaggauccucgacggcgagaacuguacccugauagaugcucuacugggggacccgcauugcgauggauuucagaauaaagaaugggacuuguucguagagcgguccaaggccuauucuaacuguuaccccuaugaugugccugacuacgcaucgcuccgcucacuggucgccagcaguggcacucuggaauuuacaaaagaggguuucaauuggaccgggguggcucaggauggaaaguccuauucuugcaagcgaggcagcguuaacuccuuuuucucacgucucaauugguuacacaaacuggaguacaaguauccagcacuuaacgugacgaugcccaauaacgacaaauuugauaaguuguacaucuggggcguccaucacccuaguacugacagcgaucaaaccucucuguacgugcaggccuccgggagaguaacaguuucaacuaaaaggagccagcagaccgugauuccaaauaucggaagucggcccuggguccgcgguauuucuuccagaaucagcauauauuggacaauugugaagccuggcgacauccuacucauuaacucgaccgggaaccugaucgcuccaaggggauacuucaagauccggaauggcaaaucuuccauuaugcgcucagacgccccgauagguaacuguaauagugaaugcaucacgcccaacgggagcauuccuaaugauaagccauuucaaaacgugaaucgaaucacuuauggagcgugucccagauacgucaaacagaacacacuuaagcuggcaaccggcaugaggaauguuccugagaaacagacucggggcauauucggggccauugcuggauuuaucgaaaacgguugggagggcaugguggacgggugguauggauuccgucaccagaauagcgagggcacaggucaagccgcagauuugaagucuacccaggcugccaucaaccagauuaaugggaaacucaaccgccugaucgaaaagacgaaugagaaguuucaucaaauugaaaaagaguucagcgaaguagagggcagaauacaggacuuagagaaguacguggaagauaccaaaaucgaccuguggucauauaacgcggagcuccuugucgcccuggaaaaccagcacacaauugauuugacugacagugagaugaauaagcuauucgaaaggacccggaaacagcugcgagagaacgcagaggauaugggaaauggcugcuuuaagaucuaccauaagugugacaacgcuugcaucggguccauucgcaauggaacauacgaucacgacguguauagagacgaagcccucaacaauagguuccaaauaaaagguguugagcugaaguccggcuacaaagauuggauccuuuggauuucuuuugcuaucucaugcuuccuguugugugugguccuccugggguuuauuaugugggccugccagaagggaaacauccgguguaauauaugcaucuga

SEQ ID NO: 130833 - RNA, 1701 nt, Artificial Sequence
  derived and/or modified sequence opt3 from hemagglutinin__InfluenzaA__AFJ77430
augaagaccaucauugcccugagcuacauacucugccuuaucuucgcucagaaacugcccggcaacgacaauuccacagcaacuuuguguuuagggcaccaugccgugccuaacggaacgcuggucaagaccauuacaaaugaucaaaucgagguuacuaacgcgaccgaacuugugcagucuucaaguacagguagaauuugcgacagcccacacaggauccucgauggcgagaauuguacccugauagacgcucuacugggggauccgaacugcgacggauuucagaauaaagaaugggauuuguucguagagcgguccaaggccuauucuaacuguuaccccuaugacgugccugauuacgcaucgcuccgcucacuggucgccagcaguggcacucuggaauuuacaaaagaggguuucaauuggaccgggguggcucaggacggaaaguccuauucuugcaagcgaggcagcguuaacuccuuuuucucacgucucaauugguuacauaaacuggaguacaaguauccagcacuuaacgugacgaugcccaauaacgauaaauuugacaaguuguacaucuggggcguccaccauccuaguacugauagcgaccaaauuucucuguacgcccaggcuuccgggagagugaccguaucaacaaaaaggagccagcagacuguuaucccaaauauuggaagucggcccugggugcgcgguaucucuuccagaauaagcauuuauuggaccaucgucaagccuggcgacauucuacucaucaacucgacagggaaccugaucgccccaaggggauacuucaagauucggaauggcaaaucuuccauaaugcgcucagaugcgccgaucgguaacuguaauagugaaugcauuacccccaacgggagcaucccuaaugacaagccauuucaaaacgugaaucgaauaacguauggagcaugucccagauacgugaaacagaacacucuuaagcuggccacaggcaugaggaaugucccugagaaacagacccggggcauuuucggggcuaucgccggauuuaucgaaaacgguugggagggcaugguugaugggugguauggauuccgucaccaaaauuccgagggcacuggucaggcagcugacuugaagucuacacaggccgcgauuaaccagaucaaugggaaacucaaccgccugauugaaaagaccaaugagaaguuucaccaaauagaaaaagaguucagcgaaguggagggcagaauccaggauuuagagaaguacguagaagacacgaaaauugaucuguggucauauaacgccgagcuccuuguggcacuggaaaaccagcauaccaucgacuugacagauagugagaugaauaagcuauucgaaaggacucggcgacagcugcgcgagaacgcugaggacaugggaaauggcugcuuuaaaaucuaccacaagugugauaacgccugcauuggguccauaagaaauggaaccuacgaccaugacgucuauagggaugaagcucucaacaaucgguuccaaaucaaggguguggagcugaaaagcggcuacaaggacuggauucuuuggaucucuuuugccauuucaugcuuccuguuguguguugugcuccugggguuuaucaugugggcaugccagaaaggaaacauacgcuguaauaucugcauuuga

SEQ ID NO: 130834 - RNA, 1701 nt, Artificial Sequence
  derived and/or modified sequence opt3 from hemagglutinin__InfluenzaA__AFJ77440
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcuuugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacauccgaagguuucaacuggaccgggguugcucaggacggaacgucuuaugcaugcaagcgaggcagcgugaaguccuuuuucucacgucucaauugguuacacaaacuggaguacaaguauccagcccuuaacgucacuaugcccaauaacgauaaauuugacaaguuguacauauggggcgugcaucacccuaguaccgauagcgaccaaacaucucuguacguacaggcuuccgggagaguuacugugucaaccaaaaggagccagcagacagucaucccaaauauuggaagucggcccugggugcgcggugugucuuccagaaucagcauuuauuggaccaucgucaagccuggcgacauacuacucauuaacucgacggggaaucugaucgccccaaggggauacuucaagauucggucuggcaaauccucaaucaugcgcagugaugcgccgaucgguaacuguaacagcgagugcauuacucccaauggguccauaccuaacgacaagccauuucaaaauguuaaccgaaucacauauggagcaugucccagauacgugaaacagaauacccuuaagcuggccacuggcaugaggaacguaccugaaaaacagacacggggcauuuucggggcuaucgccggauuuauagagaaugguugggaaggcaugguggaugggugguauggauuccgucaccagaacucugagggcaccggucaagcagcugaccuuaagagcacgcaggccgcgauuaaucagaucaacgggaaacucaaucgccugaucgagaagaccaacgaaaaguuucaucaaauugagaaagaguucucagaagucgaaggcagaauccaggauuuagagaaguacguggaggacacaaaaauugaucuguggaguuauaaugccgaacuccuuguugcacuggagaaccagcacacuauagacuugaccgauuccgaaaugaauaagcuauucgagaggacacggaaacagcugcgagaaaacgcugaggacaugggaaacggcugcuuuaagaucuaccauaagugugauaaugccugcauugggagcauccgcaacggaacuuacgaccacgacguguauagagaugaggcucucaauaacagguuccaaaucaaaggugucgaacugaagucuggcuacaaagacuggauucuuuggauaucauuugccaucaguugcuuccuguugugugugguacuccugggguuuauuaugugggcaugccagaagggaaauauccgguguaacauuugcaucuga

SEQ ID NO: 130835 - RNA, 1701 nt, Artificial Sequence
  derived and/or modified sequence opt3 from hemagglutinin__InfluenzaA__AFJ77451
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuaacaaugaauccuucaacuggacagguguugcucagaaugggaccucuuaugcaugcaagcgacguagcgugaaguccuuuuucucaagacucaacugguuacacaaacuggaguacaaguauccagcccuuaaugucacgaugcccaacaaugacaaauuugauaaguuguacauauggggagugcaucacccuaguacugacagcgaucaaaccucucuguacguacaggcuuccggcaggguuacagugucaacuaaacggagccagcagaccgucaucccaaacauuggcagucgccccugggugagaggggugucuuccaggaucagcauuuauuggacaaucgucaagccuggagacauacuacucauuaacucgaccgguaaucugaucgccccacggggcuacuucaagauucgcucugggaaauccucaaucaugcgaagugacgcgccgaucggaaacuguaauagcgagugcauuacgcccaacggcuccauaccuaaugauaagccauuucaaaacguuaauagaaucacuuauggugcaugucccagguacgugaaacagaacacacuuaagcuggccaccgggaugcggaauguaccugaaaaacagacucguggaauuuucggcgcuaucgccggcuuuauagagaacgggugggaaggaaugguggacgguugguauggcuuccgccaccagaauagcgaggggacaggacaagcagcugauuugaagucuacccaggccgcgauuaaccagaucaauggcaaacucaacagacugaucgagaagacgaaugguaaguuucaucaaauugaaaaagaguucucagaagucgaggggaggauccaggacuuagaaaaguacguggaggauaccaaaauugaccuguggaguuauaacgccgagcuccuuguugcacuggaaaaccagcacacaauagauuugacugacuccgagaugaauaagcuauucgaacggacccgaaaacagcugcgcgagaacgcugaagauaugggcaauggaugcuuuaagaucuaccauaagugugacaacgccugcauuggcagcaucagaaaugggacauacgaucacgacguguauagggacgaggcucucaacaaucgguuccaaaucaaaggagucgagcugaagucugguuacaaagauuggauucuuuggauaucauuugccaucaguugcuuccuguugugugugguacuccugggcuuuauuaugugggcaugccagaaggggaacauccgcuguaauauuugcaucuga

SEQ ID NO: 130836 - RNA, 1701 nt, Artificial Sequence
  derived and/or modified sequence opt3 from hemagglutinin__InfluenzaA__AFJ77462
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaaguacagguagaaucugcgacagcccacacaggauucucgauggcaaaaauuguacccugaucgacgcucugcugggggauccgcauugcgacggauuucagaacaaggaaugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaacguccuaugcaugcaagcgaggcucugugaaguccuuuuucucccgucucaacugguuacacaaacuggaguacaaguauccagcccuuaaugucacuaugcccaacaaugauaaauuugacaaguuguacauauggggcgugcaucacccuucaaccgauagugaccaaacaagccuguacguacaggcuucugggagaguuacuguguccaccaaaaggucacagcagacagucaucccaaacauuggaagccggcccugggugcgcggugugaguucuagaaucuccauuuauuggaccaucgucaagccuggcgacauacuacucauuaauagcacggggaaccugaucgccccaaggggauacuucaagauucggucgggcaaaucuuccaucaugcgcucagaugcgccgaucgguaacuguaauagugagugcauuacucccaacgggagcauaccuaaugacaagccauuucaaaacguuaaucgaaucacauauggagcaugucccagauacgugaaacagaacacccuuaagcuggccacuggcaugaggaauguaccugaaaaacagacacggggcauuuucggggcuaucgccggauuuauagagaacgguugggaaggcaugguggaugggugguauggauuccgucaccagaauagcgagggcaccggucaagcagcugacuugaagucuacgcaggccgcgauuaaccagaucaaugggaaacucaaccgccugaucgagaagaccaaugaaaaguuucaucaaauugagaaagaguucagcgaagucgaaggcagaauccaggauuuagagaaguacguggaggacacaaaaauugaucuguggucauauaacgccgaacuccuuguugcacuggagaaucagcacacuauagacuugaccgauagugaaaugaacaagcuauucgagaggacacggaaacagcugcgagaaaacgcugaggacaugggaaauggcugcuuuaagaucuaccauaagugugauaacgccugcauuggguccauccgcaauggaacuuacgaccacgacguguauagagaugaggcucucaacaauagguuccaaaucaaaggugucgaacuuaagagcggcuacaaagacuggauucuuuggauaucuuuugccaucucaugcuuccuguugugugugguacuccugggguuuauuaugugggcaugccagaagggaaacauccgguguaauauuugcaucuga

SEQ ID NO: 130837 - RNA, 1701 nt, Artificial Sequence
  derived and/or modified sequence opt3 from hemagglutinin__InfluenzaA__AFJ77473
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacaccagauucuagauggcgagaauuguacccucaucgacgcucugcuuggggauccgcauugcgacggauuucaaaacaaagaaugggaucuguucguggagagguccaaggccuauucuaauuguuaccccuaugacgucccugauuacgcaucguugcggucacucguggccagcaguggcacucuggaauuuaacaaugaguccuucaacuggacagguguugcucagaaugggaccucuagcgcaugcaaacgccgauccauaaagucauuuuucagucgucugaacuggcuccaccaguuaaaguauaaauacccagcccugaaugugacgaugcccaacaaugagaaguuugacaaacuuuauaucuggggaguccaucacccuagcacugauucugaccagauuuccuuguacgcucaagccucaggcagagugaccguaagcacaaagaggagucagcagacuguuaucccaaacauuggcucucggcccugggugcgcggggucuccagcagaaucucgauauacuggaccauugugaaaccuggagauauccugcuaauuaacucuacagguaaucucaucgcgccaaggggcuauuucaagauccgguccgggaagucaaguauuaugcgcagcgacgcaccgauaggaaaauguaacuccgaaugcaucacccccaauggcucuauuccuaacgacaagccauuucagaaugugaaccgaaucacguacggugccugucccagauaugucaaacaaaauacucugaaacuugcuacagggaugaggaacguuccugagaagcagacccggggaauauucggcgccauugcaggcuuuaucgaaaaugggugggagggaaugguggaugguugguacggcuuccgucaccagaacagcgaggggacuggacaagcugccgaccugaagucaacacaggcggccaucaaucagauuaacggcaaauugaaucgccucaucgaaaagaccaacgagaaguuucaucagauugaaaaagaguucagugaaguagaggguagaauacaagaucuggagaaguauguggaagacacgaaaaucgauuuaugguccuacaaugcagagcugcucgucgcucuugaaaaccagcacaccauugaccugacagauagcgagaugaacaaguuguucgaaaggacuaaaaagcagcuacgggagaaugccgaggacauggggaacggcugcuuuaagaucuaucauaaaugugauaaugcuugcaucggaucuauucgaaacggcaccuacgaccacgauguguaccgcgacgaagcccugaauaacagauuccagauaaaggggguugagcucaaaucaggauauaaggacuggauccuguggauuaguuuugcaaucagcugcuuccuucuguguguggucuugcucgguuuuauuaugugggccugccaaaaaggcaauaucagguguaacauaugcaucuga

SEQ ID NO: 130838 - RNA, 1701 nt, Artificial Sequence; identical to SEQ ID NO: 122202
  derived and/or modified sequence opt3 from hemagglutinin__InfluenzaA__AFJ77484

SEQ ID NO: 130839 - RNA, 1701 nt, Artificial Sequence; identical to SEQ ID NO: 122204
  derived and/or modified sequence opt3 from hemagglutinin__InfluenzaA__AFJ77495

SEQ ID NO: 130840 - RNA, 1701 nt, Artificial Sequence; identical to SEQ ID NO: 122202
  derived and/or modified sequence opt3 from hemagglutinin__InfluenzaA__AFJ77506

SEQ ID NO: 130841 - RNA, 1701 nt, Artificial Sequence
  derived and/or modified sequence opt3 from hemagglutinin__InfluenzaA__AFJ77517
augaagaccaucauugcccugagcuacauacucugccuuguguucgcucagaaaauccccggcaacgacaauuccacagcaacucuguguuuggggcaccaugccgucccuaacggaacguuaguuaagaccauuacaaaugaucaaaucgaggugacuaacgcgaccgaacugguacagucuucaaguacagguagaauuugcgacagcccacacaggauccuagauggcgagaauuguacccucauagacgcucugcuuggggauccgcauugcgacggauuucagaacaaagaaugggaucuguucguggagcgguccaaggccuauucuaauuguuaccccuaugacgucccugauuacgcaucguugcgcucacucguggccagcaguggcacucuggaauuuaacaaugaguccuucaacuggacagguguugcucagaaugggaccucuaacgcaugcaaacgacguagcaugaaguccuuuuucucaagacugaauuggcuccaccaauuaaaguauaaauacccagcccugaacgugacgaugcccaauaacgacaaguuugauaaacuuuauaucuggggaguccaucacccuaguacugacagcgaucagaccucuuuguacgcucaggccuccggcagggugacaguaucaacucagcggagccaacagaccguuauuccaaacaucggcagucgccccugggugagaggggucucuuccaggauuagcaucuacuggacaauagugaagccuggagacauucugcuaaucaauucgaccgguaaccucauugcgccacggggcuauuucaaaauccgcucugggaaguccucaaucauucgaagugacgcaccgauaggaaaguguaauagcgagugcaucacgcccaacggcuccauuccuaaugauaaaccauuucagaacgugaauagaaucacuuacggugccugucccagguaugucaagcagaacacacugaaacuugcuaccgggaugcggaauguuccugaaaagcaaacucguggaauauucggcgccauugcaggcuuuaucgagaacgggugggaaggaaugguggacgguugguacggcuuccgccaccaaaauucugaggggacaggacaggcugccgaucugaaaagcacccaggcggccaucaaccagauuaauggcaaguugaacagacucaucgagaaaacgaaugaaaaguuucaucagauugagaaggaguucucagaaguagaagguaggauacaggaccuggagaaauauguggaggauaccaagaucgacuuauggaguuacaacgcagaacugcucgucgcucuugagaaccaacacacaauugaucugacugacuccgaaaugaauaaauuguucgagcggacccgaaagcagcuacgcgaaaacgccgaggauauggggaauggcugcuuuaaaaucuaucauaagugugacaacgcuugcaucggaagcauuagaaauggcacauacgaucacgacguguacagggacgaggcccugaacaaucgguuccagauaaaggggguugaacucaaaucuggauauaaggauuggauccuguggauuucauuugcaaugaguugcuuccuucuguguguggucuugcucgguuuuaucaugugggccugccagaaaggcaacauucgcuguaauaucugcauauga

SEQ ID NO: 130842 - RNA, 1701 nt, Artificial Sequence; identical to SEQ ID NO: 122039
  derived and/or modified sequence opt3 from hemagglutinin__InfluenzaA__AFJ77528

SEQ ID NO: 130843 - RNA, 1698 nt, Artificial Sequence
  derived and/or modified sequence opt3 from hemagglutinin__InfluenzaA__AFJ77550
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacaccagauucuagauggcgagaauuguacccucaucgacgcucugcuuggggauccgcauugcgacggauuucaaaacaaagaaugggaucuguucguggagagguccaaggccuauucuaauuguuaccccuaugacgucccugauuacgcaucguugcggucacucguggccagcaguggcacucuggaauuuaacaaugaguccuucaacuggacagguguugcucagaaugggaccucuagcgcaugcaaacgccgauccauaaagucauuuuucagucgucugaacuggcuccaccaguuaaaguauaaauacccagcccugaaugugacgaugcccaacaaugagaaguuugacaaacuuuauaucuggggaguccaucacccuagcacugauucugaccagauuuccuuguacgcucaagccucaggcagagugaccguaagcacaaagaggagucagcagacuguuaucccaaacauuggcucucggcccugggugcgcggggucuccagcagaaucucgauauacuggaccauugugaaaccuggagauauccugcuaauuaacucuacagguaaucucaucgcgccaaggggcuauuucaagauccgguccgggaagucaaguauuaugcgcagcgacgcaccgauaggaaaauguaacuccgaaugcaucacccccaauggcucuauuccuaacgacaagccauuucagaaugugaaccgaaucacguacggugccugucccagauaugucaaacaaaauacucugaaacuugcuacagggaugaggaacguuccugagaagacccggggaauauucggcgccauugcaggcuuuaucgaaaaugggugggagggaaugguggaugguugguacggcuuccgucaccagaacagcgaggggacuggacaggcugccgaccugaagucaacacaagcggccaucaaucagauuaacggcaaauugaaucgccucaucgaaaagaccaacgagaaguuucaucagauugaaaaagaguucagugaaguagaggguagaauacaggaucuggagaaguauguggaagacacgaaaaucgauuuaugguccuacaaugcagagcugcucgucgcucuugaaaaccaacacaccauugaccugacagauagcgagaugaacaaguuguucgaaaggacuaaaaagcagcuacgggagaaugccgaggacauggggaacggcugcuuuaagaucuaucauaaaugugauaaugcuugcaucggaucuauucgaaacggcaccuacgaccacgauguguaccgcgacgaagcccugaauaacagauuccagauaaaggggguugagcucaaaucaggauauaaggacuggauccuguggauuaguuuugcaaucagcugcuuccuucuguguguggucuugcucgguuuuauuaugugggccugccagaaaggcaauaucagguguuccauaugcaucuga

SEQ ID NO: 130844 - RNA, 1701 nt, Artificial Sequence
  derived and/or modified sequence opt3 from hemagglutinin__InfluenzaA__AFJ77561
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuaacaaugaauccuucaacuggacagguguugcucagaaugggaccucuuaugcaugcaagcgacguagcgugaaguccuuuuucucaagacucaacugguuacacaaacuggaguacaaguauccagcccuuaaugucacgaugcccaacaaugacaaauuugauaaguuguacauauggggagugcaucacccuaguacugacagcgaucaaaccucucuguacgcucaggccuccggcaggguaacaguuucaacuaaacggagccagcagaccgugaucccaaacauuggcagucgccccugggucagaggggugucuuccaggaucagcauuuauuggacaaucgugaagccuggagacauacuacucauuuacucgaccgguaaccugaucgcgccacggggcuauuucaagauucgcucugggaaauccucaaucaugcgaagugacgcaccgaucggaaauuguagcuccgagugcauuacgcccaacggcucuauaccuaaugauaagccauuucaaaacgucaauagaaucacuuacggugccugucccagguauguuaaacagaacacacuuaagcuggcuaccgggaugcggaaugugccugaaaaacagacucguggaauuuucggcgccaucgcaggcuuuauagagaacgggugggaaggaaugguagacgguugguacggcuuccgccaccagaauagcgaggggacaggacaagcugccgauuugaagucaacccaggcggccauuaaccagaucaauggcaaacucaacagacugaucgagaagacgaaugaaaaguuucaucaaauugagaaagaguucagugaaguggaagguaggauccaggacuuagagaaguaugucgaggauaccaaaauugaccugugguccuacaacgcagaacuccuuguggcucuggagaaucagcacacaauagauuugacugacagcgaaaugaacaagcuauucgagcggacccgaaaacagcugcgcgaaaacgccgaggauauggggaauggcugcuuuaagaucuaccauaagugugacaacgcuugcauuggaucuaucagaaauggcacauaugaucacgacguuuacagggacgaggcccucaacaaucgguuccaaaucaaagggguggaacugaagucaggauauaaagauuggauucuuuggauaaguuuugcaaucagcugcuuccuguugugugucgugcuccuggguuuuauuaugugggccugccagaagggcaacauccgcuguaauauuugcaucuga

SEQ ID NO: 130845 - RNA, 1698 nt, Artificial Sequence
  derived and/or modified sequence opt3 from hemagglutinin__InfluenzaA__AFJ77572
augaagaccaucauugcccugagcuacauacucugccagguguucgcucaaaaacuucccggcaacgacaauuccacagcaacucuguguuuggggcaccaugccgucccuaacggaacguuaguuaagaccaucacaaaugaucagauugaggugacuaacgcgaccgaacugguacagucuucaaguacagguagaaucugcgacagcccacaccagauucuagauggcgagaauuguacccucaucgacgcucugcuuggggauccgcauugcgacggauuucaaaacaaagaaugggaucuguucguggagagguccaaggccuauucuaauuguuaccccuaugacgucccugauuacgcaucguugcggucacucguggccagcaguggcacucuggaauuuaacaaugaguccuucaacuggacagguguugcucagaaugggaccucuagcgcaugcaaacgccgauccauaaagucauuuuucagucgucugaacuggcuccaccaguuaaaguauaaauacccagcccugaaugugacgaugcccaacaaugagaaguuugacaaacuuuauaucuggggaguccaucacccuagcacugauucugaccagauuuccuuguacgcucaagccucaggcagagugaccguaagcacaaagaggagucagcagacuguuaucccaaacauuggcucugggcccugggugcggggagucuccagccgcaucucgauauacuggaccauugugaaaccuggugauauccugcuaauuaacucuacaggcaaucucaucgcgccaagaggguauuucaagaucagguccggaaagucaaguauuaugcggagcgacgcaccgauaggcaaauguaacuccgaaugcaucacccccaaugguucuauuccuaacgacaagccauuucagaaugugaaccgcaucacguacggggccuguccccgauaugucaaacaaaauacucugaaacuugcuacaggaaugagaaacguuccugagaagaccaggggcauauucggcgccauugcaggguuuaucgaaaauggaugggaggguaugguggauggcugguacggguuccggcaccagaacagcgagggaacuggccaggcugccgaccugaagucaacacaagcggccaucaaucagauuaacgguaaauugaaucgucucaucgaaaagaccaacgagaaguuucaucagauugaaaaagaguucagugaaguagaggggcgcauacaggaucuggagaaguauguggaagacacgaaaaucgauuuaugguccuacaaugcagagcugcucgucgcucuugaaaaccaacacaccauugaccugacagauagcgagaugaacaaguuguucgaaagaacuaaaaagcagcuaagggagaaugccgaggacaugggcaacggaugcuuuaagaucuaucauaaaugugauaaugcuugcaucggcucuauucggaacgggaccuacgaccacgauguguaccgagacgaagcccugaauaaccgcuuccagauaaagggaguugagcucaaaucagguuauaaggacuggauccuguggauuaguuuugcaaucagcugcuuccuucuguguguggucuugcucggcuuuauuaugugggccugccagaaagggaauaucagauguuccauaugcaucuga

SEQ ID NO: 130846 - RNA, 1701 nt, Artificial Sequence
  derived and/or modified sequence opt3 from hemagglutinin__InfluenzaA__AFJ77583
augaagaccaucauuacacugagcuacauacucugccuuguguucgcccagaaacugcccgucaaggacaacuccacugcuacguuguguuuaggccaccaugcaguuccuaaugggacccuggugaaaacaaucacuaacgaucacauugagguaaccaaugccacagagcuagugcaaucuucaaguaccggaagaaucugcgacagcccacaucagauucucgauggugaaaacuguacucugaucgacgcgcuucugggcgauccgcacugcgacggguuucagaauaaggaaugggauuuguucgucgagagguccacagcuuauucuaacuguuaccccuaugacgugccugauuacgccucgcuccggucacugguugcaagcaguggaacccuggaauuuaauaacgaguccuucaauuggacgggcguggcccagaacgguacuucuagcgcuugcaaacgccgauccauaaagucauuuuucagucgucucaauugguuacaucaacugaaguauaaauacccagcacuuaacgucaccaugcccaauaacgagaaguuugacaaauuguauaucuggggagugcaccacccuagcacagauucugaccagauuucccuguacgcccaggcuucagggagaguaacuguuagcaccaagaggagucagcaaacagugaucccaaauauuggcucucggcccuggguccgcggcguguccagcagaaucucgauauacuggaccauugugaaaccuggggauauccuacucauuaacucuacgggaaaccugaucgccccaagggguuauuucaagauccgguccggcaagucaaguauuaugcgcagcaaugcgccgauagggaaauguaacuccgaaugcaucacucccaauggaucuauuccuaacgacaagccauuucagaaugucaaccgaaucacauacggcgcaugucccagauauguuaaacagaauacccuuaagcuggccacugguaugaggaacgugccugagaaacagacacgggggauauucggagcuauugccggcuuuaucgaaaauggcugggaggggaugguagacggaugguacgguuuccgucaucaaaacagcgagggcaccgggcaggcagcugauuugaagucaacgcaggccgcgaucaaucaaauuaacggaaaacucaaucgccugaucgaaaagaccaacgagaaguuucaccagauugaaaaagaguucagugaaguggagggcagaauacaggacuuagagaaguaugucgaagauacaaaaaucgaccugugguccuacaaugccgagcuccuuguggcacuggaaaaccagcauacuauugauuugaccgacagcgagaugaacaagcuauucgaaaggacacggaaacaacugcgagagaaugcugaggauauggguaacgggugcuuuaagaucuaucacaagugugacaaugccugcaucggcucuauucgcaacggaacuuacgaucacgacguuuacagagaugaagcucucaauaacagguuccagauaaaaggcguggagcugaagucaggguauaaagacuggauccuuuggauuaguuuugccaucagcugcuuccuguugugugucgugcuccugggauuuauuaugugggcaugccagaaggguaauauccgguguaacauaugcaucuga

SEQ ID NO: 130847 - RNA, 1701 nt, Artificial Sequence
  derived and/or modified sequence opt3 from hemagglutinin__InfluenzaA__AFJ77594
augaagaccaucauugcccugagcuacauacucugccuuguguucgcucagaaacugcccgucaaggacaacuccacagcaacuuuguguuuaggccaccaugccguuccuaaugggacgcuggugaaaaccaucacaaacgaucacauugagguaacuaaugcgaccgaacuugugcaaucuucaaguacaggaagaaucugcgacagcccacaucagauucucgauggugagaacuguacccugaucgacgcucuacugggcgauccgcacugcgacggguuucagaauaaggaaugggauuuguucgucgagagguccacugccuauucuaacuguuaccccuaugacgugccugauuacgcaucgcuccggucacugguugccagcaguggaacacuggaauuuaauaacgaguccuucaauuggaccggcguggcucagaacgguacgucuagcgcaugcaaacgccgauccauaaagucauuuuucagucgucucaauugguuacaucaacugaaguauaaauacccagcccuuaacgucacuaugcccaauaacgagaaguuugacaaauuguauaucuggggagugcaccacccuagcaccgauucugaccagauuucccuguacgcucaggccucagggagaguaacaguuagcacuaagaggagucagcaaaccgugaucccaaauauuggcucucggcccuggguccgcggcguguccagcagaaucucgauauacuggacaauugugaaaccuggggauauccuacucauuaacucuaccggaaaccugaucgcgccaagggguuauuucaagauccgguccggcaagucaaguauuaugcgcagcaaugcaccgauagggaaauguaacuccgaaugcaucacgcccaauggaucuauuccuaacgacaagccauuucagaaugucaaccgaaucacuuacggcgccugucccagauauguuaaacagaauacacuuaagcuggcuaccgguaugaggaacgugccugagaaacagacucgggggauauucggagccauugcaggcuuuaucgaaaauggcugggaggggaugguagacggaugguacgguuuccgucaucaaaacagcgagggcacagggcaggcugccgauuugaagucaacccaggcggccaucaaucaaauuaacggaaaacucaaucgccugaucgaaaagacgaacgagaaguuucaccagauugaaaaagaguucagugaaguggagggcagaauacaggacuuagagaaguaugucgaagauaccaaaaucgaccugugguccuacaaugcagagcuccuuguggcucuggaaaaccagcauacaauugauuugacugacagcgagaugaacaagcuauucgaaaggacccggaaacaacugcgagagaaugccgaggauauggguaacgggugcuuuaagaucuaucacaagugugacaaugcuugcaucggcucuauucgcaacggaacauacgaucacgacguuuacagagaugaagcccucaauaacagguuccagauaaaaggcguggagcugaagucaggguauaaagacuggauccuuuggauuaguuuugcaaucagcugcuuccuguugugugucgugcuccugggauuuauuaugugggccugccagaaggguaauauccgguguaacauaugcaucuga

SEQ ID NO: 130848 - RNA, 1701 nt, Artificial Sequence
  derived and/or modified sequence opt3 from hemagglutinin__InfluenzaA__AFJ77605
augaagaccaucauugcccugagcuacauacucugccuuaucuucgcucagaaacugcccggcaacgacaauuccacagcaacuuuguguuuagggcaccaugccgugccuaacggaacgcuggucaagaccauuacaaaugaucaaaucgagguuacuaacgcgaccgaacuugugcagucuucaaguacagguaaaauuugcgacagcccacaccagauccucgauggcgagaauuguacccugauagacgcucuacugggggauccgcauugcgacggauuucagaacaaggaaugggauuuguucguagagagauccaaagccuauucuaauuguuaccccuaugacgugccugauuacgcaucgcucaggucacuggucgccagcaguggcacucuggaauuuaacaaugaguccuucaacuggacagguguggcucaaaaugggaccucuagcgcaugcaagcggcgcuccaacaagucauuuuucagucgacucaauugguuacaccagcugaaauauaaguacccagcccuuaacguuacgaugcccaauaacgagaaauuugacaaguuguauaucuggggagugcaucacccuagcacugauucugaccagauuucccuguacgcucaggccucaggccgugucaccgugagcacaaaaagaagucaacagacuguaaucccaaacauuggcucuaggcccuggguucgcgggguguccagccggaucucgauauacuggaccauugucaagccuggagauauccuacucauuaauucuacagguaaccugaucgcgccaagaggcuauuucaagaucagguccgggaaaucaaguauuaugcggagcgacgcaccgauaggaaaguguaauuccgaaugcaucacccccaacggcucuauuccuaaugacaaaccauuucagaacgugaaucgcaucacguacggugccuguccccgauaugugaagcagaacacucuuaaacuggcuacagggaugagaaaugucccugagaagcaaaccaggggaauauucggcgccauugcaggcuuuaucgaaaacgggugggagggaaugguugaugguugguacggcuuccggcaccagaauagcgaggggacuggacaggcugccgacuugaaaucaacacaagcggccaucaaccagauuaauggcaagcucaaccgucugaucgaaaagaccaaugagaaauuucaucagauugaaaaggaguucagugaaguggagggucgcauacaggauuuagagaaauauguagaagacacgaagaucgaucugugguccuacaacgcagagcuccuuguggcucuggaaaaccaacacaccauugacuugacagauagcgagaugaauaaacuauucgaaagaacuaagaagcagcugagggagaacgccgaggacauggggaauggcugcuuuaaaaucuaucauaagugugauaacgcuugcaucggaucuauucggaauggcaccuacgaccacgaugucuaccgagacgaagccgugaacaaucgcuuccagauaaaagggguugagcucaagucaggauauaaagacuggauccuguggauuaguuuugcaaucagcugcuuccuucuguguguggucuugcucgguuuuauuaugugggccugccagaagggcaacaucagauguaauauaugcaucuga

SEQ ID NO: 130849 - RNA, 1701 nt, Artificial Sequence
  derived and/or modified sequence opt3 from hemagglutinin__InfluenzaA__AFJ77616
augaagaccaucauugcccugagcuacauacucugcauggugcuugcucagaaacugcccgucaaggacaacuccacagcaacuuuguguuuaggccaccaugccguuccuaaugggacgcuggugaaaaccaucacaaacgaucacauugagguaacuaaugcgaccgaacuugugcaaucuucaaguacaggaagaaucugcgacagcccacaucagauucucgauggugagaacuguacccugaucgacgcucuacugggcgauccgcacugcgacggguuccagaauaaggaaugggauuuguuugucgagagguccacugccuauucuaacuguuaccccuaugacgugccugauuacgcaucgcuccggucacugguugccagcaguggaacacuggaguucaauaacgaauccuuuaauuggaccggcguggcucagaacgguacgucuagcgcaugcaaacgccgauccauaaagucauucuuuagucgucucaauugguuacaucaacugaaguauaaauacccagcccuuaacgucacuaugcccaauaacgagaaguucgacaaauuguauaucuggggagugcaccacccuagcaccgauucugaccagauuucccuguacgcucaggccucagggagaguaacaguuagcacuaagaggagucagcaaaccgugaucccaaauauuggcucucggcccuggguccgcggcguguccagcagaaucucgauauacuggacaauugugaaaccuggggauauccuacucauuaacucuaccggaaaccugaucgcgccaagggguuauuuuaagauccgguccggcaagucaaguauuaugcgcagcaaugcauccauagggaaauguaacucugaaugcaucacgccgaauggaagcauucccaacgacaagccuuuccagaaugucaaccgaaucacuuacggcgccuguccaagauauguuaaacagaauacacuuaagcuggcuaccgguaugaggaacgugcccgagaaacagacucgggggauauuuggagccauugcaggcuucaucgaaaauggcugggaggggaugguagacggaugguacgguuuucgucaucaaaacucagagggcacagggcaggcugccgauuugaagaguacccaggcggccaucaaucaaauuaacggaaaacucaaucgccugaucgaaaagacgaacgagaaguuccaccagauugaaaaagaguuuuccgaaguggagggcagaauacaggacuuagagaaguaugucgaagauaccaaaaucgaccuguggagcuacaaugcagagcuccuuguggcucuggaaaaccagcauacaauugauuugacugacucugagaugaacaagcuauucgaaaggacccggaaacaacugcgagagaaugccgaggauauggguaacgggugcuucaagaucuaucacaagugugacaaugcuugcaucggcucaauucgcaacggaacauacgaucacgacguuuacagagaugaagcccucaauaacagguuucagauaaaaggcguggagcugaagaguggguauaaagacuggauccuuuggauuagcuucgcaaucuccugcuuucuguugugugucgugcuccugggauucauuaugugggccugccagaaggguaauauccgguguaacauaugcaucuga

SEQ ID NO: 130850 - RNA, 1701 nt, Artificial Sequence
  derived and/or modified sequence opt3 from hemagglutinin__InfluenzaA__AFJ77627
augaagaccaucauugcccugagcuacauacucugccuugugcuggcucagaaauugcccgucaaggacaacuccacagcaacuuuaugucugggccaccaugccguuccuaaugggacgcuagugaaaaccaucacaaacgaucacauugagguaacuaaugcgaccgaacucgugcaaucuucaaguacaggaagaaucugcgacagcccacaucagauucuggauggugagaacuguacccuuaucgacgcucuguugggcgauccgcacugcgacggguuccagaauaaggaaugggaucucuuugucgagagguccacugccuauucuaacuguuaccccuaugacgugccugauuacgcaucgcugcggucacugguugccagcaguggaacacucgaguucaauaacgaauccuuuaauuggaccggcguggcucagaacgguacgucuagcgcaugcaaacgccgauccauaaagucauucuuuagucguuuaaauuggcugcaucaacuuaaguauaaauacccagccuugaacgucacuaugcccaauaacgagaaguucgacaaacuguauaucuggggagugcaccacccuagcaccgauucugaccagauuucccuauacgcucaggccucagggagaguaacaguuagcacuaagaggagucagcaaaccgugaucccaaauauuggcucucggcccuggguccgcggcguguccagcagaaucucgauauacuggacaauugugaaaccuggggauauccuccugauuaacucuaccggaaaccuuaucgcgccaagggguuauuuuaagauccgguccggcaagucaaguauuaugcgcagcaaugcauccauagggaaauguaacucugaaugcaucacgccgaauggaagcauucccaacgacaagccuuuccagaaugucaaccgaaucacuuacggcgccuguccaagauauguuaaacagaauacacugaaguuggcuaccgguaugaggaacgugcccgagaaacagacucgggggauauuuggagccauugcaggcuucaucgaaaauggcugggaggggaugguagacggaugguacgguuuucgucaucaaaacucagagggcacagggcaggcugccgaucucaagaguacccaggcggccaucaaucaaauuaacggaaaacugaaucgcuuaaucgaaaagacgaacgagaaguuccaccagauugaaaaagaguuuuccgaaguggagggcagaauacaggaccuggagaaguaugucgaagauaccaaaaucgaccucuggagcuacaaugcagagcuucugguggcuuuggaaaaccagcauacaauugaucuaacugacucugagaugaacaagcuguucgaaaggacccggaaacaacuccgagagaaugccgaggauauggguaacgggugcuucaagaucuaucacaagugugacaaugcuugcaucggcucaauucgcaacggaacauacgaucacgacguuuacagagaugaagcccugaauaacagguuucagauaaaaggcguggagcuuaagaguggguauaaagacuggauccuguggauuagcuucgcaaucuccugcuuuuugcucugugucgugcuguuaggauucauuaugugggccugccagaaggguaauauccgguguaacauaugcaucuga

SEQ ID NO: 130851 - RNA, 1701 nt, Artificial Sequence
  derived and/or modified sequence opt3 from hemagglutinin__InfluenzaA__AFJ77638
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcaccacgcccaacggcucuauaccuaaugacaagccauuucagaacgugaaucgaaucacuuacggugccugucccagauaugucaaacagaacacacuuaagcuggcuaccgggaugaggaauguuccugagaaacaaacucggggaauuuucggcgccaucgcaggcuuuauagaaaacgggugggagggaaugguggaugguugguacggcuuccgucaccagaauagcgaggggacaggacaggcugccgacuugaagucaacccaagcggccauuaaccagaucaauggcaaacucaaccgccugaucgguaagacgaaugaaaaguuucaucagauugagaaagaguucagugaaguagaagggagaauccaggauuuagagaaguauguggaggacaccaaaauugaucugugguccuacaacgcagaacuccuugucgcucuggagaaccaacacacaauagacuugacugauagcgaaaugaauaagcuauucgagaggaccaaaaagcagcugcgggaaaacgccgaggacaugggcaauggaugcuuuaagaucuaucauaaaugugauaacgcuugcauuggcucuauccgaaaugggacauacgaccacgauguguaccgcgacgaggcccucaacaauagauuccagaucaagggaguugaacugaaaucagguuauaaggacuggauucuuuggauaaguuuugcaaucagcugcuuccuguugugugugguccuccugggcuuuauuaugugggccugccagaaagggaacaucagguguaauauuugcaucuga

SEQ ID NO: 130852 - RNA, 1701 nt, Artificial Sequence
  derived and/or modified sequence opt3 from hemagglutinin__InfluenzaA__AFJ77649
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauaacacagguaaucugauugcgccaaggggcuauuucaagauccggaacgggaagucuuccaucaugcgcucagacgcaccgauuggaaaauguaauagugaaugcauaacccccaacggcagcaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucuacacaagcggccaucaaccagaucaauggcaaacucaaccgccugauugguaagaccaacgaaaaguuucaucagaucgagaaagaguucagcgaaguagaagggaggauucaggauuuagagaaguauguggaggacacgaaaauagaucuguggucauacaaugcagaacuccuugucgcucuggagaaccaacacaccaucgacuugacagauagugaaaugaauaagcuauucgagagaacuaaaaagcagcugcgggaaaacgccgaggacaugggcaauggaugcuuuaagauuuaucauaaaugugauaacgcuugcaucggcuccauccgaaaugggaccuacgaccacgauguguaccgcgacgaggcccucaacaauagauucaagauuaaaggaguugaacugaaguccgguuauaaagacuggauacuuuggaucucuuuugcaauuucaugcuuccuguugugugugguccuccugggcuuuaucaugugggccugccagaaggggaacauuagguguaauaucugcauauga

SEQ ID NO: 130853 - RNA, 1701 nt, Artificial Sequence; identical to SEQ ID NO: 122219
  derived and/or modified sequence opt3 from hemagglutinin__InfluenzaA__AFJ77660

SEQ ID NO: 130854 - RNA, 1701 nt, Artificial Sequence; identical to SEQ ID NO: 122219
  derived and/or modified sequence opt3 from hemagglutinin__InfluenzaA__AFJ77671

SEQ ID NO: 130855 - RNA, 1701 nt, Artificial Sequence; identical to SEQ ID NO: 122219
  derived and/or modified sequence opt3 from hemagglutinin__InfluenzaA__AFJ77682

SEQ ID NO: 130856 - RNA, 1701 nt, Artificial Sequence
  derived and/or modified sequence opt3 from hemagglutinin__InfluenzaA__AFJ77693
augaagaccaucauugcccugagcuacauacucugccuuguguucgcucagaaacugcccgucaacgacaauuccacagcaacuuuguguuuaggccaccauacgguuccuaacgggacccuggugaagacaaucacuaaugauaacauugagguaaccaaugccacagagcuagugcaaucuucaaguaccggaagaaucugcgacagcccacaccagauucucgauggugaaaacuguacucugaucgacgcgcuucugggcgauccgcauugcgacggguuucagaauaaagaaugggauuuguucgucgagagguccacagcuuauucuaacuguuaccccuaugacgugccugauuacgccucgcuccggucacugguugcaagcaguggaacccuggaauuuaauaacgaguccuucaauuggacgggcguggaccagaacgguacuucuagcgccugcaagcgccgauccaauaaaucauuuuucagucgucucaacugguuacaccaacugaaguauaaguacccagcucuuaaugucaccaugcccaacaacgagaaauuugauaaguuguauauauggggagugcaucacccuagcacagacucugaucagaucucccuguacgcacaggccucagggagaguaacuguuagcaccaaaaggagucagcaaacagugauuccaaauaucggcucucggcccuggguccgcggcguguccagcagaauuucgaucuacuggaccauagugaagccuggggacauucuacucaucaacucuacgggaaaucugauugcuccaagggguuauuucaaaauccgguccggcaagucaaguaucaugcgcagcaacgccccgauugggaaguguaauuccgaaugcauaacucccaacggaucuaucccuaaugacaaaccauuucagaacgucaaucgaauuacauacggcgcgugucccagauauguuaagcagaacacccuuaaacuggcaacugguaugaggaaugugccugagaagcagacacgggggaucuucggagccauagcuggcuuuauugaaaacggcugggaggggaugguagauggaugguacgguuuccgucaccaaaauuuugagggcaccgggcaggccgcagacuugaaaagcacgcaggcugccaucaaccaaaucaauggaaagcucaaccgccugauugagaaaaccaacgaaaaguuccaucagaucgaaaaggaguucucagaaguggagggcaggauucaggauuuagagaaauaugucgaagacacaaagauagaucuguggaguuacaaugcggagcuccuuguggcccuggaaaaccagcacacuaucgacuugaccgauuccgagaugaauaaacuauuugaaagaacacggaagcaacugcgagagaacgcagaggacauggguaaugggugcuucaaaauuuaucauaagugugauaacgcuugcaucggcagcauccgcaauggaacuuacgaccacgauguuuacagagacgaagcccucaacaauagguuucagauuaagggcguggagcugaaaucuggguauaaggacuggauacuuuggaucucauucgcuauuaguugcuuucuguugugugucgugcuccugggauucaucaugugggccugccagaaagguaacauucgguguaauaucugcauauga

SEQ ID NO: 130857 - RNA, 1701 nt, Artificial Sequence; identical to SEQ ID NO: 122219
  derived and/or modified sequence opt3 from hemagglutinin__InfluenzaA__AFJ77704

SEQ ID NO: 130858 - RNA, 1701 nt, Artificial Sequence; identical to SEQ ID NO: 130697
  derived and/or modified sequence opt3 from hemagglutinin__InfluenzaA__AFJ77715

SEQ ID NO: 130859 - RNA, 1701 nt, Artificial Sequence; identical to SEQ ID NO: 130697
  derived and/or modified sequence opt3 from hemagglutinin__InfluenzaA__AFJ77726

SEQ ID NO: 130860 - RNA, 1701 nt, Artificial Sequence; identical to SEQ ID NO: 130793
  derived and/or modified sequence opt3 from hemagglutinin__InfluenzaA__AFJ77737

SEQ ID NO: 130861 - RNA, 1701 nt, Artificial Sequence; identical to SEQ ID NO: 122048
  derived and/or modified sequence opt3 from hemagglutinin__InfluenzaA__AFJ77748

SEQ ID NO: 130862 - RNA, 1701 nt, Artificial Sequence; identical to SEQ ID NO: 122048
  derived and/or modified sequence opt3 from hemagglutinin__InfluenzaA__AFJ77759

SEQ ID NO: 130863 - RNA, 1701 nt, Artificial Sequence
  derived and/or modified sequence opt3 from hemagglutinin__InfluenzaA__AFJ77781
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacuccgaaucuuucgacuggacagggguuacccagaauggaacgagcuccgcuugcaagcggcgcucaaacaagagcuuuuucagucgacugaauuggcucacucauuuaaaauauaaguacccagcacugaacgugaccaugcccaauaacgagaaauuugauaaacuuuauaucuggggcguccaccauccuggcacagacucugaucagauuuccuuguacgcccaggcuucagggcguaucacugugagcaccaagagaagucaacagacaguaauuccaaauaucggaucuaggccccggguucgcgacguguccagcagaauaucgauuuacuggaccaucgucaagccuggugacauucugcuaaucaacucuacgggcaaccucaucgccccaaggggguauuucaagauucgguccggaaaaucaaguauaaugcgcagcgaugcgccgaucggcaaguguaauuccgagugcauuacucccaacgguucuaucccuaaugacaaaccauuucagaacgugaaucgaauaacauacggggcaugucccagauaugugaagcagaacacccugaaacuugccacuggaaugaggaaugucccugaaaagcaaacacggggcauuuucggcgcuaucgccggguuuaucgagaacggaugggaagguaugguugauggcugguacggguuccgucaccagaauagcgagggaaccggccaggcagcugaccugaaaucaacgcaagccgcgauuaaccagaucaaugguaaguugaaccgccucauugggaagaccaaugagaaauuucaccagauagaaaaggaguucagugaaguggagggcagaauccaggaucuggaaaaauauguagaggacacaaagauugauuuaugguccuacaacgccgagcugcucguggcacuugaaaaucaacauacuaucgaccugaccgauagcgagaugaacaaauuguucgaaaggacaaagaagcagcuacgggagaacgcugaagacaugggaaauggcugcuuuaaaaucuaucacaagugugauaacgccugcauugggucuauacgaaauggaacuuacgaccaugacgucuaccgcgaugaggcucugaacaauagauuccagaucaaagguguggagcucaagucaggcuauaaagacuggauucuguggaucaguuuugccauuagcugcuuccuucuguguguugcauugcucggguuuaucaugugggccugccagaagggaaacauaagguguaauaucugcauuuga

SEQ ID NO: 130864 - RNA, 1701 nt, Artificial Sequence; identical to SEQ ID NO: 123811
  derived and/or modified sequence opt3 from hemagglutinin__InfluenzaA__AFJ77792

SEQ ID NO: 130865 - RNA, 1701 nt, Artificial Sequence; identical to SEQ ID NO: 123811
  derived and/or modified sequence opt3 from hemagglutinin__InfluenzaA__AFJ77803

SEQ ID NO: 130866 - RNA, 1701 nt, Artificial Sequence; identical to SEQ ID NO: 123811
  derived and/or modified sequence opt3 from hemagglutinin__InfluenzaA__AFJ77814

SEQ ID NO: 130867 - RNA, 1701 nt, Artificial Sequence; identical to SEQ ID NO: 123811
  derived and/or modified sequence opt3 from hemagglutinin__InfluenzaA__AFJ77825

SEQ ID NO: 130868 - RNA, 1701 nt, Artificial Sequence; identical to SEQ ID NO: 123811
  derived and/or modified sequence opt3 from hemagglutinin__InfluenzaA__AFJ77836

SEQ ID NO: 130869 - RNA, 1701 nt, Artificial Sequence; identical to SEQ ID NO: 123811
  derived and/or modified sequence opt3 from hemagglutinin__InfluenzaA__AFJ77847

SEQ ID NO: 130870 - RNA, 1701 nt, Artificial Sequence
  derived and/or modified sequence opt3 from hemagglutinin__InfluenzaA__AFJ77858
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccacccaaagaucacagcagacaguaauuccaaacaucggaagcaggccccggguucgcgauauaccuaguagaauuucuaucuacuggaccauugugaagccaggugacaugcugcuaaucaauuccacgggcaaccucaucgccccgaggggguacuuuaaaauucggagcggaaagucgucuauaaugcgcuccgacgcgcccaucggcaaguguaauucagagugcauuacuccuaacgguaguaucccaaaugauaaacccuuccagaacgucaaucgaauaacauauggggcauguccuagauacgugaagcaaaacacccugaaacuugccacuggaaugaggaaugugccagaaaagcagacacggggcauuuuuggcgcuaucgccggguucaucgagaacggaugggaagguauggucgacggcugguauggguuucgucaccagaauagcgagggaaccggccaagcagcugaucugaaauccacgcaggccgcgauuaaccagaucaaugguaaguugaacaaacucauugggaagaccaacgagaaguuccaccagauagaaaaagaguucucugaaguugagggccgcauccaagaccuggaaaaguacguggaggauacaaaaauugacuuauggagcuauaaugccgagcugcucguagcacuugaaaaccagcauacuaucgaucugaccgacucagagaugaauaaguuguuugaaagaacuaaaaagcagcuaagggagaacgcugaagauaugggaaauggcugcuucaagaucuaccacaaaugugacaacgccugcauugggaguauacggaauggaacauaugaucaugacguguaccgagacgaggcucugaacaaucgcuuucagaucaagggugucgagcucaaauccggcuacaaggauuggauucuguggaucagcuucgccauuucuugcuuucuuuucuguguggcacuguugggguuuaucaugugggccugccaaaaaggaaacauaagauguaauaucugcauuuga

SEQ ID NO: 130871 - RNA, 1701 nt, Artificial Sequence
  derived and/or modified sequence opt3 from hemagglutinin__InfluenzaA__AFJ77869
augaagaccaucauugccuucagcuacauacugugccucguguuugcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagucuucaaguacagguggcauuugcgacagcccacaccagauccuggauggggagaauuguacccuaauagacgcucuccugggagauccgcagugcgacggcuuccaaaacaaaaagugggaucuuuuuguggaaagauccaaagccuauucuaauuguuaccccuaugacgucccugauuacgcaucgcugaggucauugguggccagcagugguacucucgaguucaacaaugaauccuuuaacuggacagggguuacccagaauggaacgucuagcgcuugcaagcggcgcuccaacaauucauucuuuagucgacugaacuggcugacucaucucaaguucaaauauccagcauuaaaugugaccaugcccaacaacgagaaguuugacaaacuguacaucuggggcguccaccauccuggcacagauaaugaccagauuagccuuuaugcccaggcuucugggcguaucacuguguccaccaagagaucacaacagacaguaauuccaaacaucggaagcaggccccggguucgcgauauaccuaguagaauuucuaucuacuggaccauugugaaaccaggugacaucuugcugaucaauuccacgggcaaccuaauugccccgaggggguacuucaagauacggagcggaaagucgucuaucaugcgcuccgacgcgcccauuggcaaauguaauucagagugcaucacuccuaacgguaguauaccaaaugauaagcccuuucagaacgucaaucgaauuacauauggggcauguccuagauacgugaaacagaacacccucaagcuggccacuggaaugaggaaugugccagaaaaacaaacacggggcaucuucggcgcuaucgccggguuuauugagaacggaugggaagguauggucgacggcugguauggguuccgucaccagaauagcgagggaaccggccaggcagcugaucuuaaguccacgcaagccgcgaucaaccagauuaaugguaaacugaaccgcuugauagggaagaccaacgagaaguuccaccagaucgaaaaagaguuuucugaaguugagggcaggauucaggaccucgaaaaguacguggaggauacaaaaaucgaccuguggagcuauaaugccgaguuacugguagcacucgaaaaccaacauacuaucgaucuuaccgacucagagaugaauaagcuguucgaaagaacuaaaaagcaguugcgggagaacgcugaagauaugggaaauggcugcuuuaagauuuaccacaaaugugacaacgccugcauagggaguauccgaaauggaacauaugaucaugacguguaccgcgacgaggcucuaaacaauagauuccagauuaagggugucgagcugaaauccggcuacaaggauuggauccucuggauuagcuuugccaucucuugcuuccugcuuuguguggcacuguugggguuuauaaugugggccugccagaaaggaaacaucagguguaauauuugcaucuga

SEQ ID NO: 130872 - RNA, 1701 nt, Artificial Sequence
  derived and/or modified sequence opt3 from hemagglutinin__InfluenzaA__AFJ77880
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcaauagcccacaccagauccuagacggggagaacuguacccucauagaugcucugcuuggagacccgcagugcgauggcuuucaaaauaaaaagugggaccuguucguggaaagauccaaagccuauucuaacuguuaccccuaugaugucccugacuacgcaucguugaggucacucguggccagcagugguacucuggaguuuaauaacgaauccuucaauuggacagggguuacccagaacggaacgucuagcgcuugcaagcggcgcuccaauaagucauuuuucagucgacugaacuggcucacucauuuaaaauuuaaguauccagcacugaaugugaccaugcccaacaacgagaaauucgauaaacuuuacaucuggggcguccaccauccuggcacagacaaugaucagauuagcuuguaugcccaggcuucugggcguaucacuguguccaccaagagaucacaacagacaguaauuccaaacaucggaagcaggccccggguucgcgacgugccuaguagaauaucuauuuacuggaccaucgucaagccaggugauauucugcuaaucaauuccacgggcaaccucaucgccccgaggggguacuuuaagauucggagcggaaaaucgucuauaaugcgcuccgacgcgcccaucggcaaguguaauucagagugcauuacuccuaacgguaguaucccaaaugacaaacccuuccagaacgugaaucgaauaacauauggggcauguccuagauacgugaagcagaacacccugaaacuugccacuggaaugaggaaugucccagaaaagcaaacacggggcauuuuuggcgcuaucgccggguucaucgagaacggaugggaagguaugguugauggcugguauggguuucgucaccagaauagcgagggaaccggccaggcagcugaccugaaauccacgcaagccgcgauuaaccagaucaaugguaaguugaaccgccucauugggaagaccaacgagaaauuccaccagauagaaaaggaguucucugaaguggagggcagaauccaggaucuggaaaaauacguagaggacacaaagauugauuuauggagcuauaaugccgagcugcucguggcacuugaaaaccaacauacuaucgaccugaccgauucagagaugaauaaauuguuugaaaggacaaagaagcagcuacgggagaacgcugaagacaugggaaauggcugcuucaaaaucuaccacaagugugauaacgccugcauugggaguauacgaaauggaacuuaugaccaugaugucuaccgcgacgaggcucugaacaauagauuucagaucaaagguguggagcucaaguccggcuacaaagacuggauucuguggaucagcuucgccauuucuugcuuucuucuguguguugcauugcucggguucaucaugugggccugccagaagggaaacauaagguguaauaucugcauuuga

SEQ ID NO: 130873 - RNA, 1701 nt, Artificial Sequence
  derived and/or modified sequence opt3 from hemagglutinin__InfluenzaA__AFJ77902
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuggguuguaugcccaggcuagcggacguaucacugugucuaccaagagaucccaacagacaguaauuccaaacaucgguucaaggccccggguucgcgauauaccuagcagaauuaguaucuacuggaccauugugaaaccaggcgacaugcugcuaaucaauucuacggggaaccucaucgccccgaggggauacuuuaagauucgguccggcaagagcucgauaaugcgcucugacgcgcccaucgguaaauguaauuccgagugcauuacuccuaacgggucaaucccaaaugauaagcccuuccagaacgucaaucgaauaacauauggagcauguccuagauacgugaaacagaacacccugaagcuggccacuggcaugaggaaugugccagaaaaacaaacacggggcauuuuuggggcuaucgccggauucaucgagaacgguugggaaggcauggucgacgggugguauggauuucgucaccagaauagugagggcaccggucaggcagcugaucuuaagagcacgcaagccgcgauuaaccagaucaaugggaaauugaaccgccucauuggcaagaccaacgagaaguuccaccagauagaaaaagaguucuccgaaguugagggaagaauccaggaccuggaaaaguacguggaggauacaaaaauugacuuauggucuuauaaugccgagcugcucguagcacuugaaaaccaacauacuaucgaucugaccgacagcgagaugaauaaguuguuugaaaggacuaaaaagcagcuacgggagaacgcugaagauaugggcaaugggugcuucaagaucuaccacaaaugugacaacgccugcauuggaucaauacgaaaugguacauaugaucaugacguguaccgcgacgaggcucugaacaauagauuucagaucaagggcgucgagcucaaaaguggguacaaggauuggauucuguggaucuccuucgccauuagcugcuuucuucuguguguggcauugcucggauucaucaugugggccugccagaaaggcaacauaagguguaauaucugcauuuga

SEQ ID NO: 130874 - RNA, 1701 nt, Artificial Sequence
  derived and/or modified sequence opt3 from hemagglutinin__InfluenzaA__AFJ77913
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacguccaggauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccugcacugaaugugaccaugccaaacaacgagaaguucgacaaacuuuacaucuggggcguccaccaucccggcacagauaaugaccagauuagcuuguaugcccaggcuucugggcguaucacuguguccaccaagagaucacaacagacaguaauuccuaacaucggaagcaggccacggguucgcgauauacccaguagaauuucuaucuacuggaccauugugaaaccuggugacaugcugcuaaucaauuccacgggcaaccucaucgccccaaggggguacuuuaagauucggagcggaaagucgucuauaaugcgcuccgacgcgccgaucggcaaauguaauucagagugcauuacucccaacgguaguaucccuaaugauaagccauuccagaacgucaaucgaauaacauauggggcaugucccagauacgugaaacaaaacacccugaaacuugccacuggaaugaggaaugugccugaaaaacagacacggggcauuuuuggcgcuaucgccggguucaucgagaacggaugggaagguauggucgacggcugguauggguuucgucaccagaauagcgagggaaccggccaagcagcugaucugaaguccacgcaggccgcgauuaaccagaucaaugguaaauugaaccgccucauugggaagaccaacgagaaguuccaccagauagaaaaagaguucucugaaguugagggcagaauccaagaccuggaaaaguacguggaggauacaaaaauugacuuauggagcuauaaugccgagcugcucguagcacuugaaaaccagcauacuaucgaucugaccgacucagagaugaauaaguuguuugaaaggacaaagaagcagcuacgggagaacgcugaagauaugggaaauggcugcuucaagaucuaccacaaaugugacaacgccugcauugggaguauacgaaauggaacuuaugaucaugacguguaccgcgacgaggcucugaacaauagauuucagaucaagggugucgagcucaaauccggcuacaaggauuggauucuguggaucagcuucgccauuucuugcuuucuucuguguguggcauugcucggguucaucaugugggccugccaaaaaggaaacauaagguguaauaucugcauuuga

SEQ ID NO: 130875 - RNA, 1701 nt, Artificial Sequence; identical to SEQ ID NO: 123129
  derived and/or modified sequence opt3 from hemagglutinin__InfluenzaA__AFJ77924

SEQ ID NO: 130876 - RNA, 1701 nt, Artificial Sequence
  derived and/or modified sequence opt3 from hemagglutinin__InfluenzaA__AFJ77935
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugaucaaauugagguaacuaacgcgaccgaacuggugcagucuucaaguacagguggcaucugcgacagcccacaccagauucuagauggggagaauuguacccucauggacgcucugcuuggagauccgcagugcgacggcuuucaaaacaaaaagugggaucuguucgucgaaagauccaaagccuauucuaauuguuaccccuaugacgugccugaucaugcaucguugaggucacucguugccagcagugguacucuggaguuuaacaaugaauccuucaacuggacaggggugacccagaauggaacgucuagcgcuugcaagcggcgcuccaacaauucauuuuucagucgacugaacuggcucacucacuuaaaguuuaaauacccagcacugaaugucaccaugcccaacaacgagacauucgacaaguuguauaucuggggcgugcaucacccuggcacugauaaugaccagauaagccuuuacgcccaggcuucugggcguaucaccguauccacaaaaagaucacaacagaccguuauuccaaacaucggaagcaggccccgggugcgcgauauuccuaguagaaucucuauauauuggacgauugucaagccaggugacauccugcuaauuaauuccacuggcaaccucaucgccccgaggggguacuuuaaaauccggagcggaaagucgucuauuaugcgcuccgacgcgcccauaggcaaguguaauucagagugcaucacaccuaacgguaguauuccaaaugauaaacccuuccagaacgugaaucgaaucaccuacggggcauguccuagauaugugaagcagaacacucugaaacuugccacaggaaugaggaaugucccagaaaagcaaacccggggcauauuuggcgcuauugccggguucaucgagaacggaugggaagguaugguugacggcugguacggguuucgucaccagaauagcgagggaacgggccaggcagcugaucugaaauccacccaagccgcgaucaaccagauuaaugguaaguugaaccgccucaucgggaaaacaaacgagaaguuccaucagauugaaaaggaguucucugaaguggagggcagaauacaggaccuggaaaaauauguagaggauacuaagaucgacuuauggagcuacaaugccgagcugcucguggcacuugaaaaccaacacaccauugaucugacagacucagagaugaauaaauuguuugaaaggacuaagaaacagcuacgggagaacgcugaagauaugggaaauggcugcuucaagaucuaucauaagugugacaacgccugcaucgggaguauucgaaauggaaccuacgaucacgacgucuaucgcgacgaggcucugaacaauagauuucagauaaaagguguggagcucaaguccggcuacaaagauuggauccuguggauuagcuucgccaucucuugcuuucuucuguguguugcauugcucggguucauuaugugggccugccagaagggaaacaucagguguaauauaugcaucuga

SEQ ID NO: 130877 - RNA, 1701 nt, Artificial Sequence
  derived and/or modified sequence opt3 from hemagglutinin__InfluenzaA__AFJ77946
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuagcuuguaugcccaggcuucugggcguaucacuguguccaccaagagaucacaacagacaguaauuccaaacaucggaagcaggccccggguucgcgauauaccuaguagaauuucuaucuacuggaccauugugaaaccaggugacaugcugcuaaucaauuccacgggcaaccucaucgccccgaggggguacuuuaagauucggagcggaaagucgucuauaaugcgcuccgacgcgcccaucggcaaauguaauucagagugcauuacuccuaacgguaguaucccaaaugauaagcccuuccagaacgucaaucgaauaacauauggggcauguccuagauacauuaaacagaacacccugaaacuugccacuggaaugaggaaugugccagaaaaacaaacacggggcaucuuuggcgcuaucgccggguucauugagaacggaugggaagguaugguggacggcugguauggguuucgucaccagaauagcgagggaaccggccaggcagcugaucugaaguccacgcaagccgcgaucaaccagauuaaugguaaauugaaccgccucauagggaagaccaacgagaaguuccaccagaucgaaaaagaguucucugaagucgagggcaggauucaggaccuggaaaaguacguugaggauacaaaaaucgacuuauggagcuauaaugccgagcugcucguggcacuugaaaaccaacauacuaucgaucugaccgacucagagaugaauaaguuguuugaaagaacaaagaagcagcuacgggagaacgcugaagauaugggaaauggcugcuucaagauuuaccacaaaugugacaacgccugcauagggaguauccgaaauggaacuuaugaucaugacguauaccgcgacgaggcucugaacaauagauuucagauuaaggguguggagcucaaauccggcuacaaggauuggaucauuuggaucagcuucgccauaucuugcuuucugcuuugugucgcacuguugggguucaucaugugggccugccagaaaggaaacauuagguguaauaucugcauuuga

SEQ ID NO: 130878 - RNA, 1701 nt, Artificial Sequence; identical to SEQ ID NO: 123769
  derived and/or modified sequence opt3 from hemagglutinin__InfluenzaA__AFJ77957

SEQ ID NO: 130879 - RNA, 1701 nt, Artificial Sequence; identical to SEQ ID NO: 122646
  derived and/or modified sequence opt3 from hemagglutinin__InfluenzaA__AFJ77968

SEQ ID NO: 130880 - RNA, 1701 nt, Artificial Sequence
  derived and/or modified sequence opt3 from hemagglutinin__InfluenzaA__AFJ77979
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugauguguaccgcgacgaggcucugaauaacagauuccagaucaagggugucgagcucaggaguggcuacaaagacuggauucuguggaucuccuuugccauaagcugcuuccuucuguguguggcauugcucggguuuaucaugugggccugccagaagggaaauauucgguguaacaucugcauuuga

SEQ ID NO: 130881 - RNA, 1701 nt, Artificial Sequence
  derived and/or modified sequence opt3 from hemagglutinin__InfluenzaA__AFJ77990
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauauggggcauguccuagauacgugaaacagaauacccugaagcuggccacuggaaugaggaacgugccagaaaaacaaacacggggcaucuucggcgcuaucgccggguuuauugagaauggaugggaagguauggucgauggcugguauggguuccgucaccagaacagugagggaaucggccaggcagcugaccuuaagagcacccaagccgcgauuaaucagauaaacgguaaauugaaccgccucaucgggaagacgaaugagaaguuccaccagauugaaaaagaguuuuccgaaguugagggcagaauccaggaucuggaaaaguacguggaggacaccaaaaucgauuuauggucuuauaacgccgagcugcucguagcacuugaaaaucaacauacaauugaccugacugauagcgagaugaacaaguuguucgaaaggaccaaaaagcagcuacgggagaaugcugaagacaugggaaacggcugcuuuaagauauaccacaaaugugauaaugccugcaucgggucaauucgaaacggaacauaugaccaugaugaguaccgcgacgaggcucugaauaacagauuccagaucaaggguguggaacucaaaaguggcuacaaggacuggauucuguggaucuccuuugccauaagcugcuuccuucugugugucacuuugcucggguuuaucaugugggcaugccagaaaggaaauauuagguguaacaucugcauuuga

SEQ ID NO: 130882 - RNA, 1701 nt, Artificial Sequence
  derived and/or modified sequence opt3 from hemagglutinin__InfluenzaA__AFJ78001
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagaugggaaaaauuguacccucauagacgcucugcuuggagauccgcagugcgacgauuuucaaaacaagaaaugggaccuguucguggagagauccaaggccuauucuaauuguuaccccuaugaugucccugacuacgcaucguugaggucacucguggccagcaguggcacucuggaauuuaacaaugaguccuucaacuggacagguguuacccagaaugggacgucuagcgcuugcaagcggcgcuccaacaauucauuuuucagucgacugaacuggcucacucauuuaaaauuuaaguauccagcacugaaugugaccaugcccaacaacgaaaaauucgauaaguuguacaucuggggaguccaccauccuggcacagacaaugaucagauuuuucuuuaugcccaggcuagcggccguaucacugugucuaccaaaagaucccaacagacaguaauuccaaacaucgggucaaggccccggguucgcaauauaccuagcagaauuaguaucuacuggaccauugugaagccaggagacauccugcuaaucaacucuacggguaaucucauugccccgaggggcuacuucaagauacgguccgggaaaagcucgaucaugcgcucugacgcgcccauuggaaaguguaacuccgagugcaucacuccuaauggcucaauaccaaacgauaaacccuuucagaaugucaaccgaauuacauauggugcauguccuagauacgugaagcagaauacccugaaacuugccacugggaugaggaacgugccagagaagcaaacacggggaaucuucggcgcuaucgccggcuuuauugaaaaugggugggagggaauggucgacgguugguauggcuuccgucaccagaacagugaagggaucggacaggcagcugaucugaaaagcacccaagccgcgauuaaucagauaaacggcaaguugaaccgccucaucgguaagacgaaugagaaauuccaccagauugagaaggaauuuuccgagguugaagggagaauccaggaccuggagaaauacguggaagauaccaagaucgacuuauggucuuauaacgccgagcugcucguagcacuugagaaucaacauacaauugaucugacugacagcgaaaugaacaaauuguucgagaggaccaagaagcagcuacgggaaaaugcugaggauaugggcaacggaugcuuuaaaauauaccacaagugugacaaugccugcaucggcucaauucgaaacgggacauaugaucaugacguguaccgcgacgaagcucugaauaacagauuccagaucaaaggagucgagcucaagagugguuacaaagauuggauucuguggaucuccuuugccauaagcugcuuccuucugugugugacuuugcucggcuuuaucaugugggcaugccagaaggggaauauuagguguaacaucugcauuuga

SEQ ID NO: 130883 - RNA, 1701 nt, Artificial Sequence
  derived and/or modified sequence opt3 from hemagglutinin__InfluenzaA__AFJ78012
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagcccauucuaauuguuaucccuacgacgucccugauuaugcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucacuuaaaguuuaaauacccagcacugaaugugaccaugcccaacaacgagaaguucgacaaacuuuauaucuggggcguccaucacccuggcacagauaaugaccagaucuuuuuguacgcccaggcuagcgggcguauuacugugucuaccaagagaucccaacagacaguaauuccaaacaucggaucaaggccccggguucgcaauauaccuagcagaauuaguaucuauuggaccauugugaaaccaggugauauccugcuaaucaacucuacgggcaaucucauugccccgaggggguacuucaagauacgguccggaaagagcucgaucaugcgcucugacgcgcccauuggcaaauguaacuccgagugcaucacuccuaaugguucaauaccaaacgacaagcccuuucagaaugucaaccgaauuacauacggggcauguccuagauaugugaaacagaauacccugaagcuggccacuggaaugaggaacgugccagaaaaacaaacacggggcaucuucggcgcuaucgccggguuuauugagaauggaugggaagguauggucgauggcugguacggguuccgucaccagaacagugagggaaucggccaggcagcugaccuuaagagcacccaagccgcgauugaucagauaaaugguaaauugaaccgccucaucgggaagacgaacgagaaguuccaucagauugaaaaagaguuuuccgaaguugagggcagaauccaggaccuggaaaaguauguggaggauaccaaaaucgacuuauggucuuacaaugccgagcugcucguagcacuugaaaaccaacacacaauugaucugacugacagcgagaugaauaaguuguucgaaaggaccaaaaagcagcuacgggagaacgcugaagauaugggaaauggcugcuuuaagauauaucauaaaugugacaacgccugcaucgggucaauucgaaauggaacauacgaucacgacguguaucgcgacgaggcucugaacaauagauuccagaucaagggugucgagcucaaaaguggcuacaaggauuggauucuguggaucuccuuugccauaagcugcuuccuucuguguguggcauugcucggguuuaucaugugggccugccagaaaggaaacauuagguguaauaucugcauuuga

SEQ ID NO: 130884 - RNA, 1701 nt, Artificial Sequence
  derived and/or modified sequence opt3 from hemagglutinin__InfluenzaA__AFJ78023
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggaaguccaacaauucauuuuucagucgccugaacuggcucacucauuuaaaauuuaaguauccagcacugaaugugaccaugcccaacaacgagaaauucgacaaguuguacaucuggggcguccaccauccuggcacagauaaugaccagauuuuucuuuaugcccaggcuagcgggcgaaucacugugucuaccaaacguucccaacagacaguaauuccaaacaucggaucaagacccaggguucggaauauaccuagccgcauuaguaucuacuggaccauugugaagccaggugauauccugcuaaucaacucuacgggcaaucucauugccccgagaggguacuucaagauaagguccggaaaaagcucgaucaugcggucugacgcgcccauuggcaaguguaacuccgagugcaucacuccuaaugguucaauaccaaacgacaaacccuuucagaaugucaaccgcauuacauauggggcauguccucgauacgugaagcagaauacccugaaacuugccacuggaaugagaaacgugccagaaaagcaaacaaggggcaucuucggcgcuaucgccggguuuauugagaauggaugggaagguauggucgauggcugguauggguuccggcaccagaacagugagggaaucggccaggcagcugaccugaaaagcacccaagccgcgauuaaucagauaaacgguaaguugaaccgucucaucgggaagacgaaugagaaauuccaccagauugaaaaggaguuuuccgaaguugagggccgcauccaggaucuggaaaaauacguggaggacaccaagaucgauuuauggucuuauaacgccgagcugcucguagcacuugaaaaucaacauacaauugaccugacugauagcgagaugaacaaauuguucgaaagaaccaagaagcagcuaagggagaaugcugaagacaugggaaacggcugcuuuaaaauauaccacaagugugauaaugccugcaucgggucaauucggaacggaacauaugaccaugauguguaccgagacgaggcucugaauaaccgcuuccagaucaaaggugucgagcucaagaguggcuacaaagacuggauucuguggaucuccuuugccauaagcugcuuccuucuguguguggcauugcucggguuuaucaugugggccugccagaagggaaauauuagauguaacaucugcauuuga

SEQ ID NO: 130885 - RNA, 1701 nt, Artificial Sequence; identical to SEQ ID NO: 122646
  derived and/or modified sequence opt3 from hemagglutinin__InfluenzaA__AFJ78034

SEQ ID NO: 130886 - RNA, 1701 nt, Artificial Sequence
  derived and/or modified sequence opt3 from hemagglutinin__InfluenzaA__AFJ78045
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccagggccuauucuaauuguuaccccuaugacgucccugauuacgcaucguugcggucacucguggccagcagugguacucuggaguuuaacaaugaauccuucaacuggacagggguuacccagaauggaacgucuagcgcuugcaaacgccgauccaacaauucauuuuucagucgucugaacuggcucacucauuuaaaguuuaaguauccagcacugaaugugaccaugcccaacaacgagaaauucgacaaguuguacaucuggggcguccaccauccuggcacagauaaugaccagauuuuucuuuaugcccaggcuagcgggagaaucacugugucuaccaaaaggucccaacagacaguaauuccaaacaucggaucacggccccgcguuagaaauauaccuagcaggauuaguaucuacuggaccauugugaagccaggugauauccugcuaaucaacucuacgggcaaucucauugccccgcggggguacuucaaaauacgcuccggaaagagcucgaucaugcgaucugacgcgcccauuggcaaguguaacuccgagugcaucacuccuaaugguucaauaccaaacgacaaacccuuucagaaugucaacagaauuacauauggggcauguccuagguacgugaagcagaauacccugaaacuugccacuggaaugcggaacgugccagaaaagcaaacacguggcaucuucggcgcuaucgccggguuuauugagaauggaugggaagguauggucgauggcugguauggguuccgccaccagaacagugagggaaugggccaggcagcugaccugaaaagcacccaagccgcgaucaaucagauuaacgguaaguugaacagacucauagggaaaacgaaugagaaguuccaccagaucgaaaaggaguuuuccgaaguugagggcaggauucaggaucuggaaaaauacguggaggacaccaagaucgauuuauggucuuauaacgccgagcugcucguagcacuugaaaaucaacauacaaucgaccugacugauagcgagaugaacaaauuguucgaacggaccaagaaacagcuacgagagaaugcugaagacaugggaaacggcugcuuuaagauuuaccacaagugugauaaugccugcauagggucaauccgcaacggaacauaugaccaugauguguacagagacgaggcucugaauaacagguuccagauuaaaggugucgagcucaagaguggcuacaaagacuggauccuguggauuuccuuugccaucagcugcuuccuucuguguguggcauugcucggguuuauaaugugggccugccagaagggaaauaucaaauguaacauuugcaucuga

SEQ ID NO: 130887 - RNA, 1701 nt, Artificial Sequence; identical to SEQ ID NO: 122646
  derived and/or modified sequence opt3 from hemagglutinin__InfluenzaA__AFJ78056

SEQ ID NO: 130888 - RNA, 1701 nt, Artificial Sequence
  derived and/or modified sequence opt3 from hemagglutinin__InfluenzaA__AFJ78067
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggacgcagcucgaucaugcgaucugacgcgcccauuggcaaguguaacuccgagugcaucacuccuaaugguucaauaccaaacgacaaacccuuucagaaugucaacagaauuacauauggggcauguccuagguacgugaagcagaauacccugaaacuugccacuggaaugcggaacgugccagaaaagcaaacacguggcaucuucggcgcuaucgccggguuuauugagaauggaugggaagguauggucgauggcugguauggguuccgccaccagaacagugagggaaucggccaggcagcugaccugaaaagcacccaagccgcgauuaaucagauaaacgguaaguugaacagacucaucgggaaaacgaaugagaaguuccaccagauugaaaaggaguuuuccgaaguugagggcaggauccaggaucuggaaaaauacguggaggacaccaagaucgauuuauggucuuauaacgccgagcugcucguagcacuugaaaaucaacauacaauugaccugacugauagcgagaugaacaaauuguucgaacggaccaagaaacagcuacgagagaaugcugaagacaugggaaacggcugcuuuaagauauaccacaagugugauaaugccugcaucgggucaauucgcaacggaacauaugaccaugauguguacagagacgaggcucugaauaacagguuccagaucaaaggugucgagcucaagaguggcuacaaagacuggauucuguggaucuccuuugccauaagcugcuuccuucuguguguggcauugcucggguuuaucaugugggccugccagaagggaaauauucgguguaacaucugcauuuga

SEQ ID NO: 130889 - RNA, 1701 nt, Artificial Sequence
  derived and/or modified sequence opt3 from hemagglutinin__InfluenzaA__AFJ78078
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagauuuuucuuuaugcccaggcuagcgggcguaucacugugucuaccaagagaucccaacagacaguaauuccaaacaucggaucaaggccccggguucgcaauauaccuagcagaauuaguaucuacuggaccauugugaaaccaggugauauccugcuaaucaacucuacgggcaaucucauugccccgaggggguacuucaagauacgguccggaaagagcucgaucaugcgcucugacgcgcccauugacaaauguaacuccgagugcaucacuccuaauggcucaauaccaaacgauaagcccuuucagaaugucaaccgaauuacauauggugcauguccuagauacgugaaacagaauacccugaaguuggccacugggaugaggaacgugccagaaaaacaaacacggggaaucuucggcgcuaucgccggcuuuauugagaaugggugggaaggaauggucgacgguugguauggcuuccgucaccagaacagugaggggaucggacaggcagcugaucugaaaagcacccaagccgcgauugaccagauaaauggcaaauugaaccgccucaucgguaagacgaacgagaaguuccaccagauugaaaaagaguuuuccgaaguugaggggagaauccaggaucuggaaaaguacguggaggacaccaaaaucgauuuauggucuuauaaugccgagcugcucguagcacuugaaaaccaacauacaauugaccugacugauagcgagaugaauaaguuguucgaaaagaccaagaagcagcuaagggagaacgcugaagacaugggcaauggaugcuuuaaaauauaccacaagugugauaacgccugcaucggcucaauucggaaugggacauaugaccaugacguguaccgagaugaggcucugaacaaucgcuuccagaucaaaggagucgagcucaagagugguuacaaagacuggauucuguggaucuccuuugccauaagcugcuuccuucuguguguggcauugcucggcuuuaucaugugggccugccagaaggggaacauuagauguaauaucugcauuuga

SEQ ID NO: 130890 - RNA, 1701 nt, Artificial Sequence; identical to SEQ ID NO: 130813
  derived and/or modified sequence opt3 from hemagglutinin__InfluenzaA__AFJ78089

SEQ ID NO: 130891 - RNA, 1701 nt, Artificial Sequence; identical to SEQ ID NO: 123844
  derived and/or modified sequence opt3 from hemagglutinin__InfluenzaA__AFJ78100

SEQ ID NO: 130892 - RNA, 1701 nt, Artificial Sequence
  derived and/or modified sequence opt3 from hemagglutinin__InfluenzaA__AFJ78111
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaauuucgacaaguuguacaucuggggcguccaccauccuggcacagauaacgaccagauuuuucuuuaugcccaggcuagcgggcguaucacugugucuaccaaaagaucccaacagacaguaauuccaaauaucggaucaaggccccggguucgcaacauaccuagcagaauuaguaucuacuggaccauugugaagccaggugauauccugcuaaucaauucuacgggcaaccucauugccccgaggggguacuucaaaauacgguccggaaagagcucgaucaugcgcucugacgcgcccauuggcaaguguaauuccgagugcaucacuccuaacgguucaauaccaaaugacaaacccuuucagaacgucaaucgaauuacauauggggcauguccuagauacgugaagcagaacacccugaaacuugccacuggaaugaggaaugugccagaaaagcaaacacggggcaucuucggcgcuaucgccggguuuauugagaacggaugggaagguauggucgauggcugguauggguuccgucaccagaauagugagggaaucggccaggcagcugaccugaaaagcacccaagccgcgauugaucagauaaacgguaaguugaaccgccucaucgggaaaacgaaugagaaguuccaccagauugaaaaggaguuuuccgaaguugagggcagaauccaggaccuggaaaaauacguggaggauaccaagaucgacuuauggucuuauaacgccgagcugcucguagcacuugaaaaucaacauacaauugaucugacugacagcgagaugaacaaauuguucgaaaagaccaaaaagcagcuaagggagaaugcugaagauaugggaaacggcugcuuuaagauauaccacaaaugugacaaugccugcaucgggucaauucggaacggaacauaugaucaugacguguaccgagacgaggcucugaauaaccgcuuccagaucaagggugucgagcucaaaaguggcuacaaggauuggauucuguggaucuccuuugccauaagcugcuuccuucuguguguggcauugcucggguuuaucaugugggccugccagaaaggaaauauuagauguaacaucugcauuuga

SEQ ID NO: 130893 - RNA, 1701 nt, Artificial Sequence
  derived and/or modified sequence opt3 from hemagglutinin__InfluenzaA__AFJ78122
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugaucaaauugagguuacuaacgcgaccgaacuggugcagucuucaaguacagguggcaucugcgacagcccacaccagauacuagauggggagaauuguacccucaucgacgcucugcuuggagauccgcagugcgacggcuuucaaaacaaaaagugggaucuguucguagaaagauccaaagccuauucuaauuguuaccccuaugacgugccugauuacgcaucguugaggucacucgucgccagcagugguacucuggaguuuaacaaugaauccuucaacuggacaggggugacccagaauggaacgucuagcgcuugcaagcggcgcuccaacaauucauuuuucagucgacugaacuggcucacucauuuaaaguuuaaauauccagcacugaauguuaccaugcccaacaacgagaaguucgacaaacuuuacauuuggggcgugcaccauccuggcacagauaaugaccagaucuuuuuguaugcccaggcuagcgggcguauuacugucucuaccaagagaucccaacagacagugaucccaaacauaggaucaaggccccggguacgcaauauuccuagcagaaucaguauuuacuggaccaucguuaaaccaggugauauccugcuaauuaacucuacgggcaaucucauagccccgaggggguacuucaagauccgguccggacgcagcucgauuaugcgaucugacgcgcccaucgacaaguguaacuccgagugcauaacuccuaauggcucaauuccaaacgauaaacccuuucagaaugugaacagaaucacauauggugcauguccuagguacgucaagcagaauacccugaaacuugccacugggaugcggaacgugccagaaaagcaaacacguggaaucuucggcgcuauugccggcuuuaucgagaaugggugggaaggaaugguggacgguugguauggcuuccgccaccagaacagugaggggauuggacaggcagcugaucugaaaagcacccaagccgcgauagaccagaucaauggcaaguugaacagacucauuaggaaaacgaacgagaaguuccaccagaucgaaaaggaguuuuccgaagucgagggucggauccaggaucuggaaaaauacguugaggacaccaagauugauuuauggucuuauaaugccgagcugcucguggcacuugaaaaccaacauacaauagaccugacugauagcgagaugaauaaauuguucgaaaagaccaaaaagcagcuacgagagaacgcugaagacauggggaauggcugcuuuaagaucuaccacaaaugugauaacgccugcauuggaucaauccgcaauggcacauaugaccaugacguauacagagaugaggcucugaacaauagguuccagauuaaggggguggagcucaaaaguggauacaaggacuggauccuguggauauccuuugccaucagcugcuuccuucugugugucgcauugcucgguuuuauuaugugggccugccagaaaggcaacauccgguguaauauuugcaucuga

SEQ ID NO: 130894 - RNA, 1701 nt, Artificial Sequence
  derived and/or modified sequence opt3 from hemagglutinin__InfluenzaA__AFJ78144
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcuccugcauccggcgcucaaacaauagcuuuuucagucgacugaacuggcucacucauuuaaaguuuaaguauccagcucugaaugugaccaugcccaacaacgagaaauucgacaaacuuuacauuuggggaguccaccauccuggcacagauaaugaccagaucuuuuuguaugcacaggccucuggccguauuacuguguccaccaagagaucacaacagacaguaaucccaaacauagggagcaggccccggguucgcaauauuccuaguagaaucucuauuuacuggaccaucgugaagccaggagauauccugcuaauuaacuccacggguaaucucauagcuccgaggggcuacuucaaaauccggagcgggaagucgucuauuaugcgcuccgacgcccccaucggaaaguguaacucagaaugcauaacuccuaauggcaguauuccaaacgacaaacccuuucagaaugucaaccgaaucacauauggugcguguccuagauacgugaagcagaauacccugaaacuugcaacugggaugaggaacgugccagagaagcaaacacggggaaucuucggcgccauugcuggcuuuaucgaaaaugggugggagggaauggucgaugguugguauggcuuccgucaccagaacagcgaggggauuggacaggccgcagaccugaaauccacccaagcugccauagaucagaucaauggcaaguugaaccgccucauugguaaaacgaacgaaaaguuccaccagaucgagaaggaauuuucugagguugaagggagaauccaggaccuggagaaauacguggaggauaccaagguagacuuauggagcuauaaugcggaacugcucguggcccuugagaaccaacauacaauugaucugacugacucagaaaugaauaaauuguucgagaagaccaaaaagcagcuaagggaaaacgcagaggauaugggcaauggaugcuuuaagauauaccacaaaugugacaacgcuugcaucggcaguauucggaaugggacauaugaucaugacgucuaccgagacgaggcccugaacaaucgcuuccagaucaagggaguggaacucaaauccgguuacaaggauuggauucuguggaucagcuuugcuauaucuugcuuccuucuguguguugccuugcucggcuuuaucaugugggcaugccagaaagggaacauuagauguaauaucugcauuuga

SEQ ID NO: 130895 - RNA, 1701 nt, Artificial Sequence; identical to SEQ ID NO: 130894
  derived and/or modified sequence opt3 from hemagglutinin__InfluenzaA__AFJ78155

SEQ ID NO: 130896 - RNA, 1701 nt, Artificial Sequence
  derived and/or modified sequence opt3 from hemagglutinin__InfluenzaA__AFJ78166
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacagaauacccugaagcuggccacugggaugaggaacgugccagaaaaacaaacacggggaaucuucggcgcuauugccggcuuuaucgagaaugggugggagggaauggucgaugguugguauggcuuccgucaccagaacagugaagggauuggacaggcagcugaccuuaagagcacccaagccgcgauagaucagaucaauggcaaauugaaccgccucauugguaagacgaacgagaaauuccaccagaucgaaaaggaguuuuccgaaguugaggggagaauccaggaccuggagaaguacguggaagauaccaaaauugacuuauggucuuauaaugccgagcugcucguagcacuugaaaaccaacauacaauagaucugacugacagcgagaugaauaaguuguucgagaaaaccaagaggcagcuacgggaaaacgcugaggauaugggcaauggaugcuuuaaaaucuaccacaagugugacaacgccugcauuggcucaauccgaaaugggacauaugaucaugacguguaccgcgacgaagcucugaacaauagauuccagauuaagggagucgagcucaaaagugguuacaaggauuggauccuguggauauccuuugccaucagcugcuuccuucuguguguggcauugcucggcuuuauuaugugggccugccagaaagggaacaucagguguaauauuugcaucuga

SEQ ID NO: 130897 - RNA, 1701 nt, Artificial Sequence; identical to SEQ ID NO: 123745
  derived and/or modified sequence opt3 from hemagglutinin__InfluenzaA__AFJ78177

SEQ ID NO: 130898 - RNA, 1701 nt, Artificial Sequence
  derived and/or modified sequence opt3 from hemagglutinin__InfluenzaA__AFJ78188
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaaaagaucccaacagacaguaaucccaaacauagggucaaggccccggauucgcaauaucccuagcagaauuaguaucuacuggaccaucguuaagccaggagauauucugcuaauaaacucuacggguaaucucaucgccccgaggggcuacuucaaaauucgguccggaaagagcucgaucaugcgcucugacgcgcccauagggaaguguaacuccgaaugcauuacuccuaauggcucaaucccaaacgacaaacccuuucagaaugugaaccgaaucacauauggugcauguccuagauacgucaagcagaauacccugaaacuugccacugggaugaggaacgugccagagaagcaaacacggggaauuuucggcgcuaucgccggcuuuauugaaaaugggugggagggaaugguggaugguugguauggcuuccgucaccagaacagugaggggaccggacaggcagcugaccugaaaagcacgcaagccgcgauagaucagaucaauggcaaguugaaccgccucauugguaaaaccaacgaaaaguuccaccagaucgagaaggaauuuuccgaggucgaagggagaauccaggaccuggagaaauacguugaggauacaaagauugacuuauggucuuauaaugccgaacugcucguggcacuugagaaccaacauacuauagaucugaccgacagcgaaaugaauaaauuguucgagaagacaaagaagcagcuaagggaaaacgcugaggauaugggcaauggaugcuuuaagaucuaccacaaaugugacaacgccugcauuggcucaauccggaaugggacuuaugaucaugacguauaccgagacgaggcucugaacaaucgcuuccagauuaagggaguggaacucaaaagugguuacaaggauuggauccuguggauauccuuugccaucagcugcuuccuucugugugucgcauugcucggcuuuauuaugugggccugccagaaagggaacaucagauguaauauuugcaucuga

SEQ ID NO: 130899 - RNA, 1701 nt, Artificial Sequence
  derived and/or modified sequence opt3 from hemagglutinin__InfluenzaA__AFJ78210
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaaaagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggaccggacaggcagcugaccugaaaagcacgcaagccgcgauugaucagauaaauggcaaguugaaccgccucaucgguaaaaccaacgaaaaguuccaccagauugagaaggaauuuuccgagguugaagggagaauccaggaccuggagaaauacguggaggauacaaagaucgacuuauggucuuauaaugccgaacugcucguagcacuugagaaccaacauacuauugaucugaccgacagcgaaaugaauaaauuguucgagaagacaaagaagcagcuaagggaaaacgcugaggauaugggcaauggaugcuuuaagauauaccacaaaugugacaacgccugcaucggcucaauucggaaugggacuuaugaucaugacguguaccgagacgaggcucugaacaaucgcuuccagaucaagggaauugaacucaaaagugguuacaaggauuggauccuguggauauccuuugccaucagcugcuuccuucugugugucgcauugcucggcuuuauuaugugggccugccagaaagggaacaucagauguaauauuugcaucuga

SEQ ID NO: 130900 - RNA, 1701 nt, Artificial Sequence; identical to SEQ ID NO: 130824
  derived and/or modified sequence opt3 from hemagglutinin__InfluenzaA__AFJ78221

SEQ ID NO: 130901 - RNA, 1701 nt, Artificial Sequence
  derived and/or modified sequence opt3 from hemagglutinin__InfluenzaA__AFJ78232
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguaaaauuugcgacagcccacaccagauccuagauggcgagaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaacaauucauuuuucagucgacugaacuggcucacucauuuaaaguuuaaauauccagcacugaaugugaccaugcccaacaacgaggaguucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggaccggacaggcagcugaccugaaaagcacgcaagccgcgauugaucagauaaauggcaaguugaaccgccucaucgguaaaaccaacgaaaaguuccaccagauugagaaugaauuuuccgagguugaagggagaauccaggaccuggagaaguacguggaggauacaaaaaucgacuuauggucuuauaacgccgaacugcucguagcacuugagaaucaacauacuauugaucugaccgacagcgaaaugaacaaguuguucgagaaaacaaagaaacagcuaagggaaaaugcugaggauaugggcaacggaugcuuuaagauauaccacaagugugacaaugccugcaucggcucaauucggaacgggacuuaugaucaugacguguaccgagacgaggcucugaauaaccgcuuccagaucaaaggagucgaacucaagagugguuacaaagauuggauucuguggaucuccuuugccauaagcugcuuccuucuguguguggcauugcucggcuuuaucaugugggccugccagaaggggaauauuagauguaacaucugcauuuga

SEQ ID NO: 130902 - RNA, 1701 nt, Artificial Sequence
  derived and/or modified sequence opt3 from hemagglutinin__InfluenzaA__AFJ78243
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccuggcacagauaaugaccagaucuuuuuguaugccaaggcuagcggccguauuacugugucuaccaaaagaucccagcaaacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccgucgggaaguguaacuccgaaugcaucacuccuaauggcucaauaccaaacgacaaacccuuucagaaugugaaccgaauuacauauggugcauguccuagauacgugaagcagaauacccugaaacuugccacugggaugaggaacgucccagaaaagcagacacggggaaucuucggcgcuaucgccggcuuuauugagaaugggugggagggaaugguugaugguugguauggcuuccgucacaaaaacagugaagggaccggacaagcagcugaccugaaaagcacgcaggccgcgaucgaucagauuaauggcaaauugaaccgccucauagguaagaccaacgagaaguuccaccaaaucgaaaaagaguuuuccgaaguggaggggaggauucaggaccuggagaaguacguagaagauacaaaaaucgacuuauggucuuauaaugccgagcugcucguggcacuugaaaaccagcauacuaucgaucugaccgacagcgagaugaauaaguuguucgaaaagacaaagaagcagcuaagagagaacgcugaggauaugggcaauggaugcuuuaaaauuuaccacaagugugacaacgccugcauaggcucaauccggaaugggacuuaugaucaugacgucuaccgagacgaagcucugaacaaucgcuuccaaauuaaaggaguggagcucaagagugguuacaaagauuggauccuguggauuuccuuugccaucagcugcuuccuucuguguguugcauugcucggcuuuauaaugugggccugccagaaggggaacaucagauguaauauuugcaucuga

SEQ ID NO: 130903 - RNA, 1701 nt, Artificial Sequence
  derived and/or modified sequence opt3 from hemagglutinin__InfluenzaA__AFJ78254
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacagaauacccugaagcuggccacugggaugaggaacgugccagaaaaacaaacacggggaaucuucggcgcuauugccggcuuuaucgagaaugggugggagggaauggucgaugguugguauggcuuccgucaccagaacagugaagggauuggacaggcagcugaccuuaagagcacccaagccgcgauagaucagaucaauggcaaauugaaccgccucauugguaagacgaacgagaaauuccaccagaucgaaaaggaguuuuccgaaguugaggggagaauccaggaccuggagaaguacguggaagauaccaaaguagacuuauggucuuauaaugccgagcugcucguggcacuugaaaaccaacauacaauugaucugacugacagcgagaugaauaaguuguucgagaaaaccaagaaacagcuaagggaaaacgcugaggauaugggcaauggaugcuuuaagauauaccacaagugugacaacgccugcaucggcucaauucggaaugggacauaugaucaugacgucuaccgagacgaagcucugaacaaucgcuuccagaucaaaggaguggagcucaagagugguuacaaagauuggauucuguggaucuccuuugccauaagcugcuuccuucuguguguugcauugcucggcuuuaucaugugggccugccagaaggggaacauuagauguaauaucugcauuuga

SEQ ID NO: 130904 - RNA, 1701 nt, Artificial Sequence; identical to SEQ ID NO: 130903
  derived and/or modified sequence opt3 from hemagglutinin__InfluenzaA__AFJ78265

SEQ ID NO: 130905 - RNA, 1701 nt, Artificial Sequence
  derived and/or modified sequence opt3 from hemagglutinin__InfluenzaA__AFJ78276
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagaaauucgacaaacuuuacauuuggggaguccaccauccuggcacagauaaugaccagaucuuuuuguaugcccaggcuagcggccguauuacugugucuaccaagagaucccaacagacaguaaucccaaacauagggucaaggccccggguucgcaauauuccuagcagaaucaguauuuacuggaccaucgugaagccaggagauauccugcuaauuaacucuacggguaaucucauagccccgaggggcuacuucaaaauccgguccggaaagagcucgauuaugcgcucugacgcgcccaucgggaaguguaacuccgaaugcauaacuccuaauggcucaauuccaaacgacaaacccuuucagaaugucaaccgaaucacauauggugcauguccuagauacgugaagcagaauacccugaaacuugccacugggaugaggaacgugccagagaagcaaacacggggaaucuucggcgcuauugccggcuuuaucgaaaaugggugggagggaauggucgaugguugguauggcuuccgucaccagaacagugaggggauuggacaggcagcugaccugaaaagcacccaagccgcgauagaucagaucaauggcaaguugaaccgccucauugguaaaacgaacgaaaaguuccaccagaucgagaaggaauuuuccgagguugaagggagaauccaggaccuggagaaauacguggaggauaccaagguagacuuauggucuuauaaugccgaacugcucguggcacuugagaaccaacauacaauugaucugacugacagcgaaaugaauaaauuguucgagaagaccaaaaagcagcuaagggaaaacgcugaggauaugggcaauggaugcuuuaagauauaccacaaaugugacaacgccugcaucggcucaauucggaaugggacauaugaucaugacgucuaccgagacgaggcucugaacaaucgcuuccagaucaagggaguggaacucaaaagugguuacaaggauuggauucuguggaucuccuuugccauaagcugcuuccuucuguguguugcauugcucggcuuuaucaugugggccugccagaaagggaacauuagauguaauaucugcauuuga

SEQ ID NO: 130906 - RNA, 1701 nt, Artificial Sequence
  derived and/or modified sequence opt3 from hemagglutinin__InfluenzaA__AFJ78287
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauggacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauacggcgcuccaagaacucauuuuucagucgacugaauuggcucacucauuuaaacuuuaaauauccagcacugaaugugaccaugcccaacaacgagcaguucgacaaacuuuacaucuggggaguccaccauccuggcacagauaaagaccagauuuuuccauaugcccaagcuagcggccguaucacugugucuaccaagagaucccagcagacaguaauucccaauaucgggucaaggccucggguucgcaacauaccaagcagaauuaguaucuacuggaccauugugaaaccgggagauaucuugcugaucaauucuacggguaaccuaauugcccccaggggcuacuucaagauacgguccggaaagagcucgaucaugcgcucugacgcgccuauugggaaauguaauuccgagugcaucacuccaaacggcucaauacccaaugacaagccuuuucagaacgucaaucgaauuacauauggugcauguccaagauacgugaaacaaaacacccucaagcuggccacugggaugaggaaugugcccgaaaaacagacacggggaaucuucggcgcuaucgccggcuuuauugagaacgggugggaaggaauggucgaugguugguauggcuuccgucaccagaauagugaggggcgcggacaagcagcugaccuuaagagcacccaggccgcgaucgaucagauuaacggcaaacugaauagauugauagguaagacgaacgagaaguuccaccagaucgaaaaagaguuuuccgaaguugaggggaggauucaagaccucgaaaaguacguggaggauaccaaaaucgaccuguggucuuauaacgccgaguuacugguagcacucgaaaaucagcauacaaucgaucuuacugacagcgagaugaacaagcuguucgaaaagaccaagaagcaguugcgggagaaugcugaagauaugggcaacggaugcuuuaaaauuuaccacaagugugacaaugccugcauaggcucaauccgaaacgggacauaugaucaugacguguaccgcgacgaggcucuaaauaacagauuccagauuaaaggagucgagcugaagagugguuacaaagauuggauccucuggauuuccuuugccaucagcugcuuccugcuuuguguggcacuguugggcuuuauaaugugggccugccaaaaggggaauaucagguguaacauuugcaucuga

SEQ ID NO: 130907 - RNA, 1698 nt, Artificial Sequence
  derived and/or modified sequence opt3 from hemagglutinin__InfluenzaA__AFJ78309
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagagaaggaaguacugguucuauggggcgugcaucacccuucaaacaucggcgaucagcgcgccauauaccacacugagaacgcuuaugucagcguggugaguucucauuacucccgacguuucaccccagaaaucgcaaaaagacccaaggucagggaccaggaggggcggauuaauuauuacuggacacuccuggagccuggagauacuaucauuuuugaagccaacgguaaucuuaucgcuccaugguaugccuucgcgcugagccgcggcuuugggucgggaauaauuaccucuaacgcaccgauggacgagugugaugccaagugccagacaccccaaggcgcuaucaauuccucauugccuuuccagaacguucacccaauuaccaucggugaaugucccaaauacgugagaagugccaagcucaggaugguaacggggcugcggaauaucccuagcauucagucccgcggauuauuuggcgcaauagcuggcuucaucgaagggggauggacugguaugauugacggcugguauggguaccaucaccagaacgaacaaggaucuggcuacgccgcggaucagaaaagcacacagaaugccaucaacgguauaaccaauaaggugaacucagucauugagaaaaugaauacucaguuuacagcaguggggaaggaguucaacaaacuggaacgaagaauggagaaucucaacaagaagguugacgauggcuuccuugacaucuggaccuauaacgcugaacuguuggugcuacuggagaaugaaaggacgcucgacuuucacgauaguaacgucaaaaaucuguacgagaaggugaaaucccaacuuaagaacaaugccaaagagaucggaaacggcugcuucgaauuuuaucauaaguguaauaacgagugcauggaaagcguaaagaaugggaccuacgacuauccaaaauacucugaggagucaaagcugaaccgggagaaaauugauggaguuaaguuggaaaguauggguguguaucagauccucgcuauuuacagcacagucgccuccucucugguguuacuggucucgcuaggcgcaaucagcuucuggaugugcuccaaugggucacuccagugucguauaugcauuuga

SEQ ID NO: 130908 - RNA, 1701 nt, Artificial Sequence
  derived and/or modified sequence opt3 from hemagglutinin__InfluenzaA__AFJ78320
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccaacaagucauuuuucagucgucucaauugguuacaccagcugaaguauaaauacccagcccuuaacgugacgaugcccaauaacgagaaguuugacaaauuguauauauggggaguccaucacccuagcacugauucugaccagaucucccuguacgcucaggccucaggcagagugaccguaagcacaaagaggagucaacagacuguuauuccaaacaucggcucucggcccugggugcgcggggucuccagcagaauuucgaucuacuggaccauagugaaaccuggagauauucuacucaucaauucuacagguaaccugauugcgccaaggggcuauuucaagauccgguccgggaagucaaguaucaugcgcagcgacgcaccgauuggaaaauguaauuccgaaugcauaacccccaacggcucuaucccuaaugacaagccauuucagaacgugaaucgaauuacguacggugccugucccagauaugucaaacagaacacucuuaagcuggcuacagggaugaggaauguuccugagaaacaaacccggggaaucuucggcgccauagcaggcuuuauugaaaacgggugggagggaaugguggaugguugguacggcuuccgucaccagaauagcgaggggacuggacaggcugccgacuugaagucaacacaagcggccaucaaccagaucaauggcaaacucaaccgccugauugguaagaccaaugaaaaguuucaucagaucgagaaagaguucagugaaguagaagggaggauucaggauuuagagaaguauguggaggacacgaaaauagaucugugguccuacaacgcagaacuccuugucgcucuggagaaccaacacaccaucgacuugacagauagcgaaaugaauaagcuauucgagagaacuaaaaagcagcugcgggaaaacgccgaggacaugggcaauggaugcuuuaagauuuaucauaaaugugauaacgcuugcaucggcucuauccgaaaugggaccuacgaccacgauguguaccgcgacgaggcccucaacaauagauuccagauuaagggaguugaacugaaaucagguuauaaggacuggauacuuuggaucaguuuugcaauuagcugcuuccuguugugugugguccuccugggcuuuaucaugugggccugccagaaagggaacauuagguguaauaucugcauauga

SEQ ID NO: 130909 - RNA, 1698 nt, Artificial Sequence
  derived and/or modified sequence opt3 from hemagglutinin__InfluenzaA__AFJ78331
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggcaaaaacggauuguaucccaaucugagcaagucuuacgugaacaauaaagaaaaggagguucuaguacucuggggcgugcaucacccuccaaacaucggggaucagcgcgcccuguaccacacugaaaacgcuuaugucuccguggugucaagccauuacagucgacguuucacccccgagauagcaaaaagaccuaaggucagggaccaggaaggacggaucaauuauuacuggacacuucuggagccaggugauacuauuaucuuugaggccaacggcaauuugauugcuccgugguaugccuucgcgcucucucgcggguuuggauccggcaucauaaccagcaacgcacccauggacgaaugugaugccaagugccagacaccucaaggugcuauuaauucgucucugccauuccagaacguucaccccgugaccaucggggaguguccuaaauacguaagauccgccaaguuaaggauggugacgggacugcggaauauuccaucaauccagagucgcggccucuuuggcgcaaucgcuggguucauugaaggagguuggacuggcauggucgacgggugguauggauaccaucaccagaacgagcaaggcagcgguuacgccgcggaucagaaauccacacagaaugccauaaacgggaucaccaauaaggugaacucuguuauugaaaagaugaauacucaguuuacagcagugggcaaagaguucaacaaacuugagcgaagaauggaaaaucugaacaagaaggucgacgauggauucuuggacaucuggaccuauaacgcugagcuacuggugcuccuggaaaaugagaggacgcuugacuuucacgauagcaacguuaaaaaucuguacgaaaagguaaaaucacaauugaagaacaaugccaaagagauaggcaacgggugcuucgaguuuuaucauaaguguaauaacgaaugcauggagagugugaagaauggaaccuacgacuaucccaaauacuccgaagagagcaagcucaaccgggagaaaauugauggugucaagcuggaaucuaugggcguguaucagaucuuagcuaucuacucaacagucgccaguagccuggugcuacucguuucccugggggcaauuucuuucuggaugugcucgaauggaagccuucagugucguaucugcauuuga

SEQ ID NO: 130910 - RNA, 1698 nt, Artificial Sequence; identical to SEQ ID NO: 130909
  derived and/or modified sequence opt3 from hemagglutinin__InfluenzaA__AFJ78342

SEQ ID NO: 130911 - RNA, 1698 nt, Artificial Sequence; identical to SEQ ID NO: 130909
  derived and/or modified sequence opt3 from hemagglutinin__InfluenzaA__AFJ78353

SEQ ID NO: 130912 - RNA, 1698 nt, Artificial Sequence
  derived and/or modified sequence opt3 from hemagglutinin__InfluenzaA__AFJ78364
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagagaaggaaguacugguucuauggggcgugcaucacccuucaaacaucggcgaucagcgcgccauauaccacacugagaacgcuuaugucagcguggugaguucucauuacaaucgacguuucaccccagaaaucgcaaaaagacccaaggucaggaaccaggaggggcggauuaauuauuacuggacacuccuggagccuggagacacuaucauuuuugaagccaacgguaaucuuaucgcuccaugguaugccuucgcgcugucccgcggcuuugggagcggaauaauuaccucgaacgcaccgauggaugagugugacgccaagugccagacaccccaaggcgcuaucaauucuuccuugccuuuccagaacguucacccaauuaccaucggugaaugucccaaauacgugagaucagccaagcucaggaugguaacggggcugcggaauaucccuaguauucagagccgcggauuauuuggcgcaauagcuggcuucaucgaagggggauggacugguaugauugauggcugguauggguaccaucaccagaacgaacaaggauccggcuacgccgcggaccagaaaucuacacagaaugccaucaacgguauaaccaauaaggugaacagcgucauugagaaaaugaauacucaguuuacagcaguggggaaggaguucaacaaacuggaacgaagaauggagaaccucaauaagaagguugaugacggcuuccuugauaucuggaccuauaacgcugaacuguuggugcuacuggagaaugaaaggacgcucgacuuucacgacucaaacgucaaaaaucuguacgagaaggugaaaagucaacuuaagaacaaugccaaagagaucggaaacggcugcuucgaauuuuaucauaaguguaauaacgagugcauggaauccguaaagaaugggaccuacgauuauccaaaauacagcgaggagucuaagcugaaccgggagaaaauugacggaguuaaguuggaaucaauggguguguaucagauccucgcuauuuacaguacagucgccagcucccugguguuacuggucucucuaggcgcaauaucguucuggaugugcagcaaugggucccuccagugucguaucugcauuuga

SEQ ID NO: 130913 - RNA, 1698 nt, Artificial Sequence
  derived and/or modified sequence opt3 from hemagglutinin__InfluenzaA__AFJ78375
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccauaaauuuacuggaaaacucucacaaugggaaacuaugccuccugaagggaaucgcgccccuucagcuggguaacuguucaguggcuggcuggauuuuggggaauccugagugcgaacuccugaucaguaaagagagcugguccuacauugucgaaaccccaaacccggagaauggaacuuguuaucccggccauuuugccgauuacgaggaacugagagagcaacucucuucggugagcucauucgaaagguuugagaucuucccuaaggagaguuccuggccaaaccacacaguuaccggugugucugcaagcugcucccauaaugggaagucaaguuuuuaucggaacuuacuguggcuuacggagaaaaauggauuguaccccaaccugagcaagucuuaugucaauaacaaagagaaggaagugcuaguacucuggggcguucaccacccuuccaacauaggcgaccagcgcgccaucuaccauacugagaaugcuuacgugucagucgugagcagucacuauucucgacguuucaccccagaaauugugaaaagacccaaggucagggaucaggaggggcggaucaacuacuauuggacacugcuugagccuggagacacuauuaucuuugaagcaaaugguaaccugauagccccaugguacgcuuucgccuugucccgcggcuuugggagcggaauuaucaccucgaaugcgccgauggaugagugugacgcaaagugccagacaccccaaggcgccauuaacucuucccucccuuuccagaauguucauccagugaccaucggugaaugucccaaauauguaagaucagcuaagcugaggauggugacgggguuacggaacaucccuaguauucagagccgcggacuguuuggcgccauagcaggcuucaucgaagggggauggacugguaugauugauggcugguacggguaucaccaccagaaugaacaaggauccggcuacgcugccgaccagaaaucuacacagaacgcgaucaaugguauaaccaacaaggucaauagcauuaucgagaaaaugaacacucaguuuacagccguggggaaggaguucaauaaacucgaacgaagaauggagaaccuuaacaagaagguugaugacggcuuccuggauaucuggaccuacaaugcagaauugcuagugcugcucgagaacgaaaggacgcuggacuuucaugacucaaaugucaaaaaccuuuaugagaaggugaaaagucaacugaagaauaacgcuaaagagauuggaaauggcugcuucgaauuuuaccacaaguguaacaaugagugcauggaauccguaaagaacgggaccuaugauuacccaaaauauagcgaggagucuaaguugaaucgggagaaaaucgacggaguuaagcucgaaucaauggguguguaccagauucuggccauauauaguacagucgcuagcuccuuagugcugcuagucucucucggcgccaucucguucuggaugugcagcaacgggucccugcagugucguauuugcaucuga

SEQ ID NO: 130914 - RNA, 1698 nt, Artificial Sequence; identical to SEQ ID NO: 123401
  derived and/or modified sequence opt3 from hemagglutinin__InfluenzaA__AFJ78386

SEQ ID NO: 130915 - RNA, 1698 nt, Artificial Sequence; identical to SEQ ID NO: 123401
  derived and/or modified sequence opt3 from hemagglutinin__InfluenzaA__AFJ78397

SEQ ID NO: 130916 - RNA, 1698 nt, Artificial Sequence; identical to SEQ ID NO: 130093
  derived and/or modified sequence opt3 from hemagglutinin__InfluenzaA__AFJ78408

SEQ ID NO: 130917 - RNA, 1698 nt, Artificial Sequence
  derived and/or modified sequence opt3 from hemagglutinin__InfluenzaA__AFJ78419
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggcuacuuugcugacuaugaggaacugagagagcaacucucuucggugagcucauucgaaagguuugagauuuucccuaaggagaguuccuggccaaaucauacugucacaggugugucugccagcugcucccacaacgggaaaucaaguuuuuacaagaauuuacuguggcuuaccggcaaaaacggauuguaucccaaucugagcaagucuuacgcaaacaauaaagaaaaggagguucuaguacucuggggcgugcaucacccuccaaacaucggggaucagcgggcccuguaccacacggaaaacgcuuaugucuccguggugucaagccauuacagucgcaaguucacucccgagauagcaaaacgaccuaagguccgugaccaggaaggaagaaucaauuauuacuggacccuucuggagccaggugauacaguuauuuuugaggccaacggcaauuugaucgcuccgagguaugccuucgcgcucucucggggguuuggauccggcauuaucaacagcaaugcacccauggacgaaugugaugccaaaugccagacuccucaaggugcuauaaacucgucucugccauuccagaaugugcaccccguaaccauuggggaguguccuaaguacgugcgcuccgccaaauuaagaauggucacaggacugaggaacaucccaucaauucagagucggggccucuuuggcgcaaucgcuggguucaucgaaggagguuggaccggcaugguggacgggugguauggauaccaucaccagaaugagcaaggcagcgguuacgccgcggaucagaaguccacgcagaacgccauuaaugggauaacuaacaaaguuaauucugugaucgaaaagaugaacacacaguuuaccgcagucggcaaggaguucaauaaacuugagcgccgaauggaaaaccugaacaagaaaguggacgauggauucauugacaucuggacuuauaaugcugaguugcuaguacugcucgaaaacgagagaacacuggacuuucacgauagcaauguuaagaaccuuuacgaaaaagugaagucacaacugaagaauaacgccaaagagauaggcaaugggugcuucgaguuuuaucauaaguguaacgacgaaugcauggagagugucaaaaauggaaccuacgauuaucccaaguacuccgaagagagcaaauugaacagggagaagauugacggugugaagcucgaaucuaugggcgucuaucagauccuggcuaucuacucaacgguggccaguagcuuaguucugcuagugucccucggggcaauuucuuucuggaugugcucgaauggaagccugcagugucggaucugcauuuga

SEQ ID NO: 130918 - RNA, 1698 nt, Artificial Sequence
  derived and/or modified sequence opt3 from hemagglutinin__InfluenzaA__AFJ78430
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaauccaaacccggagaauggaaccuguuaucccggccauuuugcugacuacgaggaacugagggagcaacucucuucggugagcucauucgaacgguuugagauuuucccuaaagagaguuccuggccaaaccacacugucacaggugugucugccagcugcucccauaaugggaagucaaguuuuuauaagaacuuacuguggcuuaccggaaagaauggcuuguaccccaaccugagcaagucuuaugcaaauaacaaagaaaaggagguucuaguacucuggggcgugcaccacccuccaaacaucggggaucagcgcgcccuguaccauacggaaaaugcuuacgucuccguggugucaagccacuauagucgaaaauucacucccgagauagcaaagcguccuaaggucagagaccaggaaggaaggaucaacuacuauuggacccuucuggguccaggcgauacaauuaucuuugaggccaaugggaacuugauugcuccgcgguacgccuucgcgcucucucgcggauuuggcuccgguaucauaaauagcaacgcacccauggacgagugugaugccaaaugccagacuccucaaggggcuauuaauucgucucugccauuccagaacguucaucccgugaccaucggagaauguccuaaguauguaagauccgccaaauuaaggauggugacaggccugcggaauauuccaucaauccagagucgcggccucuuuggggcaaucgcuggauucauugaggguggcuggaccgggauggucgacggaugguacggcuaucaccaccagaacgaacaagguagcggguacgccgcggaucagaaguccacgcagaaugccauaaacggcaucacuaauaaagugaacucuguuauugagaagaugaauacacaguuuaccgcagugggaaaagaguucaacaaacuugaacgaagaauggagaaccugaauaagaaagucgacgauggcuucaucgacauauggacuuacaacgcugaauugcuagugcugcucgagaaugaaaggacacuggacuuucaugauagcaacguaaagaaucuuuaugagaaaguuaagucacaacugaaaaacaaugccaaggaaauugggaacggaugcuucgaguuuuaccacaaguguaaugacgagugcauggaaagugugaaaaacgguaccuaugauuaccccaaguauuccgaggaaagcaaauugaaucgggagaagaucgacggcgucaaacucgagucuauggggguguaccagauccuggcuauuuauucaacggucgccaguagcuuagugcugcuaguuucccucggagcaaucucuuucuggaugugcucgaacggcagccugcagugucguauuugcauauga

SEQ ID NO: 130919 - RNA, 1698 nt, Artificial Sequence
  derived and/or modified sequence opt3 from hemagglutinin__InfluenzaA__AFJ78441
augaaggugaaacugaugguccuccuuugcaccuucacagccacuuacgcugacacgaucuguauuggcuaucacgcaaacaauagcaccgauacaguugacacugugcuggagaagaacguaaccgugacacauuccgucaauuuguuagaagauucucacaacgggaaacugugccuacucaagggaauagcgccccugcagcuugguaauuguucaguggccggcuggauccuggggaacccugagugcgaauugcucauuaguagagagagcugguccuacaucguugaaaaaccaaauccggagaacggaaccuguuaucccggccauuuugcugacuacgaggaacugagggagcaacugucuucggugucaucuuucgaacgguuugagauuuucccuaaggagaguuccuggccaaaucacacugucacaggugugucugccagcugcucccauaacgggaagucaaguuuuuauaaaaaucucuuauggcugaccggaaagaacggccuuuaccccaauuugagcaaaucuuaugcaaacaauaaggaaaaagagguacugguucuauggggcgugcaccacccuccaaacaucggggaucagaaggcccucuaccauacggaaaacgcuuacgucuccguggugucaagccacuauagucgcaaguucacucccgagauagcaaaacgaccuaagguccgugaccaggaaggaagaaucaauuacuauuggacccugcuugagccaggugauacaauuaucuuugaggccaacggcaaucugauugcuccgagguacgccuucgcguugucucggggguuuggauccggcaucauaaacagcaaugcacccauggacgaaugugaugccaaaugccagacuccucaaggugcuauuaacucgucucucccauuccagaauguucaucccgugaccaucggggaguguccuaaguauguacgcuccgccaaacugagaauggugacaggauuaaggaacauuccaucaauccagagucggggccuguuuggcgcaaucgcuggguucauugaaggagguuggaccggcauggucgacgggugguacggauaucaccaccagaaugagcaaggcagcgguuacgccgcggaucagaaguccacgcagaacgccauaaaugggaucacuaacaaagugaauagcguuauugaaaagaugaacacacaguuuaccgcaguggacaaggaguucaauaaacucgagcgccgaauggaaaaccuuaacaagaaagucgaugacggcuucaucgacauauggacuuacaaugcugagcuguuggugcuacuggaaaacgagagaacacucgauuuucaugacagcaauguaaagaaccuguaugaaaaaguuaagucacaacuuaagaauaacgccaaagagauuggaaauggcugcuucgaguuuuaccacaaguguaacgaugaaugcauggagagugugaaaaaugggaccuaugacuaccccaaguauuccgaagagagcaaacugaacagggagaagaucgauggagucaaguuggaaucuauggguguguaccagauccucgcuauuuauucaacggucgccaguagccugguguuacugguuucccuaggcgcaaucucuuucuggaugugcucgaaugggagccuccagugucggauuugcauauga

SEQ ID NO: 130920 - RNA, 1698 nt, Artificial Sequence
  derived and/or modified sequence opt3 from hemagglutinin__InfluenzaA__AFJ78452
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggaaagaacggcuuguaccccaaucugagcaagucuuaugcaaacaauaaagaaaaggaggugcuaguucucuggggcgugcaccacccuccaaacaucggggaucagaaggcccuguaccauacggaaaacgcuuacgucuccguggugucaagccacuauagucggaaauucauacccgagaucgcaaagcgcccuaaaguccgagaccaggaaggacguauuaauuacuauuggacucuucuggagccaggugauaccaucauuuuugaggccaacggcaauuugaucgcuccgagauacgccuucgcgcucucuaggggguuuggauccggcauaauuaacagcaaugcacccauggacgaaugugaugccaagugccagacaccucaaggugcuaucaacucgucucugccauuccagaauguucaucccgugacuauuggggaguguccuaaauauguacgguccgccaaguuacgcauggugaccggacugagaaacaucccaucaauccagaguaggggccucuuuggcgcaauugcuggguucauagaaggagguuggacaggcauggucgacgggugguacggauaucaccaccagaaugagcaaggcagcgguuacgccgcggaucagaaauccacccagaacgccaucaaugggauuacgaacaagguaaauucuguuaucgaaaagaugaacacucaguuuacagcagugggcaaagaguucaauaaacuugagcggcgcauggaaaaccugaacaaaaaggucgacgauggauucauagacauuuggaccuacaaugcugaguugcuagugcugcucgaaaacgagcgaacucuggacuuucaugauagcaauguuaaaaaccuuuaugaaaagguaaagucacaacugaaaaauaacgccaaggagaucggcaaugggugcuucgaguuuuaccacaaauguaacgacgaaugcauggagagugugaagaauggaacauaugauuaccccaaauauuccgaagagagcaaguugaacagagagaagaucgacggugucaaacucgaaucuaugggcguguaccagauucuggcuaucuauucaaccgucgccaguagcuuagugcugcuaguuucccucggggcaauuucuuucuggaugugcucgaauggaagccugcaguguaggauaugcaucuga

SEQ ID NO: 130921 - RNA, 1698 nt, Artificial Sequence
  derived and/or modified sequence opt3 from hemagglutinin__InfluenzaA__AFJ78463
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccgggaaaaacggcuuguaccccaaucugggcaagagcuaugcaaacaauaaagaaaaggaggugcuaguucucuggggagugcaccacccuccaaacaucggagaucagaaggcccuguaccauacggaaaacgcuuacgucucugugguguccucacacuauagccggaaauucauacccgagaucgcaaagcgcccuaaaguccgagaccaggaaggucguauuaauuacuauuggacucuucuggagccaggcgauaccaucauuuuugaggccaacgggaauuugaucgcuccgagauacgccuucgcgcucaguaggggauuuggcucugguauaauuaacuccaaugcacccauggacgaaugugaugccaagugccagacaccucaaggggcuaucaacagcucgcugccauuccagaauguucaucccgugacuauuggagaguguccuaaauauguacggucugccaaguuacgcauggugaccggccugagaaacaucccauccauccagucaaggggccucuuuggggcaauugcuggauucauagaagguggcuggacagggauggucgacggaugguacggcuaucaccaccagaaugagcaagguaguggguacgccgcggaucagaaaagcacccagaacgccaucaauggcauuacgaacaagguaaauuccguuaucgaaaagaugaacacucaguuuacagcagugggaaaagaguucaauaaacuugagcggcgcauggaaaaccugaacaaaaaggucgacgauggcuucauagacauuuggaccuacaaugcugaguugcuagugcugcucgaaaacgagcgaacucuggacuuucaugauucuaauguaaagaaccuuuaugaaaagguuaagagccaacugaaaaauaacgccaaggagaucgggaauggaugcuucgaguuuuaccacaaauguaacgacgaaugcauggagucagugaagaaugguacauaugauuaccccaaauauagugaagaguccaaguugaacagagagaagaucgacggcgucaaacucgaaagcauggggguguaccagauucuggcuaucuauucuaccgucgccucaaguuuagugcugcuaguuagccucggagcaauuuccuucuggaugugcucuaauggcucgcugcaguguaggauaugcaucuga

SEQ ID NO: 130922 - RNA, 1698 nt, Artificial Sequence
  derived and/or modified sequence opt3 from hemagglutinin__InfluenzaA__AFJ78474
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacugucacaggugugucugccagcugcuccuauaacgggaagucaaguuuuuacaaaaauuuacuguggcuuaccggaaagaacggcuuguaucccaaucugagcaaaucuuacgcaaacaauaaggaaaaagaggugcuaguucucuggggcgugcaucacccuccaaacaucggggaucagcgcgcccuguaccacacggaaaacgcuuaugucuccguggugucaagccauuacagucgaaaguucacucccgagauagcaaagcguccuaaagucagagaccaggaaggaaggaucaauuauuacuggacccuucuggagccaggugauacaauuaucuuugaggccaacggcaauuugauugcuccgcgguaugccuucgcgcucucucgcggguuuggauccggcaucauaaacagcaaugcacccauggacgaaugugaugccaagugccagacuccucaaggugcuauuaacucgucucugccauuccagaauguucaccccgugaccaucggggaguguccuaaauacguaagauccgccaaguuaaggauggugacaggacugcggaacauuccaucaauccagagucgcggccucuuuggcgcaaucgcuggguucauugaaggagguuggaccggcauggucgacgggugguauggauaccaucaccagaaugagcaaggcagcgguuacgccgcggaucagaaauccacgcagaacgccauaaaugggaucacuaacaagguaaauucuguuauugaaaagaugaacacacaguuuaccgcagugggcaaggaguucaauaaacuugagcgaagaauggaaaaccugaacaaaaaggucgacgauggauucaucgacauauggacuuauaaugcugaguugcuagugcugcucgaaaacgagaggacacuggacuuucacgauagcaauguuaaaaaccuuuacgaaaagguaaaaucacaacugaagaauaacgccaaggagauuggcaaugggugcuucgaguuuuaucauaaauguaacgacgaaugcauggagagugugaagaauggaaccuacgauuaucccaaauacuccgaagagagcaaguugaaccgggagaaaaucgacggugucaagcucgaaucuaugggcguguaucagauccuggcuauuuacucaacggucgccaguagcuuagugcugcuaguuucccucggggcaaucucuuucuggaugugcucgaauggaagccugcagugucguauuugcauauga

SEQ ID NO: 130923 - RNA, 1698 nt, Artificial Sequence
  derived and/or modified sequence opt3 from hemagglutinin__InfluenzaA__AFJ78485
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucggggaucagcgcgcccuguaccauacugagaacgcuuacguguccgucgugucaagccacuauagucgaaaauucacccccgaaauagcaaagcguccuaaggugagagaccaggagggaaggaucaauuacuauuggacacuucuggagccaggugauacuauuaucuuugaagccaacggcaauuugauugcuccgcgguacgccuucgcgcucucucgcggguuuggauccggcaucauaaacagcaaugcacccauggacgagugugaugccaaaugccagaccccucaaggugcuauuaacucgucucugccauuccagaauguccaucccguuacaaucggggaauguccuaaguaugugagauccgccaaauuaaggaugguaaccggacugcggaacauuccaucaauccagagucgcggccucuuuggcgcaaucgcuggguucauugagggagguuggacgggcaugguggacgggugguacggauaucaccaccagaaugaacaaggcagcgguuacgccgcggaucagaaguccacucagaacgccauaaaugggaucacaaacaaagucaauucugugauugagaagaugaacacccaguuuacugcaguuggcaaagaguucaauaaacuugaacgaagaauggagaaccugaacaagaaaguggaagacggauucaucgauauauggacauacaaugcugaguugcuaguccugcucgaaaacgagaggacccuggacuuucaugacagcaaugugaagaaccuuuaugagaaaguaaagucacaacugaaaaauaacgccaaggaaauuggcaaugggugcuucgaguuuuaccacaaguguaacgaugaaugcauggagaguguuaaaaauggaacguaugacuaccccaaguauuccgaggaaagcaaauugaaccgggagaagaucgauggugugaaacucgaaucuaugggcgucuaccagauccuggcuauuuauucaaccguggccaguagcuuaguccugcuagugucccucggggcaaucucuuucuggaugugcucgaauggaagccugcagugucguauuugcauauga

SEQ ID NO: 130924 - RNA, 1698 nt, Artificial Sequence
  derived and/or modified sequence opt3 from hemagglutinin__InfluenzaA__AFJ78496
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucgggggacagcgcgcccuguaccauacugagaacgcuuacguguccgucgugucaagccacuauagucgaaaauucacccccgaaauagcaaagcguccuaaggugagagaucaggaggguaggaucaauuacuauuggacacuucuggagccaggcgacacuauuaucuuugaagccaacgggaauuugauugcuccgcgguacgccuucgcgcucucucgcggauuuggcuccgguaucauaaacagcaaugcacccauggaugagugugacgccaaaugccagaccccucaaggggcuauuaacucgucucugccauuccagaauguccaucccguuacaaucggagaauguccuaaguaugugagauccgccaaauuaaggaugguaaccggccugcggaacauuccaucaauccagagucgcggccucuuuggggcaaucgcuggauucauugaggguggcuggacggggaugguggauggaugguacggcuaucaccaccagaaugaacaagguagcggguacgccgcggaccagaaguccacucagaacgccauaaauggcaucacaaacaaagucaauucugugauugagaagaugaacacccaguuuacugcaguuggaaaagaguucaauaaacuugaacgaagaauggagaaccugaacaagaaaguggaugacggcuucaucgauauauggacauacaaugcugaauugcuaguccugcucgagaacgaaaggacccuggacuuucaugacagcaaugugaagaaccuuuaugagaaaguaaagucacaacugaaaaauaacgccaaggagauugggaauggaugcuucgaauuuuaccacaaguguaacgaugagugcauggaaaguguuaaaaaugguacguaugacuaccccaaguauuccgaggagagcaaauugaaccgggaaaagaucgauggcgugaaacucgagucuaugggggucuaccagauccuggcuauuuauucaaccguggccaguagcuuaguccugcuagugucccucggagcaaucucuuucuggaugugcucgaauggcagccugcagugucguauuugcauauga

SEQ ID NO: 130925 - RNA, 1698 nt, Artificial Sequence
  derived and/or modified sequence opt3 from hemagglutinin__InfluenzaA__AFJ78518
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguagagagagcugguccuacaucguugaaaaaccaaauccggagaacggaaccuguuaucccggccauuuugcugacuacgaggaacugagggagcaacucucuucggugagcucauucgaacgguuugagauuuucccuaaggagaguuccuggccaaaucacacuacaaccggugucucugccagcugcucccauaacggggaaucaaguuuuuauaagaauuuacuguggcuuacgggaaagaacggcuuguaccccaaucugagcaagucuuaugcaaacaauaaagagaaggaagugcuaguacucuggggcguucaccacccuccaaacaucggggaucagcgcgcccuguaccauacugagaacgcuuacguguccgucgugucaagccacuauagucgaaaauucacccccgaaauagcaaagcguccuaaggugagagaccaggagggaaggaucaauuacuauuggacacuucuggagccaggugauacuauuaucuuugaagccaacggcaauuugauugcuccgcgguacgccuucgcgcucucucgcggguuuggauccggcaucauaaacagcaaugcacccauggacgagugugaugccaaaugccagaccccucaaggugcuauuaacucgucucugccauuccagaauguccaucccguuacaaucggggaauguccuaaguaugugagauccgccaaauuaaggaugguaaccggacugcggaacauuccaucaauccagagucgcggccucuuuggcgcaaucgcuggguucauugagggagguuggacgggcaugguggacgggugguacggauaucaccaccagaaugaacaaggcagcgguuacgccgcggaucagaaguccacucagaacgccauaaaugggaucacaaacaaagucaauucugugauugagaagaugaacacccaguuuacugcaguuggcaaagaguucaauaaacuugaacgaagaauggagaaccugaacaagaaaguggacgauggauucaucgacauauggacauacaaugcugaauugcuaguccugcucgagaacgaaaggacccuggacuuucaugauagcaaugugaagaaccuuuaugagaaaguaaagucacaacugaaaaauaacgccaaggagauuggcaaugggugcuucgaauuuuaccacaaguguaacgacgagugcauggaaaguguuaaaaauggaacguaugauuaccccaaguauuccgaggagagcaaauugaaccgggaaaagaucgacggugugaaacucgagucuaugggcgucuaccagauccuggcuauuuauucaaccguggccaguagcuuaguccugcuagugucccucggggcaaucucuuucuggaugugcucgaauggaagccugcagugucguauuugcauauga

SEQ ID NO: 130926 - RNA, 1698 nt, Artificial Sequence
  derived and/or modified sequence opt3 from hemagglutinin__InfluenzaA__AFJ78529
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaagaccaaacccggagaauggaaccuguuaucccggccauuuugcugacuacgaggaacugagggagcaacucuccucugugucgucauucgaacgguuugagauuuucccuaaggagagcaguuggccaaaccacacugucacagguguguccgccucuugcagccauaauggggaauccucauuuuauaagaacuuacuguggcuuaccggaaagaauggcuuguaccccaaccugaguaagagcuaugcaaauaacaaagagaaggaaguucuaguacucuggggcgugcaccacccuccaaacaucggggaucagaugacgcuguaccauaaagagaaugccuacgucucugugguguccucacacuauagccgcaaguucacucccgaaauagcuaagcgaccuaaaguccgugaccaggagggaagaaucaacuacuauuggacccuucuggagccaggugauacaauuaucuuugaagcaaauggcaacuugauugccccgagguacgcuuucgcccucagucggggguuuggaucuggcaucauaaauuccaacgcgcccauggacgagugugaugcaaagugccagacuccucaaggugccauuaauagcucgcugccauuccagaacguucaucccgugaccaucggggaauguccuaaauauguacgcucugcuaaguuaagaauggugacaggacugaggaauauuccauccauccagucacggggccucuuuggcgccaucgcaggguucauugagggagguuggaccggcauggucgacgggugguacggauaucaccaccagaacgaacaaggcagugguuacgcugccgaucagaaaagcacgcagaaugcgauaaacgggaucacuaauaaggugaacuccguuauugagaaaaugaauacacaguuuaccgccgugggcaaggaguucaacaaacuugaacgccgaauggagaaccugaauaaaaaggucgacgauggauucaucgacguguggacuuacaacgcagaauugcuaguacugcucgagaaugaaagaacacuggacuuucaugauucuaacguuaaaaaucuuuaugagaaggugaaaaaccaacugaagaauaacgcuaaggagauaggcaaugggugcuucgaauuuuaccacaaauguaacgacgagugcauggaaagcgucaagaauggaaccuaugauuaccccaaauauucagaggagaguaaguuguccagggagaaaauugacggugugaagcucgaaagcaugggcgucuaccagauccuggccaucuauucuacgguggcuucaaguuuaguucugcuagugagccucggggccauuuccuucuggaugugcucuaacggaucgcugcagugucggaucugcauuuga

SEQ ID NO: 130927 - RNA, 1698 nt, Artificial Sequence; identical to SEQ ID NO: 130926
  derived and/or modified sequence opt3 from hemagglutinin__InfluenzaA__AFJ78540

SEQ ID NO: 130928 - RNA, 1698 nt, Artificial Sequence; identical to SEQ ID NO: 130926
  derived and/or modified sequence opt3 from hemagglutinin__InfluenzaA__AFJ78551

SEQ ID NO: 130929 - RNA, 1698 nt, Artificial Sequence
  derived and/or modified sequence opt3 from hemagglutinin__InfluenzaA__AFJ78562
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaagaccaaacccggagaauggaaccuguuaucccggccauuuugcugacuacgaggaacugagggagcaacucuccucugugucgucauucgaacgguuugagauuuucccuaaggagagcaguuggccaaaccacacugucacagguguguccgccucuugcagccauaauggggaauccucauuuuauaagaacuuacuguggcuuaccggcaaaaauggauuguaccccacgcugaguaagagcuaugcaaacaauaaagagaaggaagugcuaguucucuggggcgugcaccacccuccaaacaucggggaucagaugacucuguaccauaaagagaacgccuacgucucugugguguccucacacuauagccgcaaguucacccccgaaauagcuaagcgacuuaaaguccgugaccaggagggaagaaucaauuacuauuggacacuguuggagccuggugauacuauuaucuuugaagcaaacggcaaucucauugccccaagguacgcuuucgcccugagucggggguuaggaucuggcaucauaaacuccaaugcgccgauggacgagugugaugcaaagugccagacaccccaaggugccauuaacagcucgcugccuuuucagaauguucauccagugaccaucggggaaugucccaaauauguacgcucugcuaagcucagaauggugaccggacuuaggaacauuccuuccauccagucacggggccuguucggcgccaucgcaggguuuauugagggagguuggacgggcauggucgacgggugguacggauaucaccaccagaaugaacaaggcagugguuacgcugccgaucagaaaagcacucagaacgcgauaaaugggaucacaaacaagguaaauuccguuauugagaaaaugaacacccaguucacugccgugggcaaggaguuuaauaaguuggaacgccgaauggagaaccuaaacaaaaaggucgacgauggauucaucgacguguggacauacaaugcagaacugcucguacugcuugagaacgaaagaacccuggacuuccaugauucuaauguuaaaaacuuguaugagaaggugaaaaaucaacucaagaacaaugcuaaggagauaggcaacgggugcuuugaguucuaccacaaauguaaugacgaaugcauggaaagcgucaagaacggaacguaugauuacccaaaauauucagaggagaguaagcuguccagggagaaaauugacggugugaaguuagaaagcaugggcgucuaccagauccuggccaucuauucuaccguggcuucaagucuaguucuccuggugagccuuggggccauuuccuuuuggaugugcucuaauggaucguugcagugucggaucugcauuuga

SEQ ID NO: 130930 - RNA, 1698 nt, Artificial Sequence
  derived and/or modified sequence opt3 from hemagglutinin__InfluenzaA__AFJ78573
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaagaccaaacccggagaauggaaccuguuaucccggccauuuugcugacuacgaggaacugagggagcaacucuccucugugucgucauucgaacgguuugagauuuucccuaaggagagcaguuggccaaaccacacugucacagguguguccgccucuugcagccauaauggggaauccucauuuuauaagaacuuacuguggcuuaccggaaagaauggcuuguaccccaaccugaguaagagcuaugcaaauaacaaagagaaggaaguucuaguacucuggggcgugcaccacccuccaaacaucggggaucagaugacgcuguaccauaaagagaaugccuacgucucugugguguccucacacuauagccgcaaguucacucccgaaauagcuaagcgaccuaaaguccgugaccaggagggaagaaucaacuacuauuggacccuucuggagccaggugauacaauuaucuuugaagcaaauggcaacuugauugccccgagguacgcuuucgcccucagucggggguuuggaucuggcaucauaaauuccaacgcgagcauggacgagugugaugcaaagugccagacuccccaaggugccauuaauucgucucugccuuuccagaacguucauccagugaccaucggggaaugucccaaauauguacgcuccgcuaaguuaagaauggugacaggacugaggaauauuccuucaauccagagucggggccucuuuggcgccaucgcaggguucauugagggagguuggaccggcauggucgacgggugguacggauaucaccaccagaacgaacaaggcagcgguuacgcugccgaucagaaauccacgcagaaugcgauaaacgggaucacuaauaaggugaacucuguuauugagaaaaugaauacacaguuuaccgccgugggcaaggaguucaacaaacuugaacgccgaauggagaaccugaauaaaaaggucgacgauggauucaucgacguguggacuuacaacgcagaauugcuaguacugcucgagaaugaaagaacacuggacuuucaugauagcaacguuaaaaaucuuuaugagaaggugaaaaaccaacugaagaauaacgcuaaggagauaggcaaugggugcuucgaauuuuaccacaaauguaacgacgagugcauggaaucagucaagaauggaaccuaugauuacccaaaauauagugaggaggccaaguuguccagggagaaaauugacggugugaagcucgaaagcaugggcgucuaccagauccuggcuaucuauucuacgguggccucaaguuuaguucugcuagugagccucggggcaauuuccuucuggaugugcucuaacggaucgcugcagugucggaucugcauuuga

SEQ ID NO: 130931 - RNA, 1698 nt, Artificial Sequence
  derived and/or modified sequence opt3 from hemagglutinin__InfluenzaA__AFJ78584
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcagcuucgaaagguuugagauuuucccuaaggagaguuccuggccaaaccacacugucacaggugugucugccagcugcucccauaauggggaaaacucauuuuaucggaauuuacuguggcuuacccgcaaaaacggauuguaccccaaucugaguaagagcuaugcaaacaacaaagagaaggaagugcuaguucucuggggcgugcaccacccuccaaauaucggcgaccagaaagcccuguaccauacggagaacgcuuacgucucugugguguccucacacuauagccgaaaguucacucccgaaauagcaaagcguccuaaagucagagaucaggaggggaggaucaauuacuauuggacccuucuggagccaggagacacaauuaucuuugaagccaacgguaauuugauugcuccgcgguacgccuucgcgcucagucgcggcuuugggucuggaaucauaaacuccaaugcacccauggauaagugugacgccaaaugccagacuccucaaggcgcuauuaacagcucgcugccauuccagaauguucaucccguggccaucggugaguguccuaaguauguaagaucugcaaaauuaaggauggugaccgggcugcggaacauuccauccauccagucacgcggacucuuuggcgcuaucgccggcuucauugaagggggauggacagguauggucgauggcugguacggguaucaccaccagaaugagcaaggaaguggcuacgcggccgaccagaagucaacccagaacgcaauaaaugguaucacgaacaaaguaaauuccguuauugaaaagaugaacacucaguuuacagcuguggggaaggaguucaacaaacuugagcgaagaauggaaaaucugaacaagaaagucgaugacggcuucaucgauauauggaccuacaaugccgaguugcuagugcugcucgaaaacgagaggacucuggacuuucaugacucuaauguaaagaaccuuuaugaaaaaguuaagagccaacugaagaauaacgcuaaagagauuggaaauggcugcuucgaguuuuaccacaaguguaacgaugaaugcauggagucagugaaaaaugggacauaugacuaccccaaguauagugaagaguccaaauugaaccgggagaagaucgauggagucaagcucgaaagcauggguguguaccagauccuggccauuuauucuaccgucgcaucaaguuuagugcugcuaguuagccucggcgccaucuccuucuggaugugcucuaaugggucgcugcagugucguauuugcauauga

SEQ ID NO: 130932 - RNA, 1698 nt, Artificial Sequence
  derived and/or modified sequence opt3 from hemagglutinin__InfluenzaA__AFJ78595
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaaccgcgagaaagaaguucuaguacucuggggcgugcaccacccuccaaacaucggggaccagaaggcccuguaccauacggagaaugcuuacgucuccguggugucaagccacuauagucgaaaauucacucccgaaauagcaaagcguccuaaggucagagaucaggagggaaggaucaacuacuauuggacccuucuggagccaggugacacaauuaucuuugaagccaauggcaacuugauugcuccgcgguacgccuucgcgcucucucgcggguuuggauccggcaucauaaauagcaacgcacccauggauaaaugugacgccaagugccagacuccucaaggugcuauuaauucgucucugccauuccagaacguucaucccgugaccaucggggaguguccuaaauauguaagauccgccaaguuaaggauggugacaggacugcggaauauuccaucaauccagagucgcggccucuuuggcgcaaucgcuggguucauugaaggagguuggaccggcauggucgaugggugguacggauaucaccaccagaacgagcaaggcagcgguuacgccgcggaccagaaauccacgcagaaugccauaaacgggaucacuaauaaggugaacucuguuauugaaaagaugaauacacaguuuaccgcagugggcaaggaguucaacaaacuugagcgaagaauggaaaaccugaauaaaaaggucgaugacggauucaucgauauauggacuuacaacgcugaguugcuagugcugcucgaaaaugagaggacacuggacuuucaugacagcaacguuaaaaaucuuuaugaaaagguaaaaucacaacugaagaacaaugccaaggagauuggcaacgggugcuucgaguuuuaccacaaauguaaugaugaaugcauggagagugugaagaacggaaccuaugacuaccccaaauauuccgaagagagcaaguugaaucgggagaaaaucgauggugucaagcucgaaucuaugggcguguaccagauccuggcuauuuauucaacggucgccaguagcuuagugcugcuaguuucccucggggcaaucucuuucuggaugugcucgaacggaagccugcagugucguauuugcauauga

SEQ ID NO: 130933 - RNA, 1698 nt, Artificial Sequence
  derived and/or modified sequence opt3 from hemagglutinin__InfluenzaA__AFJ78617
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccaugacggggaaucaaguuuuuaucggaauuuacuguggcuuaccggaaagaacggcuuguaccccaaucugagcaagucuuaugcaaacaauaaagagaaggaaguucuaguacucuggggcgugcaccacccuccauccaucucagaucagaaaacgcuguaccauacugagaacgcccacgucagcguggugaguucucauuacucccgcaaguucacccccgaaauagcuaagcgaccuaaaguccgugaccaggaggggagaaucaacuauuacuggacacuucuggagccaggagauacuauuaucuuugaagcaaaugguaacuugauugccccgagguaugcuuucgcccucagccggggcuuugggucgggaaucauaaauucuaacgcgcccauggacaagugugaugcaaaaugccagaccccucaaggcgccauuaauuccucacugccauuccagaacguucaccccgugacaaucggugaguguccuaaguacguacgcagugcuaaauuaagaauggugaccgggcugaggaauauuccaagcauccagucccggggacucuuuggcgccaucgcaggcuucauugaagggggauggacggguauggucgacggcugguauggguaccaccaucagaacgagcaaggaucuggcuaugcugccgaucagaaaagcacucagaaugcgauaaacgguaucacaaauaaagugaacucaguuauugaaaagaugaauacccaguuuacugccgugaguaaggaguucaacaaacuugagcgccgaauggaaaaucugaacaagaaagucgacgauggguucaucgacauauggacauacaacgcagaguugcuagugcugcucgaaaaugagagaacccuggacuuucacgauuccaacguaaagaaucuuuacgaaaaaguuaagagccaacugaagaacaaugcuaaagagauuggcaacggaugcuucgaguuuuaucauaaguguaaugacgaaugcauggagucugugaaaaacggcacguacgauuaucccaaguacucagaagagaguaaauugaauagggagaagaucgacggggucaagcucgaaagcaugggaguguaucagauccuggccauuuacuccaccgucgcuucuucguuagugcugcuaguuagccucggugccaucuccuucuggaugugcucaaacggcagucugcagugucggauuugcauauga

SEQ ID NO: 130934 - RNA, 1698 nt, Artificial Sequence
  derived and/or modified sequence opt3 from hemagglutinin__InfluenzaA__AFJ78628
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaauagcgccccuucagcuggguaacuguucuguggccggcuggaucuuggggaauccugagugcgaacuccugauuucaaaagagaguuggagcuacaucguugaaagaccaaacccggagaauggaaccuguuaucccggccauuuugcugacuacgaggaacugagggagcaacucuccucugugucgucauucgaacgguuugagauuuucccuaaggagagcaguuggccaaaccacacugucacagguguguccgccucuugcagccauaauggggaauccucauuuuauaagaacuuacuguggcuuaccggaaagaauggcuuguaccccaaccugaguaagagcuaugcaaauaacaaagagaaggaagugcuaguucucuggggcgugcaccacccuccaaacaucgggaaucagaugacgcuguaccauaaagagaacgccuacgucucugugguguccucacacuauagccgcaaguucacucccgaaauagcuaagcgaccuaaaguccgugaucaggagggaagaaucaauuacuauuggacccuucuggagccaggugacacaauuaucuuugaagcaaacggcaauuugauugccccgagguacgcuuucgcccucagucggggguuuggaucuggcaucauaaacuccaaugcgcccauggaugagugugacgcaaagugccagacuccucaaggugccauuaacagcucgcugccauuccagaauguucaucccgugaccaucggggaauguccuaaauauguacgcucugcuaaguuaagaauggugacaggacugaggaacauuccauccauccagucacggggccucuuuggcgccaucgcaggguucauugagggagguuggaccggcauggucgaugggugguacggauaucaccaccagaaugaacaaggcagugguuacgcugccgaccagaaaagcacgcagaacgcgauaaaugggaucacuaacaagguaaauuccguuauugagaaaaugaacacacaguuuaccgccgugggcaaggaguucaacaaacuugaacgccgaauggagaaucugaacaaaaaggucgaugacggauucaucgauguguggacuuacaaugcagaauugcuaguacugcucgagaacgaaagaacacuggacuuucaugacucuaauguuaaaaaccuuuaugagaaggugaaaaaucaacugaagaacaaugcuaaggagauaggcaacgggugcuucgaauuuuaccacaaauguaaugaugagugcauggaaagcgucaagaacggaaccuaugacuaccccaaauauucagaggagaguaaguuguccagggagaaaauugauggugugaagcucgaaagcaugggcgucuaccagauccuggccaucuauucuacgguggcuucaaguuuaguucugcuagugagccucggggccauuuccuucuggaugugcucuaauggaucgcugcagugucggaucugcauuuga

SEQ ID NO: 130935 - RNA, 1698 nt, Artificial Sequence
  derived and/or modified sequence opt3 from hemagglutinin__InfluenzaA__AFJ78639
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaagucuuaugcaaauaacaaagagaaggaaguucuaguacucuggggcgugcaccacccuccauccaucucaaaccagaaaacgcuguaccauacugagaaugccuacgucagcguggugaguucucacuauucccgcaaguucacccccgaaauagcuaagcgaccuaaaguccgugaccaggaggggagaaucaacuacuauuggacacuucuggagccaggagauacuauuaucuuugaagcaaaugguaacuugauugccccgagguacgcuuucgcccucagccggggcuuugggucgggaaucauaaauucuaacgcgcccauggacaagugugaugcaaaaugccagaccccucaaggcgccauuaauuccucacugccauuccagaacguucaucccgugacaaucggugaguguccuaaguauguacgcagugcuaaauuaagaauggugaccgggcugaggaauauuccaagcauccagucccggggacucuuuggcgccaucgcaggcuucauugaagggggauggacggguauggucgacggcugguacggguaucaccaccagaacgagcaaggaucuggcuacgcugccgaucagaaaagcacucagaaugcgauaaacgguaucacaaauaaagugaacucaguuauugaaaagaugaauacccaguuuacugccguggggaaggaguucaacaaacuugagcgccgaauggaaaaccugaauaagaaagucgacgauggcuucaucgacauauggacauacaacgcagaguugcuagugcugcucgaaaaugagagaacccuggauuuucaugacaguaacguaaagaaucuuuaugaaaaaguuaagucccaacugaagaacaaugcuaaagagauuggaaacggcugcuucgaguuuuaccacaaguguaaugacgaaugcauggagagcgugaaaaacgggacguaugauuaccccaaguauucugaagagucaaaauugaauagggagaagaucgacggagucaagcucgaaaguauggguguguaccagauccuggccauuuauagcaccgucgcuuccucuuuagugcugcuaguuucgcucggcgccaucagcuucuggaugugcuccaacgggucacugcagugucggauuugcauauga

SEQ ID NO: 130936 - RNA, 1698 nt, Artificial Sequence; identical to SEQ ID NO: 130935
  derived and/or modified sequence opt3 from hemagglutinin__InfluenzaA__AFJ78650

SEQ ID NO: 130937 - RNA, 1701 nt, Artificial Sequence; identical to SEQ ID NO: 124685
  derived and/or modified sequence opt3 from hemagglutinin__InfluenzaA__AFJ78661

SEQ ID NO: 130938 - RNA, 1701 nt, Artificial Sequence
  derived and/or modified sequence opt3 from hemagglutinin__InfluenzaA__AFJ78681
augaaggccauccuggugguccuccuuuacaccuucgcuacaguuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguaaagaagggaaacagcuacccaaaauuaucuaaguccuauauaaaugacaagggcaaagaaguucuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacgagaucacgaauaagguuaacucugugauagagaaaaugaauacccaguuuacagccgucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauagcaauguuaaaaaccuguacgagaaggugcgaucacagcucaaaaacaaugccaaggaaaucggcaacggauguuuugaguucuaucacaagugcgacaauacauguauggaaagugucaaaaacggcacuuacgauuauccuaaguacuccgaggaagcaaaacugaauagagaggagauugacggggugaaacuugaaagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 130939 - RNA, 1701 nt, Artificial Sequence; identical to SEQ ID NO: 124685
  derived and/or modified sequence opt3 from hemagglutinin__InfluenzaA__AFJ78691

SEQ ID NO: 130940 - RNA, 1701 nt, Artificial Sequence; identical to SEQ ID NO: 124685
  derived and/or modified sequence opt3 from hemagglutinin__InfluenzaA__AFJ78701

SEQ ID NO: 130941 - RNA, 1701 nt, Artificial Sequence; identical to SEQ ID NO: 129213
  derived and/or modified sequence opt3 from hemagglutinin__InfluenzaA__AFJ78711

SEQ ID NO: 130942 - RNA, 1701 nt, Artificial Sequence; identical to SEQ ID NO: 124685
  derived and/or modified sequence opt3 from hemagglutinin__InfluenzaA__AFJ78721

SEQ ID NO: 130943 - RNA, 1701 nt, Artificial Sequence
  derived and/or modified sequence opt3 from hemagglutinin__InfluenzaA__AFJ78731
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcucuaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguaaagaaccuguacgagaagguucgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauugacggggucaaacuugaaucuaccaggaucuaucaaauucuggccauauacucaacaguggcuaguagcuugguccucgugguuucccugggagcgaucucuuuuuggaugugcucgaacgguagcuuacagugccggauuuguaucuga

SEQ ID NO: 130944 - RNA, 1701 nt, Artificial Sequence; identical to SEQ ID NO: 125849
  derived and/or modified sequence opt3 from hemagglutinin__InfluenzaA__AFJ78741

SEQ ID NO: 130945 - RNA, 1701 nt, Artificial Sequence; identical to SEQ ID NO: 124685
  derived and/or modified sequence opt3 from hemagglutinin__InfluenzaA__AFJ78751

SEQ ID NO: 130946 - RNA, 1701 nt, Artificial Sequence; identical to SEQ ID NO: 124685
  derived and/or modified sequence opt3 from hemagglutinin__InfluenzaA__AFJ78761

SEQ ID NO: 130947 - RNA, 1701 nt, Artificial Sequence; identical to SEQ ID NO: 124685
  derived and/or modified sequence opt3 from hemagglutinin__InfluenzaA__AFJ78771

SEQ ID NO: 130948 - RNA, 1701 nt, Artificial Sequence; identical to SEQ ID NO: 124685
  derived and/or modified sequence opt3 from hemagglutinin__InfluenzaA__AFJ78781

SEQ ID NO: 130949 - RNA, 1701 nt, Artificial Sequence; identical to SEQ ID NO: 124685
  derived and/or modified sequence opt3 from hemagglutinin__InfluenzaA__AFJ78791

SEQ ID NO: 130950 - RNA, 1701 nt, Artificial Sequence; identical to SEQ ID NO: 124685
  derived and/or modified sequence opt3 from hemagglutinin__InfluenzaA__AFJ78801

SEQ ID NO: 130951 - RNA, 1701 nt, Artificial Sequence; identical to SEQ ID NO: 125546
  derived and/or modified sequence opt3 from hemagglutinin__InfluenzaA__AFJ78811

SEQ ID NO: 130952 - RNA, 1701 nt, Artificial Sequence; identical to SEQ ID NO: 124685
  derived and/or modified sequence opt3 from hemagglutinin__InfluenzaA__AFJ78821

SEQ ID NO: 130953 - RNA, 1701 nt, Artificial Sequence; identical to SEQ ID NO: 124685
  derived and/or modified sequence opt3 from hemagglutinin__InfluenzaA__AFJ78831

SEQ ID NO: 130954 - RNA, 1701 nt, Artificial Sequence; identical to SEQ ID NO: 125883
  derived and/or modified sequence opt3 from hemagglutinin__InfluenzaA__AFJ78841

SEQ ID NO: 130955 - RNA, 1701 nt, Artificial Sequence; identical to SEQ ID NO: 124685
  derived and/or modified sequence opt3 from hemagglutinin__InfluenzaA__AFJ78851

SEQ ID NO: 130956 - RNA, 1701 nt, Artificial Sequence
  derived and/or modified sequence opt3 from hemagglutinin__InfluenzaA__AFJ78861
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguagacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaggagcuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 130957 - RNA, 1701 nt, Artificial Sequence
  derived and/or modified sequence opt3 from hemagglutinin__InfluenzaA__AFJ78881
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaguagcuccuggucuuacauuguugagaccucgucaagcgacaacggaacuugcuauccaggcgauuuuaucgacuacgaggagcucagggagcagcugaguuccgugucuagcuucgaacgguuugagauuuucccgaagacauccucauggcccaaucacgauaguaacaagggugucaccgcagccuguccucaugcuggggcaaagagcuuuuauaagaaucugaucuggcucgugaaaaagggaaacucuuacccaaaauuauccaagucauauauaaaugacaagggcaaagaaguacugguucuuuggggcauccaccaccccagcacgagugccgaucaacagucuuuguaccagaacgcugacgccuacguguucgucgggacuucccgcuauagcaagaaauuuaagccugagauugcgauccgaccaaaagugcgugaucaggagggaagaaugaauuacuauuggacccugguggaacccggugacaagauuacauucgaggcaacuggcaaccuagucguuccuagguacgccuuugcuauggaacggaacgccgggucgggaaucauaauuucugauaccccagugcaugacugcaauacaaccugucaaacgccgaaaggcgcaaucaacacuucccuccccuuccagaauauucacccuaucacaaucgguaagugcccaaaguauguaaaaucaaccaagcugcgccuugcuacugggcugagaaacgugcccaguauucagagcaggggauuguuuggcgccauagcgggcuucaucgaagggggauggacagguauggucgacggcugguacggguaucaucaccagaaugaacaaggauccggcuacgccgcagaucucaaaucuacccagaacgcuauugacgagaucacgaauaaggugaacagcguuauagagaaaaugaauacccaguuuacagccguggguaaggaguucaaccaccuggaaaagcggauugaaaauuuaaacaaaaaggucgaugacggguuccuggauaucuggacuuacaaugcugagcuccuugugcuguuggaaaacgagcgcacccuagacuaucaugauucaaauguuaaaaaccuguacgagaagguacgaagucagcucaaaaacaaugccaaggaaaucggcaacggauguuuugaguucuaucacaagugcgacaauacauguauggaauccgugaaaaacggcacuuacgauuauccuaaguacagcgaggaagcaaaacugaauagagaggagauuaacggggucaaacuugaaucuaccaggaucuaucaaauucuggccauauacucaacagcugcgaguagcuuggugcucgucgugucccugggagcaaucucuuuuuggaugugcucgaaugguagcuuacagugccggauuuguaucuga

SEQ ID NO: 130958 - RNA, 1701 nt, Artificial Sequence; identical to SEQ ID NO: 124685
  derived and/or modified sequence opt3 from hemagglutinin__InfluenzaA__AFJ78891

SEQ ID NO: 130959 - RNA, 1701 nt, Artificial Sequence; identical to SEQ ID NO: 124685
  derived and/or modified sequence opt3 from hemagglutinin__InfluenzaA__AFJ78901

SEQ ID NO: 130960 - RNA, 1701 nt, Artificial Sequence; identical to SEQ ID NO: 124685
  derived and/or modified sequence opt3 from hemagglutinin__InfluenzaA__AFJ78911

SEQ ID NO: 130961 - RNA, 1701 nt, Artificial Sequence; identical to SEQ ID NO: 124685
  derived and/or modified sequence opt3 from hemagglutinin__InfluenzaA__AFJ78921

SEQ ID NO: 130962 - RNA, 1701 nt, Artificial Sequence
  derived and/or modified sequence opt3 from hemagglutinin__InfluenzaA__AFJ97567
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucgauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaaacaagucuuauauaaaugauaagggcaaagaaguacugguucuuuggggcauccaccaccccuccacgucaacugaccaacagagcuuguaccagaacgcugaugccuacguguucgucgggaccagucgcuauucuaagaaauuuaagccugagauugcgauccgaccaaaagugcgugaccaggagggaagaaugaauuacuauuggacacugguggaacccggugauaagauuacuuucgaggcaaccggcaaccuagucguuccuagguacgccuuuacaauggaacggaacgcuggguccggaaucauaauuagcgacaccccagugcaugacugcaauacgacuugucaaacaccgaaaggcgccaucaacaccucguuccccuuucagaauauucacccuaucacuaucgguaagugcccaaaguauguaaaaucuacaaagcuccgccuggcaaccgggcuuagaaacgugcccuccauucagucaaggggacuguucggcgcuauagccggcuuuaucgaagggggauggacggguauggucgauggcugguacggguaucaucaccagaaugaacaaggaaguggcuacgcggccgacuugaaaagcacccagaacgcaauugaugagaucacaaauaaggugaacuccguuauagagaaaaugaauacucaguucaccgcuguggguaaggaguucaaccaccucgaaaagcggauugaaaaucugaacaaaaaggucgacgauggguuuuuagacaucuggacauacaaugccgagcugcucgugcuucuggaaaacgagcgcacuuuggauuaucaugacucuaauguuaaaaaccuauacgagaagguacgaagccagcugaaaaacaaugcuaaggaaaucggcaacggauguuucgaguuuuaucacaagugcgauaauaccuguauggaaucagugaaaaacggcacauacgacuauccuaaguacagugaggaagccaaacucaauagagaggagauugauggggucaagcuggaauccaccaggaucuaucaaauucuugcaauauacagcacuguggccucuucacuggucuuggugguuagucucggagcuaucagcuucuggaugugcuccaacgguucucugcagugccggauuuguaucuga

SEQ ID NO: 130963 - RNA, 1701 nt, Artificial Sequence; identical to SEQ ID NO: 124685
  derived and/or modified sequence opt3 from hemagglutinin__InfluenzaA__AFK14115

SEQ ID NO: 130964 - RNA, 1701 nt, Artificial Sequence; identical to SEQ ID NO: 124685
  derived and/or modified sequence opt3 from hemagglutinin__InfluenzaA__AFK14131

SEQ ID NO: 130965 - RNA, 1701 nt, Artificial Sequence; identical to SEQ ID NO: 126367
  derived and/or modified sequence opt3 from hemagglutinin__InfluenzaA__AFK14139

SEQ ID NO: 130966 - RNA, 1701 nt, Artificial Sequence
  derived and/or modified sequence opt3 from hemagglutinin__InfluenzaA__AFK14148
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaaaccagcucaagaauaacgcaaaggagaucggcaauggauguuuugaguucuaucacaaaugcgacaacacauguauggaaucagugaagaauggcacuuacgauuauccuaaauacagugaagaggccaagcugaacagagaagagauugacggggucaaacuugaguccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 130967 - RNA, 1701 nt, Artificial Sequence; identical to SEQ ID NO: 126312
  derived and/or modified sequence opt3 from hemagglutinin__InfluenzaA__AFK14157

SEQ ID NO: 130968 - RNA, 1701 nt, Artificial Sequence; identical to SEQ ID NO: 124685
  derived and/or modified sequence opt3 from hemagglutinin__InfluenzaA__AFK14166

SEQ ID NO: 130969 - RNA, 1701 nt, Artificial Sequence; identical to SEQ ID NO: 126013
  derived and/or modified sequence opt3 from hemagglutinin__InfluenzaA__AFK14175

SEQ ID NO: 130970 - RNA, 1701 nt, Artificial Sequence; identical to SEQ ID NO: 127590
  derived and/or modified sequence opt3 from hemagglutinin__InfluenzaA__AFK14184

SEQ ID NO: 130971 - RNA, 1701 nt, Artificial Sequence; identical to SEQ ID NO: 125038
  derived and/or modified sequence opt3 from hemagglutinin__InfluenzaA__AFK14193

SEQ ID NO: 130972 - RNA, 1701 nt, Artificial Sequence; identical to SEQ ID NO: 126282
  derived and/or modified sequence opt3 from hemagglutinin__InfluenzaA__AFK14202

SEQ ID NO: 130973 - RNA, 1701 nt, Artificial Sequence; identical to SEQ ID NO: 125038
  derived and/or modified sequence opt3 from hemagglutinin__InfluenzaA__AFK14211

SEQ ID NO: 130974 - RNA, 1701 nt, Artificial Sequence
  derived and/or modified sequence opt3 from hemagglutinin__InfluenzaA__AFK14220
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcagugccuccucuuucgaacgguaugagauuuuuccgaagacaagcuccuggcccaaucacgauucaaacaagggugugaccgcugcauguccucaugccggggcuaaaaguuucuacaagaaucugaucuggcucgucaaaaagggaaacagcuauccaaaauuaucuaaguccuacauaaaugacaagggcaaagaagugcugguacuuuggggcauccaccaccccucaacgagcgccgaucaacagaguuuguaccagaacgcggacgcauauguuuuuguggggacuucucgcuacuccaagaaauucaagccugagauugccauccgaccaaaaguccgugaucaggagggaagaaugaauuauuacuggacccugguggaacccggugacaagauuacauuugaggcuacuggcaaccuaguggucccuagguaugccuucgcaauggaacggaacgcugggagcggaaucauaauuucggauaccccaguucaugacugcaauacaaccugucaaacgccgaaaggcgccaucaacacuucucuccccuuucagaauauucacccuaucacaaucgguaagugcccaaaguacgugaaauccaccaagcugcgccuugcgacugggcugagaaacguacccucaauucagaguaggggauuguucggcgccauagcaggcuuuaucgaagggggauggacagguaugguggacggcugguauggguaccaucaccagaaugaacaaggaagcggcuacgcugccgaucucaaauccacccagaacgcuauugacaagaucacgaauaaagucaacucugugauagagaagaugaauacccaguucacagccguugguaaggaguuuaaccaccuggaaaaacggauugagaauuuaaacaagaaaguggaugacggguuccuggauaucuggacuuauaaugcagaacuccuuguccuguuggagaacgaacgcacccuagacuaccaugauagcaaugugaagaaccuguaugagaaaguacgaaaccagcucaagaauaacgccaaggagaucggcaauggauguuucgaauuuuaccacaaaugcgacaacacauguauggagucaguuaagaauggcacuuaugauuacccuaaauauagugaagaggcuaagcugaacagagaagagauugacggggugaaacuugaguccaccaggaucuaccaaauucuggcgauauacagcacagucgcaucuucauuggugcucgucgugagucugggagccaucagcuucuggaugugcuccaaugguucuuuacagugccggauuuguaucuga

SEQ ID NO: 130975 - RNA, 1701 nt, Artificial Sequence; identical to SEQ ID NO: 126312
  derived and/or modified sequence opt3 from hemagglutinin__InfluenzaA__AFK14229

SEQ ID NO: 130976 - RNA, 1701 nt, Artificial Sequence; identical to SEQ ID NO: 129450
  derived and/or modified sequence opt3 from hemagglutinin__InfluenzaA__AFK14238

SEQ ID NO: 130977 - RNA, 1701 nt, Artificial Sequence
  derived and/or modified sequence opt3 from hemagglutinin__InfluenzaA__AFK14247
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaugaacacuucucuccccuuccagaauauccacccuauuacaaucgguaagugcccaaaguauguaaaauccaccaagcugcgcauggccacugggcuuagaaacgugcccucaauccagaguaggggacuguuuggcgcgauugccggcuucauagaagggggauggacagguauggucgacggcugguacggguaucaucaccagaaugaacaaggaagcggcuacgcagcugauuugaaauccacccagaacgccaucgacgagauuacgaauaaggugaacucuguuaucgagaaaaugaauacccaguuuacagcuguggguaaggaguucaaccaccucgaaaagcggauagaaaaucugaacaaaaaggucgaugacggguucuuagauauuuggacuuacaaugccgagcugcucgugcuucuggaaaacgagcgcaccuuggacuaucaugauagcaauguuaaaaaccuauacgagaagguacgaucacagcugaaaaacaaugcaaaggaaaucggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauccuugcuauuuacucuacaguggcgucaagucuggucuuggugguuagccucggagcaauauccuuuuggaugugcucuaacgguucgcugcagugccggaucuguauuuga

SEQ ID NO: 130978 - RNA, 1701 nt, Artificial Sequence
  derived and/or modified sequence opt3 from hemagglutinin__InfluenzaA__AFK14272
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucacaggagucgcuccccugcaucuugguaaaugcgacaucgccggcuggauucuggggaacccugagugugaaucuuugucaaccgcaaguagcugguccuacaucguggagacuucuucgucagauaauggaacaugcuauccaggcgacuuuauugauuacgaggagcucagagagcagcugagcaguguuuccucuuucgaaagguuugagaucuucccgaagaccagcuccuggcccaaccacgacucaaauaagggugugacggccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccucaacuagcgcugaccaacagaguuuguaccagaaugccgaugcguacguuuucguggggaccucucgguauuccaagaaauuuaagccugagaucgcaauucgcccaaaaguccgagaccaggagggacguaugaacuacuauuggacacugguggaacccggugauaagaucacuuucgaggccaccggcaaucuaguggucccuagauacgcuuuugccauggaaaggaacgcagggagcggaauaauuaucucggacacaccaguucaugacugcaacaccacgugucaaacuccgaaaggcgcuauuaauacaucucuccccuuccagaacauccacccuaucaccauugguaagugcccaaaguaugugaaauccacuaagcugcggcuugccacagggcugcgcaauguacccucaauacagaguagaggauuguuuggcgcgaucgccggcuucauugaagggggauggaccgguaugguggauggcugguacggguaucaucaccagaacgaacaaggaagcggcuacgcagcugaccucaaauccacgcagcacgccaucgaugagauaaccaauaaggucaacucugugauugagaaaaugaauacacaguuuacugcuguugguaaggaguucaaccaucuggaaaagaggaucgaaaauuuaaacaaaaagguggacgauggguuccuggacaucuggaccuacaaugccgagcuccuuguccuguuggaaaacgagcggacacuagauuaucacgacagcaaugugaaaaaccuguacgagaagguacgcucacagcucaaaaauaacgcaaaggaaauuggcaacggauguuuugaguucuaucauaagugcgauaauacuuguauggaaaguguuaaaaacggcaccuacgacuauccuaaguacuccgaggaagccaaacugaaucgagaggagaucgauggggugaaacuugaaagcacaagaauuuaucaaauacuggcuaucuacucuaccgucgcgucaaguuuggugcucgucgugagccugggagcaauuuccuuuuggaugugcucuaacgguucguuacagugcaggaucuguaucuga

SEQ ID NO: 130979 - RNA, 1701 nt, Artificial Sequence; identical to SEQ ID NO: 125038
  derived and/or modified sequence opt3 from hemagglutinin__InfluenzaA__AFK14314

SEQ ID NO: 130980 - RNA, 1701 nt, Artificial Sequence
  derived and/or modified sequence opt3 from hemagglutinin__InfluenzaA__AFK14323
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuuaucaacuacgaggagcucagggagcagcugucaagcgugaguuccuucgaacgguuugagauuuucccgaagacaucuagcuggcccaaucacgacuccaacaagggugucaccgccgcuuguccucaugcaggggccaaaucauuuuauaagaaucugaucuggcucgugaaaaagggaaacaguuacccaaaauuaagcaagucuuauauaaaugauaagggcaaagaaguacugguucuuuggggcauccaccaccccuccacgucagcugaccaacagagcuuguaccagaacgccgaugcguacguguucgucgggaccagucgcuauucuaagaaauuuaagccugagauugcaauccgaccaaaagugcgugaccaggagggaagaaugaacuacuauuggacucugguggaacccggugauaagauuacauucgaggccacuggcaaucuagucguuccuagguacgcuuuugccauggaacggaacgcaggguccggaaucauaauuagcgacaccccagugcaugauugcaauacaaccugucaaacgccgaaaggcgcuaucaacacuucgcuccccuuccagaauauucacccuaucacaaucgguaagugcccaaaguauguaaaaucuaccaagcugcgccuugccacugggcugagaaacgugcccuccauucagucaaggggauuguuuggcgcgauagccggcuucaucgaagggggauggacagguauggucgacggcugguacggguaucaucaccagaaugaacaaggaaguggcuacgcagcugaccucaaaagcacccagaacgccauugauaagaucacgaauaaagugaacuccguuauagagaagaugaauacccaguuuacagcuguggguaaggaguucaaccaccuggaaaaacggauugagaauuuaaacaagaaagucgacgauggguuccuggacaucuggacuuacaaugccgaacuccuugugcuguuggagaacgaacgcacccuagauuaucaugacucuaacguaaagaaucuguacgagaaaguucgaagccagcucaagaacaaugcaaaggagaucggcaacggauguuuugaguucuaucacaaaugcgauaauacauguauggaaucagugaagaacggcacuuacgacuauccuaaauacagugaagaggccaagcugaauagagaagagauugauggggucaaacuugaguccaccaggaucuaucaaauucuggcuauauacagcacaguggcgucuucauugguccucgugguuagucugggagcaaucagcuuuuggaugugcuccaacgguucuuuacagugccggauuuguaucuga

SEQ ID NO: 130981 - RNA, 1701 nt, Artificial Sequence; identical to SEQ ID NO: 129450
  derived and/or modified sequence opt3 from hemagglutinin__InfluenzaA__AFK14332

SEQ ID NO: 130982 - RNA, 1701 nt, Artificial Sequence
  derived and/or modified sequence opt3 from hemagglutinin__InfluenzaA__AFK14341
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaccucaaauccacccagaacgccauugaugagaucacgaauaaggugaacucuguuauagagaaaaugaauacccaguuuacagcuguggguaaggaguucaaccaccuggaaaagcggauugagaauuuaaacaaaaaggucgacgauggguuccuggacaucuggacuuacaaugccgaacuccuugugcuguuggagaacgagaaaacccuagauuaucaugacagcaauguaaagaaccuguacgaaaaaguucgcucacagcucaagaacaaugcaaaggagaucggcaacggauguuuugaguucuaucacaaaugcgauaauacauguauggaaagugugaagaacggcacuuacgacuauccuaaauacuccgaagaggccaagcugaaucgagaggaaauugauggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 130983 - RNA, 1701 nt, Artificial Sequence; identical to SEQ ID NO: 126105
  derived and/or modified sequence opt3 from hemagglutinin__InfluenzaA__AFK14350

SEQ ID NO: 130984 - RNA, 1701 nt, Artificial Sequence
  derived and/or modified sequence opt3 from hemagglutinin__InfluenzaA__AFK14358
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggagccugcuauccaggcgauuuuaucgacuacgaagaacucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugagcaggaaggaagaaugaauuacuauuggacucugguggagcccggugauaagauuaccuucgaagcuacaggcaaccuagucguuccuagguacgccuuugcaauggagcggaacgcugggagcggaaucauaauuucggacacuccagugcaugauugcaauaccacaugucaaaccccgaaaggcgccaucaacacgucucuccccuuccagaauauucacccuaucacuaucgguaagugcccaaaguauguaaaauccacaaagcugcgccuugcgaccgggcugagaaacgugcccucaauucagaguaggggauuguuuggcgccauagcaggcuucaucgaagggggauggacugguauggucgacggcugguacggguaucaucaccagaaugagcaaggaagcggcuacgcugccgaccucaaauccacacagaacgcuauugaugagaucaccaauaaggugaacucuguuauagagaaaaugaauacgcaguuuaccgccguggguaaggaguucaaccaccuggaaaagcggauugagaauuuaaacaaaaaggucgacgauggguuccuggacaucuggacauacaaugcagaacuccuugugcuguuggagaacgagaaaacucuagauuaucaugacagcaauguaaagaaccuguacgaaaaaguucgcucacagcucaagaacaaugccaaggagaucggcaacggauguuuugaguucuaucacaaaugcgauaauaccuguauggaaagugugaagaacggcacauacgacuauccuaaauacuccgaagaggcuaagcugaaucgagaggaaauugauggggucaaacuugagagcacuagaaucuaucaaauucuggcgauauacucuaccguggcaucaaguuugguccucgugguuagccugggagccaucuccuuuuggaugugcucuaacgguucguuacagugcaggauuuguaucuga

SEQ ID NO: 130985 - RNA, 1701 nt, Artificial Sequence
  derived and/or modified sequence opt3 from hemagglutinin__InfluenzaA__AFK14395
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagaaaacggaaugugcuguccaagggacuuuauugauuaugaggaguugcgggaacagcucagcaguguguccucuuucgagcgcuuugaaaucuucccgaagacuagcuccuggcccaaucacgacucaaacaagggcgucacagccgcuugcccucaugcaggcgccaaaaguuuuuacaagaaucugauauggcuggugaaaaaggggaacagcuauccaaaacucucuaaguccuacaucaaugauaagggaaaagagguauuaguucuguggggcauucaccaccccucaaccagcgcugaccaacagagucuuuaucagaacgccgaugcguacguguucgucgguucuucccgauacagcaagaaauuuaagccugagaucgcaauucguccaaaagugagagaccaggaagggaggaugaauuauuacuggacguugguggagcccggagauaagaucacuuucgaagccaccgguaaccuggucguuccucgguaugcuuuugccauggagcgcaacgcaggcucggggauaauuaucucugacacaccagugcaugauuguaauacuaccugccaaacaccgaaaggagcuauuaacaccucccuacccuuccagaauauccacccuaucacgauuggcaaguguccaaaguacguaaaaucaacuaagcucagacuggccacaggucuuaggaacgugcccaguauacagagccgggggcuguuuggagcgaucgccggcuucauugaaggcggguggaccggaauggucgacgguugguauggcuaccaucaccagaaugagcaaggguccggauaugcagcugacuugaaaucuacucagaacgccaucgaugagauaacaaauaaggugaacagcguuauugaaaagaugaauacccaguuuacggcugugggcaaagaguucaaccaccucgaaaagcgcaucgagaaucugaacaaaaaggucgacgaugguuucuuagacaucuggaccuacaaugccgaacugcucgugcuucuggagaacgagcgaacauuggauuaccaugacucaaauguuaaaaaccuauaugaaaagguaagaagucagcugaaaaacaaugcaaaggagguggggaacggcugcuuugaguucuaccacaagugugauaauacuugcauggaauccgucaaaaacggaaccuaugacuacccuaaguauagcgaagaggccaaacucaauagggaggaaauugauggcgugaagcuggagucuacacggaucuaccaaauucuugcuauauauucaacugcggcaaguagccuggucuuggugguuucccucggggccaucucuuuuuggaugugcucgaacggaagccugcagugucguauuugcaucuga

SEQ ID NO: 130986 - RNA, 1701 nt, Artificial Sequence
  derived and/or modified sequence opt3 from hemagglutinin__InfluenzaA__AFK14431
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaacucggacaauggaacuugcuauccaggcgauuuucucgacuacgaggaacugaggaagcagcugucaagcgugaguuccuucgagcgggucgaaaucuuuccgaagacaucuagcuggcccaaccacgauuccaauaaaggugugaccgccgcuuguccucaugcaggggccaagucauucuauaaaaaccucauuugguuaguaaagaaaggaaauaguuacccaaagcugagcaagucuuauaucaacgacaaaggcaaggagguucuuguguuguggggcauacaccaccccuccacgucagcugaucaacagagccuguaccagaaugccgacgcguacgucuuuguggggacuagccgcuauucuaaaaaguucaaaccugaaaucgcaauucgaccaaaggugcgugaucaggagggaagaaugaacuacuauuggacccuagucgagcccggugacaaaaucacauuugaagccacuggcaaccucguugugccuagguacgcuuucgccauggagcggaaugcaggguccggaauuaucauaagcgauaccccaguacaugacugcaacacaaccugucaaacgccgaagggcgcuauuaauacuucgcugcccuuucagaacauccacccuauuacaaucgguaagugcccaaaauaugugaagucuaccaaacuucgccuggccacuggguugagaaauguccccuccauccagucaaggggacucuucggcgcgauugccggcuuuauagaagggggauggacagguaugguggacggcugguacggguaucaucaccagaacgagcaaggaaguggcuacgcagcugauuuaaagagcacccagaaugccaucgacaaaauuacgaacaagguuaauuccgugaucgaaaagaugaacacccaguucacagcugucgguaaagaguuuaaucaccuggagaagcggauagaaaaccugaauaaaaagguggaugacggguuccucgauauuuggacuuacaacgccgagcuucugguauugcuagaaaaugagcgcacccuggacuaucaugauucuaacguuaaaaaccucuacgaaaaggugcgaagccagcugaagaauaacgcaaaagagaucggcaauggauguuucgaguuuuaucacaagugcgacaacacauguauggaaucagucaaaaauggcacuuacgauuauccuaaguacagugaggaagccaaacuuaacagagaggaaaucgacggggugaagcuggaguccaccaggauuuaucaaaucuuggcuauuuacagcacagucgcgucuucacucgugcugguugugaguuuaggagcaauaaguuucuggaugugcuccaaugguucucugcagugccggaucuguauuuga

SEQ ID NO: 130987 - RNA, 1701 nt, Artificial Sequence; identical to SEQ ID NO: 124685
  derived and/or modified sequence opt3 from hemagglutinin__InfluenzaA__AFK14456

SEQ ID NO: 130988 - RNA, 1701 nt, Artificial Sequence; identical to SEQ ID NO: 124685
  derived and/or modified sequence opt3 from hemagglutinin__InfluenzaA__AFK14465

SEQ ID NO: 130989 - RNA, 1701 nt, Artificial Sequence
  derived and/or modified sequence opt3 from hemagglutinin__InfluenzaA__AFK14536
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccuauucuucggacaacggaacuugcuacccaggcgauuuuaucgacuaugaggagcucagggagcagcugucaagcgugaguuccuucgaacgguuugagauuuucccgaagacaucuagcuggcccaaucacgauuccaacaagggugucaccgccgcuuguccucaugcaggggccaaaucauuuuacaagaaucugaucuggcucgugaaaaagggaaacaguuauccaaaauuaagcaagucuuacauaaaugacaagggcaaagaaguacugguucuuuggggcauccaccaccccuccacgucagcugaucaacagagcuuguaccagaacgccgacgcguauguguucgucgggacuucccgcuacucuaagaaauuuaagccugagauugcaauccgaccaaaagugcgugaucaggagggaagaaugaauuauuacuggacccugguggaacccggugacaagauuacauucgaggccacuggcaaccuagucguuccuagguaugcuuuugccauggaacggaacgcaggguccggaaucauaauuagcgauaccccagugcaugacugcaauacaaccugucaaacgccgaaaggcgcuaucaacacuucgcuccccuuccagaauauucacccuaucacaaucgguaagugcccaaaguacguaaaaucuaccaagcugcgccuugccacugggcugagaaacgugcccuccauucagucaaggggauuguuuggcgcgauagccggcuucaucgaagggggauggacagguauggucgacggcugguauggguaccaucaccagaaugaacaaggaaguggcuacgcagcugaucucaaaagcacccagcacgccauugacgagaucacgaacaaggugaauaguguuauagagaaaaugaacacccaguuuacagcuguggguaaggaguucaaucaucuggaaaagcggauugaaaacuuaaauaaaaaggucgaugacggguuccuggauaucuggacuuauaacgccgagcuccuugugcuguuggaaaaugagcgcacccuagacuaccacgauucuaacguaaagaaucuguaugagaagguucgaagccagcucaaaaacaacgcaaaggaaaucggcaauggauguuuugaguucuaccauaagugcgacaacacauguauggaaucagugaaaaauggcacuuaugauuacccuaaguauagugaggaagccaaacugaacagagaggagauugacggggucaaacuugaauccaccaggaucuaccaaauucuggcuauauacagcacaguggcgucuucauugguccucgugguuagucugggagcaaucagcuuuuggaugugcuccaaugguucuuuacagugccggauuuguaucuga

SEQ ID NO: 130990 - RNA, 1701 nt, Artificial Sequence; identical to SEQ ID NO: 124685
  derived and/or modified sequence opt3 from hemagglutinin__InfluenzaA__AFK14571

SEQ ID NO: 130991 - RNA, 1701 nt, Artificial Sequence; identical to SEQ ID NO: 129194
  derived and/or modified sequence opt3 from hemagglutinin__InfluenzaA__AFK14586

SEQ ID NO: 130992 - RNA, 1701 nt, Artificial Sequence
  derived and/or modified sequence opt3 from hemagglutinin__InfluenzaA__AFK14595
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucaaaggaguggcuccccugcaucuugguaagugcaacauagccggcuggauccuggggaauccuaagugugagucuuugucaacagcaaguagcugguccuacauuggagaaaccucuucgucaaacaauggcacuugcuauccagguaacuuuaucgacuucgaggaacucaaaaagcagcugagcaguguuuccucuuuugagagauucgagauuuuuccgaaaacaagcuccuggcccaaucacgauucaaacaagggggugaccgccgcuuguccucaugcaggagccaaaaguuucuacaagaaucugaucuggcucgucaagaaaggcaacagcuauccaaaguuaucuaaauccuacauaaaugacaagggcaaagaagugcugguacuuugggggauccaccaccccucaacgagcgcugaucaacagaguuuguaucagaacgccgacgcguacguuuuugugggaacuucuagguacuccaagaaauucaagccugagauugcaauccggccaaagguccgcgaucaggaaggucgaaugaacuauuacuggacccugguggagcccggcgacaaaauuacauuugaggccacugggaaucuaguggucccucguuaugcuuucgccauggaaagaaacgcaggaagcggcaucauaauuucggauaccccaguucaugacugcaauacaaccugucaaacgccgaagggugcuaucaacacuucucuccccuuucagaauauucacccuaucacaaucgggaaaugcccaaaguacgugaaauccaccaagcugaggcuugccacuggacugcggaacguacccucaauucagagucgcggcuuguucggcgcgauagccggguuuaucgagggagguuggacaggcaugguggaugggugguauggauaccaucaccagaaugaacaaggcagcgguuaugcagcugaccucaaguccacccagaacgccauugacgagaucacgaauaaagucaacucugugauagaaaagaugaauacccaguucacagcuguugggaaagaguucaaccaccuggagaagagaauugaaaauuuaaacaaaaagguggaugacggcuuucuggauaucuggacuuacaaugccgagcuccuuguccuguuggaaaacgagaggacccuagacuaccaugauagcaacgugaagaaucuguaugaaaaaguacggucacagcucaagaacaaugcaaaagagaucggaaacggcuguuucgaguuuuaccacaagugcgacaauacauguauggaaaguguuaaaaacgggacuuaugauuacccuaaguauuccgaggaagccaagcugaaucgcgaggaaauugacggagugaaacuugagagcacccgaaucuaccaaauucuggcuauauauucuacagucgcgucaaguuuggugcucgucgugagccugggugcaaucuccuucuggaugugcucuaacggcucguuacagugcagaauuuguaucuga

SEQ ID NO: 130993 - RNA, 1701 nt, Artificial Sequence; identical to SEQ ID NO: 129194
  derived and/or modified sequence opt3 from hemagglutinin__InfluenzaA__AFK14612

SEQ ID NO: 130994 - RNA, 1701 nt, Artificial Sequence; identical to SEQ ID NO: 124685
  derived and/or modified sequence opt3 from hemagglutinin__InfluenzaA__AFK14621

SEQ ID NO: 130995 - RNA, 1701 nt, Artificial Sequence
  derived and/or modified sequence opt3 from hemagglutinin__InfluenzaA__AFK14630
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgcgcgcugauuugcaaagcauuaaccagaaugccgacgcguacguguucgucgggacuucccgauacucuaagaaauuuaagccugagaucgcaauucguccaaaagugagagaucaggagggaaggaugaacuauuacuggacccugguggaacccggugacaagaucacauucgaggccacuggcaaccuagucguuccucgguaugcuuuugccauggaacgcaaugcaggguccggaauaauuaucagcgauaccccagugcaugacugcaacacaaccugucagacgccgaaaggcgcuauuaauacuucgcuccccuuccaaaacauccacccuaucacaauugguaagugcccaaaguacguaaaaucuaccaagcugagacuugccacugggcugaggaaugugcccuccauacagucacggggauuguuuggcgcgaucgccggcuucauugaagggggauggacagguauggucgacggcugguauggguaccaucaccagaacgaacagggaaguggcuaugcagcugaucucaaaagcacccaaaaugccaucgacgagauaacgaacaaggugaauaguguuauugagaaaaugaacacccaguuuacagcuguggguaaggaguucaaucaccuggaaaagcgcaucgaaaacuuaaauaaaaaggucgaugacggguuccuggauaucuggacuuacaacgccgagcuccuugugcuguuggaaaaugagcgaacccuagacuaccaugauucuaacguaaagaaccuguaugagaagguuagaagccagcucaaaaauaacgcaaaggaaauuggcaauggauguuuugaguucuaccacaagugcgacaacacauguauggaaucagugaaaaauggcacuuaugauuacccuaaguauagugaggaagccaaacugaacagggaggagaucgacggggucaaacuugaauccacccggauuuaccagauacuggcuaucuauagcacaguggcgucuucauugguccucgugguuagucugggagcaauuagcuuuuggaugugcuccaaugguucuuuacaaugccguaucuguaucuga

SEQ ID NO: 130996 - RNA, 1701 nt, Artificial Sequence
  derived and/or modified sequence opt3 from hemagglutinin__InfluenzaA__AFK14639
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguucgucgggucuucccgcuauagcaagaaauuuaagccugagaucgcaauucgaccaaaagugcgugaucaggagggaagaaugaauuacuauuggacuuugguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaggccagcugaaaaacaaugcaaaggaaauuggaaacggcuguuuugaguucuaucacaagugcgacaauaccuguauggaaagugugaaaaacgggacauacgauuauccuaaguacuccgaggaagccaaacucaauagagaggagaucgacggagucaagcuggaaagcacuaggauuuaucaaauacuugcuaucuacucuaccguggcgucaagucuggucuuggugguuagccucggugcaauuuccuuuuggaugugcucuaacggcucgcugcagugccggaucuguaucuga

SEQ ID NO: 130997 - RNA, 1701 nt, Artificial Sequence; identical to SEQ ID NO: 124685
  derived and/or modified sequence opt3 from hemagglutinin__InfluenzaA__AFK14661

SEQ ID NO: 130998 - RNA, 1701 nt, Artificial Sequence; identical to SEQ ID NO: 129194
  derived and/or modified sequence opt3 from hemagglutinin__InfluenzaA__AFK14670

SEQ ID NO: 130999 - RNA, 1701 nt, Artificial Sequence; identical to SEQ ID NO: 129194
  derived and/or modified sequence opt3 from hemagglutinin__InfluenzaA__AFK14678

SEQ ID NO: 131000 - RNA, 1701 nt, Artificial Sequence
  derived and/or modified sequence opt3 from hemagglutinin__InfluenzaA__AFK14688
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuauccacgacgaggagcucaggaagcagcugagcaguguguccucuuucgagcgguuugaaauuuucccgaagacaagcuccuggcccaaucaugauucaaacaaaggugucaccgccgcuuguccucacgcaggggccaagaguuuuuacaaaaaucugaucuggcucgugaagaaaggaaacagcuauccaaaguuaucuaaguccuacauaaaugacaaaggcaaggagguacugguucuuuggggcauccaccaucccucaacgagcgcugaucaacagaguuuguaucagaacgccgacgcguacguguucgucgggacuucucgcuacuccaaaaaguuuaaaccugaaauugcaauccgaccaaaggugcgugaucaggagggaagaaugaauuauuacuggacccugguggagcccggugacaaaauuacauucgaagccacuggcaaccuagucguuccuagguaugcuuuugccauggagcggaaggcagggagcggaaucauaauucucgauaccccagugcacgacuggaacacaaccugcgaaacgccgaagggcgcuguaaauacuucgcugcccuuccaaaacauccauccuauuacaaucgguaaauguccaaaguacgugaaaucuaccaagcugcgccuugccacuggguugagaaauguccccuccauccagucaaggggacucuuuggcgcgauugccggcuucauagaagggggauggacagguaugguggacggcugguauggguaccaccaccagaacgaacagggaaguggcuaugcagcugaucugaaaagcacccaaaaugccaucgacgagauuacgaacaagguuaauuccgugaucgagaagaugaacacccaguuuacagcugucgguaaagaguucaaucauuuagaaaagcggauagaaaaccugaauaaaaagguggaugacggguuccucgauauuuggacuuacaacgccgagcuucugguauugcuagaaaaugagcgcacccuggacuaccacgauucuaacguuaaaaaucucuaugagaaggugcgaagccagcugaagaacaacgcaaaagaaaucggcaauggaugcuuugaguucuaccauaagugugacaacacaugcauggaaucagucaaaaauggcacuuaugauuacccuaaguauagugaggaagccaaacuuaacagagaggagaucgacggggugaagcuggaauccaccaggauuuaccagaucuuggcuauuuauagcacagucgcgucuucacucgugcugguugugaguuuaggagcaaucagcuuuuggauguguuccaaugguucucugcaaugccggauaugcauuuga

SEQ ID NO: 131001 - RNA, 1701 nt, Artificial Sequence; identical to SEQ ID NO: 129194
  derived and/or modified sequence opt3 from hemagglutinin__InfluenzaA__AFK14697

SEQ ID NO: 131002 - RNA, 1701 nt, Artificial Sequence; identical to SEQ ID NO: 129194
  derived and/or modified sequence opt3 from hemagglutinin__InfluenzaA__AFK14713

SEQ ID NO: 131003 - RNA, 1701 nt, Artificial Sequence; identical to SEQ ID NO: 129194
  derived and/or modified sequence opt3 from hemagglutinin__InfluenzaA__AFK14722

SEQ ID NO: 131004 - RNA, 1701 nt, Artificial Sequence
  derived and/or modified sequence opt3 from hemagglutinin__InfluenzaA__AFK14731
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucaggaagcagcugagcaguguguccucuuucgagcgggucgaaauuuuuccgaagacaagcuccuggcccaaucacgauucaaacaaaggugugaccgccgcuuguccucaugcaggggccaagaguuucuauaaaaaucugaucuggcucguaaagaaaggaaacagcuacccaaaguuaucuaaguccuauauaaaugacaaaggcaaggagguucuggugcuuuggggcauccaccaccccucaacgagcgcugaucaacagaguuuguaccagaacgccgacgcguacgucuuuguggggacuucucgcuauuccaaaaaguucaaaccugaaauugcaauccgaccaaaggugcgugaucaggagggaagaaugaauuacuauuggacccuggucgagcccggugacaaaauuacauuugaagccacuggcaaccuaguugugccuagguacgcuuucgccauggagcggaacgcagggagcggaaucauaauuucggauaccccaguacaugacugcaauacaaccugucaaacgccgaagggcgcugugaacacuucucuccccuuucagaauauccacccuauuacaaucgguaagugcccaaaauaugucaaguccaccaaacugcgccuugccacugggcugagaaacgugcccucaauccagaguaggggauuguucggcgcgauugccggcuuuauagaagggggauggacagguaugguugacggcugguacggguaucaucaccagaaugagcaaggaagcggcuacgcagcugaucucaaguccacccagaacgccaucgacgaaauuacgaauaaagugaacucugucaucgagaagaugaauacccaguucacagcuguggguaaggaguuuaaccaccuggaaaaacggauagagaauuuaaacaagaaaguagaugacggguuccuggauauuuggacuuacaaugccgaacuccuuguucuguuggagaacgaacgcacccuagacuaucaugauagcaaugugaagaaccuguacgagaaaguccgaucacagcucaagaacaaugcaaaggagaucggcaacggauguuucgaauuuuaucacaaaugcgacaauacauguauggagagugugaagaacggcacuuacgauuauccuaaauacuccgaagaggccaagcugaauagagaagagaucgacggggucaaacuugagagcaccaggauuuaucaaauccuggcuauuuacucuacaguggcgucaaguuugguucucgugguaagccugggagcaauauccuucuggaugugcucuaacgguucguuacagugccggaucuguauuuga

SEQ ID NO: 131005 - RNA, 1701 nt, Artificial Sequence; identical to SEQ ID NO: 129194
  derived and/or modified sequence opt3 from hemagglutinin__InfluenzaA__AFK14740

SEQ ID NO: 131006 - RNA, 1701 nt, Artificial Sequence; identical to SEQ ID NO: 129194
  derived and/or modified sequence opt3 from hemagglutinin__InfluenzaA__AFK14749

SEQ ID NO: 131007 - RNA, 1701 nt, Artificial Sequence; identical to SEQ ID NO: 129194
  derived and/or modified sequence opt3 from hemagglutinin__InfluenzaA__AFK14756

SEQ ID NO: 131008 - RNA, 1701 nt, Artificial Sequence; identical to SEQ ID NO: 129194
  derived and/or modified sequence opt3 from hemagglutinin__InfluenzaA__AFK14764

SEQ ID NO: 131009 - RNA, 1701 nt, Artificial Sequence
  derived and/or modified sequence opt3 from hemagglutinin__InfluenzaA__AFK14779
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucggagguguggcuccccugcaucuuggcaaaugcaacauagccggguggauccugggaaauccugagugugaaucuuugucaacagcaaguagcugguccuacauuguugagaccucuucgucagacaacggcacuugcuauccagguaauuuuaucgauuacgaagaacucagagagcagcugagcaguguguccucuuucgaaagguuugagauuuucccgaagacaagcuccuggcccaaccacgacucaaauaagggggucaccgccgcuuguccucaugcaggagccaaaaguuuuuauaagaaccugaucuggcucgugaaaaagggcaauagcuacccaaaauuaucuaaguccuauauaaacgauaagggcaaagaaguacugguucuuugggggauccaccaccccucaacgagcgcugaccaacagaguuuguaccagaaugccgaugcguacguguucgucggaacuucucgguauuccaagaaauuuaagccugagauugcaauccgcccaaaagugcgagaccaggagggucguaugaacuacuauuggacccugguggaacccggcgauaagauuacauucgaggccacugggaaccuagucguuccuagauacgcuuuugccauggaaaggaaugcaggaagcggcaucauaauuucggacaccccagugcaugauugcaacacaaccugucaaacgccgaaaggugcuaucaauacuucucuccccuuccagaacauucacccuaucacaaucgggaagugcccaaaguauguaaaauccaccaagcugcggcuugccacuggacugcgcaaugugcccucaauucagaguagaggcuuguuuggcgcgauagccggguucaucgagggagguuggacaggcauggucgacgggugguacggauaucaucaccagaacgaacaaggcagcgguuacgcagcugaccucaaauccacccagaaugccauugaugagaucacgaacaagguaaauucuguuauagagaaaaugaacacccaguuuacagcuguggggaaggaguucaaucaccuggagaagaggauugaaaacuuaaauaaaaaggucgacgauggcuuccuggacaucuggacuuacaacgccgagcuccuugugcuguuggaaaaugagcggacccuagauuaucaugacagcaacgugaaaaaccuguacgagaagguucgcucacagcucaaaaauaacgcaaaggaaaucggaaauggcuguuuugaguucuaucacaagugcgauaacacauguauggaaagugugaaaaaugggacuuacgacuauccuaaguacuccgaggaagccaaacugaaccgagaggagauugauggagucaaacuugaaagcaccagaaucuaucaaauucuggcuauauacucuacaguggcgucaaguuugguccucgugguuagccugggugcaaucuccuuuuggaugugcucuaauggcucguuacagugcaggauuuguaucuga

SEQ ID NO: 131010 - RNA, 1701 nt, Artificial Sequence
  derived and/or modified sequence opt3 from hemagglutinin__InfluenzaA__AFK14788
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaaguuuuuauaagaaucugauauggcuggugaaaaagggaaacagcuacccaaaacuccgcaagucuuauaucaaugacaagggcaaagaaguauuaguucuguggggcauucaccaccccuccacgucagcugaucaacagagccuuuaccagaacgccgacgcguacguguucgucgggaguucucgauauuccaagaaauuuaagccugagaucgcaauucguccaaaagugagagaucaggagggaaggaugaauuacuauuggacuuugguggaacccggugacaagaucaccuucgaggccacaggcaaccuggucguuccucgguacgcuuuugccauggaacgcaacgcagggagcggaauaauuaucucggauacuccagugcaugacugcaauaccacaugucaaaccccgaaaggcgcuauuaacacgucucuacccuuccagaauauccacccuaucacuauugguaagugcccaaaguauguaaaauccacaaagcucagacuggccaccgggcuuaggaacgugcccucaauacagagucggggacuguuuggcgcgaucgccggcuucauugaagggggauggacugguauggucgacggcugguacggguaucaucaccagaaugaacaaggaagcggcuacgcagcugauuugaaauccacacagaacgccaucgacgagauaaccaauaaggugaacucuguuauugagaaaaugaauacgcaguuuaccgcuguggguaaggaguucaaccaccucgagaagcgcaucgaaaaucugaacaaaaaggucgaugacggguucuuagauaucuggacauacaaugccgagcugcucgugcuucuggaaaacgagcgaacuuuggacuaucaugauagcaauguuaaaaaccuauacgagaagguaagaucacagcugaaaaacaaugcaaaggaagugggcaacggauguuuugaguucuaucacaagugcgacaauaccuguauggaaagugucaaaaacggcacauacgauuauccuaaguacuccgaggaagccaaacucaauagggaggagauugacggggugaagcuggaaagcacucggaucuaucaaauucuugcuauauacucuaccgcggcaucaagucuggucuuggugguuagccucggagccaucuccuuuuggaugugcucuaacgguucgcugcagugccguauuuguaucuga

SEQ ID NO: 131011 - RNA, 1701 nt, Artificial Sequence
  derived and/or modified sequence opt3 from hemagglutinin__InfluenzaA__AFK14798
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggaacucaggaagcagcugagcaguguguccucuuucgagcgggucgaaauuuuuccgaagacaagcuccuggcccaaccacgacucaaauaaaggugugaccgccgcuuguccucaugcaggggccaagaguuucuauaaaaaccugaucuggcucguaaagaaaggaaauagcuacccaaaguuaucuaaguccuauauaaacgauaaaggcaaggagguucuggugcuuuggggcauccaccaccccucaacgagcgcugaccaacagaguuuguaccagaaugccgaugcguacgucuuuguggggacuucucgcuauuccaaaaaguucaaaccugaaauugcaauccgaccaaaggugcgugaccaggagggaagaaugaacuacuauuggacccuggucgagcccggugauaaaauuacauuugaagccacuggcaaccuaguugugccuagguacgcuuucgccauggagcggaaugcagggagcggaaucauaauuucggacaccccaguacaugauugcaacacaaccugucaaacgccgaauggcgcuaucaacacuucucuccccuuucagaauauucacccuaucacaaucgguaagugcccaaaguaugugaaauccaccaagcugcgccuugccacugggcugagaaacguccccucaauucagaguaggggauuguucggcgcgauagccggcuuuaucgaagggggauggacagguaugguggacggcugguacggguaucaucaccagaaugagcaaggaagcggcuacgcagcugaccucaaauccacccagaacgccauugauaagaucacgaauaaaguuaacucugugauagaaaagaugaauacccaguucacagcugucgguaaggaguuuaaccaccuggagaaacggauugaaaauuuaaacaagaaaguggacgauggguuccuggacaucuggacuuacaaugccgagcuccuuguacuguuggaaaacgagcgcacccuagauuaucaugacagcaacguuaagaaucuguacgaaaaagugcgaucacagcucaagaacaaugcaaaggagaucggcaacggauguuucgaguuuuaucacaaaugcgauaauacauguauggaaagugucaagaacggcacuuacgacuauccuaaauacuccgaggaagccaagcugaauagagaggaaauugauggggugaaacuugagagcaccaggaucuaucaaauucuggcuauauacucuacagucgcgucaaguuuggugcucguugugagccugggagcaaucuccuucuggaugugcucuaacgguucguuacagugccggauuuguaucuga

SEQ ID NO: 131012 - RNA, 1701 nt, Artificial Sequence
  derived and/or modified sequence opt3 from hemagglutinin__InfluenzaA__AFK14814
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuaugaacgguacgagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuacauaaaugacaagggcaaagaaguacugguucuuuggggcauccaccaccccucaacgagcgcugaucaacagaguuuguaucagaacgccgacgcguacguguucgucgggacuucucgcuauuccaagaaauuuaagccugagauugcaauccgaccaaaagugcgugagcaggaaggaagaaugaauuacuauuggacccugguggagcccggugauaagauuacauucgaagccacuggcaaccuagucguuccuagguacgcuuuugccauggagcggaacgcagggagcggaaucauaauuucggacaccccagugcaugauugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaccaucaccagaaugagcaaggaagcggcuaugcagcugaccucaaauccacccagaacgccauugaugagaucacgaauaaggugaacucuguuauagaaaagaugaauacccaguuuacagcuguggguaaggaguucaaccaccuggaaaagcggauugagaauuuaaacaaaaaggucgacgauggguuucuggacaucuggacuuacaaugccgaacuccuugugcuguuggagaacgagcgcacccuagauuaucaugacagcaauguuaaaaaccuguacgaaaagguacgaucacagcucaaaaacaaugcaaaggagaucggcaacggauguuucgaguucuaucacaagugcgauaauacauguauggagagugugaaaaacggcacuuacgacuauccuaaguacuccgaagaggccaaacugaauagagaggaaauugauggggucaaacuugagagcaccaggaucuaccaaauucuggcuauauauucuacaguggcgucaaguuugguccucgugguuagccugggagcaaucuccuuuuggaugugcucuaacgguucguuacagugccggauuuguaucuga

SEQ ID NO: 131013 - RNA, 1701 nt, Artificial Sequence
  derived and/or modified sequence opt3 from hemagglutinin__InfluenzaA__AFK14831
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuagcgacuacgaggagcucagggagcagcugaguuccgugucuagcuucgaacgguuugagaucuucccgaagacauccucauggcccaaucacgauaguaacaagggugucaccgccgcuuguccucaugcaggggccaagagcuuuuauaagaaucugauuuggcucgugaaaaagggaaacucuuacccaaaauuauccaagucauauaucaaugacaagggcaaagaaguacugguucuuuggggcauacaccaccccagcacgagugcugaucaacagucuuuguaccagaacgccgacgcguacguguucgucgggacuucccgcuauagcaagaaauuuaagccugagaucgcaauucgaccaaaagugcgugaucaggagggaagaaugaauuacuauuggacccugguggaacccggugacaagaucacauucgaggccacuggcaaccuagucguuccuagguacgcuuuugccauggaacggaacgcagggucgggaauuaucauaucugauaccccagugcaugacugcaauacaaccugucaaacgccgaaaggcgcuauuaacacuucccuccccuuccagaauauccacccuauuacaaucgguaagugcccaaaguauguaaaaucaaccaagcugcgccuugccacugggcugagaaacgugcccaguauccagagcaggggauuguuuggcgcgauugccggcuucauagaagggggauggacagguauggucgacggcugguacggguaucaucaccagaaugaacaaggauccggcuacgcagcugaucucaaaucuacccagaacgccaucgacgagauuacgaauaaggugaacagcguuaucgagaaaaugaauacccaguuuacagcuguggguaaggaguucaaccaccuggaaaagcggauagaaaauuuaaacaaaaaggucgaugacggguuccuggauauuuggacuuacaaugccgagcuccuugugcuguuggaaaacgagcgcacccuagacuaucaugauucaaauguuaaaaaccuguacgagaagguacgaagucagcucaaaaacaaugcaaaggaaaucggcaacggauguuuugaguucuaucacaagugcgacaauacauguauggaauccgugaaaaacggcacuuacgauuauccuaaguacagcgaggaagccaaacugaauagagaggagaucgacggggucaaacuugaaucuaccaggauuuaucaaauccuggcuauuuacucaacaguggcgaguagcuugguccucgugguuucccugggagcaauaucuuuuuggaugugcucgaacgguagcuuacagugccggaucuguauuuga

SEQ ID NO: 131014 - RNA, 1701 nt, Artificial Sequence; identical to SEQ ID NO: 124685
  derived and/or modified sequence opt3 from hemagglutinin__InfluenzaA__AFK14839

SEQ ID NO: 131015 - RNA, 1701 nt, Artificial Sequence
  derived and/or modified sequence opt3 from hemagglutinin__InfluenzaA__AFK14847
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcagugccuccucuuucgaacgguaugagauuuuuccgaagacaagcuccuggcccaaucacgauucaaacaagggugugaccgcugcauguccucaugccggggcuaaaaguuucuacaagaaucugaucuggcucgucaaaaagggaaacagcuauccaaaauuaucuaaguccuacauaaaugacaagggcaaagaagugcugguacuuuggggcauccaccaccccucaacgagcgccgaucaacagaguuuguaccagaacgcggacgcauauguuuuuguggggacuucucgcuacuccaagaaauucaagccugagauugccauccgaccaaaaguccgugaucaggagggaagaaugaauuauuacuggacccugguggaacccggugacaagauuacauuugaggcuacuggcaaccuaguggucccuagguaugccuucgcaauggaacggaacgcugggagcggaaucauaauuucggauaccccaguucaugacugcaauacaaccugucaaacgccgaaaggcgccaucaacacuucucuccccuuucagaauauucacccuaucacaaucgguaagugcccaaaguacgugaaauccaccaagcugcgccuugcgacugggcugagaaacguacccucaauucagaguaggggauuguucggcgccauagcaggcuuuaucgaagggggauggacagguaugguggacggcugguauggguaccaucaccagaaugaacaaggaagcggcuacgcugccgaucucaaauccacccagaacgcuauugacgagaucacgaauaaggucaacucugugauagagaaaaugaauacccaguucacagccguugguaaggaauuuaaccaccuggagaagcggauugaaaauuuaaacaaaaagguggaugacggguuccuggauaucuggacuuauaaugcagagcuccuuguccuguuggaaaacgagcgcacccuagacuaccaugauagcaaugugaaaaaccuguaugagaagguacgaucacagcucaaaaacaaugccaaggaaaucggcaacggauguuucgaguuuuaccacaagugcgacaauacauguauggaaaguguuaaaaacggcacuuaugauuacccuaaguauuccgaggaagcuaaacugaauagagaggagauugacggggugaaacuugaaagcaccaggaucuaccaaauucuggcgauauacucuacagucgcaucaaguuuggugcucgucgugagccugggagccaucuccuucuggaugugcucuaacgguucguuacagugccggauuuguaucuga

SEQ ID NO: 131016 - RNA, 1701 nt, Artificial Sequence; identical to SEQ ID NO: 129194
  derived and/or modified sequence opt3 from hemagglutinin__InfluenzaA__AFK14868

SEQ ID NO: 131017 - RNA, 1701 nt, Artificial Sequence; identical to SEQ ID NO: 125849
  derived and/or modified sequence opt3 from hemagglutinin__InfluenzaA__AFK14884

SEQ ID NO: 131018 - RNA, 1701 nt, Artificial Sequence; identical to SEQ ID NO: 125849
  derived and/or modified sequence opt3 from hemagglutinin__InfluenzaA__AFK14892

SEQ ID NO: 131019 - RNA, 1701 nt, Artificial Sequence; identical to SEQ ID NO: 125849
  derived and/or modified sequence opt3 from hemagglutinin__InfluenzaA__AFK14901

SEQ ID NO: 131020 - RNA, 1701 nt, Artificial Sequence; identical to SEQ ID NO: 125849
  derived and/or modified sequence opt3 from hemagglutinin__InfluenzaA__AFK14910

SEQ ID NO: 131021 - RNA, 1701 nt, Artificial Sequence; identical to SEQ ID NO: 124685
  derived and/or modified sequence opt3 from hemagglutinin__InfluenzaA__AFK14919

SEQ ID NO: 131022 - RNA, 1701 nt, Artificial Sequence; identical to SEQ ID NO: 124685
  derived and/or modified sequence opt3 from hemagglutinin__InfluenzaA__AFK14929

SEQ ID NO: 131023 - RNA, 1701 nt, Artificial Sequence; identical to SEQ ID NO: 130202
  derived and/or modified sequence opt3 from hemagglutinin__InfluenzaA__AFK25599

SEQ ID NO: 131024 - RNA, 1701 nt, Artificial Sequence
  derived and/or modified sequence opt3 from hemagglutinin__InfluenzaA__AFK25601
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugaguguguuacauugucuaccgcaucaaguuggagcuacauuguggaaacuuccucuucggacaacggaacaugcuauccaggcgauuuuaucgacuacgaggaacucagggagcagcugucaagcgucaguuccuucgagcgguuugaaauuuucccgaagaccucuagcuggcccaaucacgauuccaacaagggugugacggccgcuuguccucaugcaggggccaaaggauuuuauaagaaucugaucuggcucguuaaaaagggcaacucauacccaaaauuaaguaagagcuauauaaaugacaagggcaaagagguacuggugcuuugggggauccaccaccccucuacuaccgcugaucaacaguccuuguaccagaacgccgacacauacgucuucgugggaacuucacgcuauagcaagaaauuuaagccugaaauugcgauccgaccaaaagugcgugaucaggaggguagaaugaauuacuauuggacccuggucgagcccggcgacaagauuacauucgaagcaaccgggaaccuaguugugccuagguacgccuuugcuauggagcgggaugccggaaguggcaucauaauuucugacacgccaguacaugacugcaacacuacaugucaaaccccgaaaggugcaaucaauacuucccuccccuuccagaacauucacccuaucacaaucgggaagugcccaaaguaugugaaaagcaccaagcugcgccuugcuacgggacugagaaauguccccucgauucagucuaggggcuuguuuggcgccauagcgggguucaucgaaggagguuggaccggcaugguggaugggugguacggauaucaucaccagaacgagcaaggcuccgguuacgccgcagaccucaaaucaacacagaaugcuauugauaagaucacuaacaaaguuaauagugugauagaaaagaugaacacccaguuuacagccgucgggaaggaguucaaucaccuggagaaacggauugaaaacuuaaauaagaaaguggacgauggcuuccuggacaucuggacuuacaacgcugagcuccuuguacuguuggaaaaugagcgcacccuagauuaucaugacagcaacguuaagaaucuguacgaaaaagugcgaaaccagcucaagaacaaugccaaggagaucggaaacggcuguuuugaguucuaucacaaaugcgauaauacauguauggaauccgucaagaacgggaccuacgacuauccuaaauacucugaggaagcaaagcugaauagagaggaaauugauggagugaaacuugagagcacuaggaucuaucaaauucuggccauauacucaacggcugcgaguuccuugguccucgugguuagccugggugcaaucucuuuuuggaugugcucaaacggcaguuuacagugccggauuuguaucuga

SEQ ID NO: 131025 - RNA, 1701 nt, Artificial Sequence; identical to SEQ ID NO: 130202
  derived and/or modified sequence opt3 from hemagglutinin__InfluenzaA__AFK25603

SEQ ID NO: 131026 - RNA, 1701 nt, Artificial Sequence
  derived and/or modified sequence opt3 from hemagglutinin__InfluenzaA__AFK25605
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaacauugucuaccgcaucaaguuggagcuacauuguugagacuuccucuucggacaacggaacaugcuauccaggcgauuuuaucgacuacgaagaacucagggagcagcugucaagcgugaguuccuucgaacgguuugagauuuucccgaagaccucuagcuggcccaaucacgauuccaacaagggugucacggccgcuuguccucaugcaggggccaaaggauuuuauaagaaucugaucuggcucgugaaaaagggcaacucauacccaaaauuaaguaagagcuauauaaaugacaagggcaaagaaguacugguucuuugggggauccaccaccccucuacuaccgcugaucaacaguccuuguaccagaacgccgacacauacguguucgucggaacuucacgcuauagcaagaaauuuaagccugagauugcgauccgaccaaaagugcgugaucaggaggguagaaugaauuacuauuggacccugguggaacccggcgacaagauuacauucgaggcaaccgggaaccuagucguuccuagguacgccuuugcuauggaacgggaugccggaaguggcaucauaauuucugacacgccagugcaugacugcaacacuacaugucaaaccccgaaaggugcaaucaauacuucccuccccuuccagaacauucacccuaucacaaucgggaagugcccaaaguauguacgcagcaccaaacugagacuugcuacgggacugaggaaugugcccucgauucagucucggggcuuguuuggcgccauagcgggguucaucgagggagguuggaccggcauggucgaugggugguacggauaucaucaccagaacgaacaaggcuccgguuacgccgcagaccucaagucaacacagaaugcuauugauaaaaucacuaacaaggugaauaguguuauagagaaaaugaacacccaguuuacagccguggggaaggaguucaaucaccuggaaaagcgcauugagaacuuaaauaaaaaggucgacgauggcuuccuggacaucuggacuuacaacgcugaacuccuugugcuguuggagaaugaacgaacccuagauuaucaugacagcaacguaaagaaucuguacgagaagguuagaaaccagcucaaaaacaaugccaaggagaucggaaacggcuguuuugaguucuaucacaagugcgauaauacauguauggaguccgugaaaaacgggaccuacgacuauccuaaguacucugaagaggcaaaacugaauagggaagagauugauggagucaaacuugagagcacucggaucuaucaaauucuggccauauacucaacggcugcgaguuccuuggugcucgucgugagccugggugcaaucucuuuuuggaugugcucaaacggcaguuuacagugccguauuuguaucuga

SEQ ID NO: 131027 - RNA, 1701 nt, Artificial Sequence; identical to SEQ ID NO: 130430
  derived and/or modified sequence opt3 from hemagglutinin__InfluenzaA__AFK74526

SEQ ID NO: 131028 - RNA, 1701 nt, Artificial Sequence; identical to SEQ ID NO: 124685
  derived and/or modified sequence opt3 from hemagglutinin__InfluenzaA__AFK74534

SEQ ID NO: 131029 - RNA, 1701 nt, Artificial Sequence; identical to SEQ ID NO: 124685
  derived and/or modified sequence opt3 from hemagglutinin__InfluenzaA__AFK74544

SEQ ID NO: 131030 - RNA, 1701 nt, Artificial Sequence; identical to SEQ ID NO: 124685
  derived and/or modified sequence opt3 from hemagglutinin__InfluenzaA__AFK74554

SEQ ID NO: 131031 - RNA, 1701 nt, Artificial Sequence; identical to SEQ ID NO: 124927
  derived and/or modified sequence opt3 from hemagglutinin__InfluenzaA__AFK74564

SEQ ID NO: 131032 - RNA, 1701 nt, Artificial Sequence; identical to SEQ ID NO: 127240
  derived and/or modified sequence opt3 from hemagglutinin__InfluenzaA__AFK74575

SEQ ID NO: 131033 - RNA, 1701 nt, Artificial Sequence; identical to SEQ ID NO: 124672
  derived and/or modified sequence opt3 from hemagglutinin__InfluenzaA__AFK74585

SEQ ID NO: 131034 - RNA, 1701 nt, Artificial Sequence
  derived and/or modified sequence opt3 from hemagglutinin__InfluenzaA__AFK74595
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgaucugaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggaccagucgcuauucuaagaaauuuaagccugagauugcaauccgaccaaaagugcgugaucaggagggaagaaugaauuacuauuggacucuaguggaacccggugacaagauuacauucgaggccacuggcaaccucgucguuccuagguacgcuuuugccauggaacggaacgcaggguccggaaucauaauuagcgauaccccagugcaugacugcaauacaaccugucaaacgccgaaaggcgcuaucaacacuucgcugcccuuccagaauauucacccuaucacaaucgguaagugcccaaaguauguaaaaucuaccaaacuucgccuggccacuggguugagaaacgugcccuccauucagucaaggggacucuuuggcgcgauagccggcuucaucgaagggggauggacagguauggucgacggcugguacggguaucaucaccagaaugaacaaggaaguggcuacgcagcugaucugaaaagcacccagaacgccauugacgagaucacgaauaaggugaacuccguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauucuaauguaaagaaccucuacgagaagguucgaagccagcugaaaaacaaugcaaaggaaaucggcaacggauguuuugaguucuaucacaagugcgacaauacauguauggaaucagugaaaaacggcacuuacgauuauccuaaguacagugaggaagccaaacuuaauagagaggagauugacggggucaagcuggaauccaccaggaucuaucaaauuuuggcuauauacagcacaguggcgucuucacucguccuggugguuaguuuaggagcaaucagcuuuuggaugugcuccaacgguucucugcagugccggauuuguaucuga

SEQ ID NO: 131035 - RNA, 1701 nt, Artificial Sequence; identical to SEQ ID NO: 124685
  derived and/or modified sequence opt3 from hemagglutinin__InfluenzaA__AFK74605

SEQ ID NO: 131036 - RNA, 1701 nt, Artificial Sequence; identical to SEQ ID NO: 124927
  derived and/or modified sequence opt3 from hemagglutinin__InfluenzaA__AFK74615

SEQ ID NO: 131037 - RNA, 1701 nt, Artificial Sequence; identical to SEQ ID NO: 124927
  derived and/or modified sequence opt3 from hemagglutinin__InfluenzaA__AFK74625

SEQ ID NO: 131038 - RNA, 1701 nt, Artificial Sequence; identical to SEQ ID NO: 125787
  derived and/or modified sequence opt3 from hemagglutinin__InfluenzaA__AFK74635

SEQ ID NO: 131039 - RNA, 1701 nt, Artificial Sequence; identical to SEQ ID NO: 125787
  derived and/or modified sequence opt3 from hemagglutinin__InfluenzaA__AFK74645

SEQ ID NO: 131040 - RNA, 1701 nt, Artificial Sequence; identical to SEQ ID NO: 124685
  derived and/or modified sequence opt3 from hemagglutinin__InfluenzaA__AFK74655

SEQ ID NO: 131041 - RNA, 1701 nt, Artificial Sequence; identical to SEQ ID NO: 124685
  derived and/or modified sequence opt3 from hemagglutinin__InfluenzaA__AFK74665

SEQ ID NO: 131042 - RNA, 1701 nt, Artificial Sequence; identical to SEQ ID NO: 124685
  derived and/or modified sequence opt3 from hemagglutinin__InfluenzaA__AFK74675

SEQ ID NO: 131043 - RNA, 1701 nt, Artificial Sequence; identical to SEQ ID NO: 124685
  derived and/or modified sequence opt3 from hemagglutinin__InfluenzaA__AFK74685

SEQ ID NO: 131044 - RNA, 1701 nt, Artificial Sequence; identical to SEQ ID NO: 127240
  derived and/or modified sequence opt3 from hemagglutinin__InfluenzaA__AFK74695

SEQ ID NO: 131045 - RNA, 1701 nt, Artificial Sequence; identical to SEQ ID NO: 124685
  derived and/or modified sequence opt3 from hemagglutinin__InfluenzaA__AFK74705

SEQ ID NO: 131046 - RNA, 1701 nt, Artificial Sequence; identical to SEQ ID NO: 124685
  derived and/or modified sequence opt3 from hemagglutinin__InfluenzaA__AFK74715

SEQ ID NO: 131047 - RNA, 1701 nt, Artificial Sequence; identical to SEQ ID NO: 124685
  derived and/or modified sequence opt3 from hemagglutinin__InfluenzaA__AFK74725

SEQ ID NO: 131048 - RNA, 1701 nt, Artificial Sequence; identical to SEQ ID NO: 124685
  derived and/or modified sequence opt3 from hemagglutinin__InfluenzaA__AFK74735

SEQ ID NO: 131049 - RNA, 1701 nt, Artificial Sequence; identical to SEQ ID NO: 124685
  derived and/or modified sequence opt3 from hemagglutinin__InfluenzaA__AFK74745

SEQ ID NO: 131050 - RNA, 1701 nt, Artificial Sequence; identical to SEQ ID NO: 124685
  derived and/or modified sequence opt3 from hemagglutinin__InfluenzaA__AFK74755

SEQ ID NO: 131051 - RNA, 1701 nt, Artificial Sequence; identical to SEQ ID NO: 127240
  derived and/or modified sequence opt3 from hemagglutinin__InfluenzaA__AFK74765

SEQ ID NO: 131052 - RNA, 1701 nt, Artificial Sequence; identical to SEQ ID NO: 124685
  derived and/or modified sequence opt3 from hemagglutinin__InfluenzaA__AFK74775

SEQ ID NO: 131053 - RNA, 1701 nt, Artificial Sequence; identical to SEQ ID NO: 124685
  derived and/or modified sequence opt3 from hemagglutinin__InfluenzaA__AFK74785

SEQ ID NO: 131054 - RNA, 1701 nt, Artificial Sequence; identical to SEQ ID NO: 124685
  derived and/or modified sequence opt3 from hemagglutinin__InfluenzaA__AFK74795

SEQ ID NO: 131055 - RNA, 1701 nt, Artificial Sequence; identical to SEQ ID NO: 124685
  derived and/or modified sequence opt3 from hemagglutinin__InfluenzaA__AFK74805

SEQ ID NO: 131056 - RNA, 1701 nt, Artificial Sequence; identical to SEQ ID NO: 124685
  derived and/or modified sequence opt3 from hemagglutinin__InfluenzaA__AFK74815

SEQ ID NO: 131057 - RNA, 1701 nt, Artificial Sequence; identical to SEQ ID NO: 124685
  derived and/or modified sequence opt3 from hemagglutinin__InfluenzaA__AFK74825

SEQ ID NO: 131058 - RNA, 1701 nt, Artificial Sequence; identical to SEQ ID NO: 124685
  derived and/or modified sequence opt3 from hemagglutinin__InfluenzaA__AFK74835

SEQ ID NO: 131059 - RNA, 1701 nt, Artificial Sequence; identical to SEQ ID NO: 124685
  derived and/or modified sequence opt3 from hemagglutinin__InfluenzaA__AFK74845

SEQ ID NO: 131060 - RNA, 1701 nt, Artificial Sequence; identical to SEQ ID NO: 124685
  derived and/or modified sequence opt3 from hemagglutinin__InfluenzaA__AFK74895

SEQ ID NO: 131061 - RNA, 1701 nt, Artificial Sequence; identical to SEQ ID NO: 124685
  derived and/or modified sequence opt3 from hemagglutinin__InfluenzaA__AFK74905

SEQ ID NO: 131062 - RNA, 1701 nt, Artificial Sequence; identical to SEQ ID NO: 124685
  derived and/or modified sequence opt3 from hemagglutinin__InfluenzaA__AFK74915

SEQ ID NO: 131063 - RNA, 1701 nt, Artificial Sequence
  derived and/or modified sequence opt3 from hemagglutinin__InfluenzaA__AFK74925
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugguuccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguaaagaagggaaacagcuacccaaaauuaucuaaguccuauauaaaugacaagggcaaagaaguucuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuuaccauggaacggaacgcugggagcggaaucauaauuucggauacaccaguacaugacugcaauaccacgugucaaacuccgaaaggcgccaucaacacaucucuccccuuccagaauauucacccuaucaccaucgguaagugcccaaaguaugugaaauccacuaagcugcgccuugcaacagggcugagaaacguccccucaauucagaguaggggauuguuuggcgcuauagccggcuucaucgaagggggauggaccgguaugguggacggcugguacggguaucaucaccagaaugaacaaggaagcggcuacgcggccgaucucaaauccacgcagaacgcaauugacgguaucaccaauaagguuaacucugugauagagaaaaugaauacacaguuuacugcugucgggaaggaguucaaccaccuggaaaagcggauugagaauuuaaacaaaaagaucgaugacggcuuccuggauaucuggaccuacaaugccgaacuccuugugcuguuggagaacgaacgcacacuagacuaucaugauagcaauguuaaaaaccuguacgagaagguacgaucacagcucaaaaacaaugcuaaggagauuggaaacggcuguuuugaguucuaucacaagugcgacaauacuuguauggaaagugugaaaaacgggaccuacgauuauccuaaguacuccgaagaggccaaacugaauagagaagagaucgacggagucaaacuugagagcacaaggauuuaucaaauacuggcaaucuacucuaccguggccucaaguuugguccucgugguuagccugggugcuauuuccuuuuggaugugcucuaacggcucguuacagugccggaucuguaucuga

SEQ ID NO: 131064 - RNA, 1701 nt, Artificial Sequence; identical to SEQ ID NO: 125787
  derived and/or modified sequence opt3 from hemagglutinin__InfluenzaA__AFK74935

SEQ ID NO: 131065 - RNA, 1701 nt, Artificial Sequence; identical to SEQ ID NO: 124685
  derived and/or modified sequence opt3 from hemagglutinin__InfluenzaA__AFK74945

SEQ ID NO: 131066 - RNA, 1701 nt, Artificial Sequence; identical to SEQ ID NO: 124685
  derived and/or modified sequence opt3 from hemagglutinin__InfluenzaA__AFK74955

SEQ ID NO: 131067 - RNA, 1701 nt, Artificial Sequence; identical to SEQ ID NO: 124685
  derived and/or modified sequence opt3 from hemagglutinin__InfluenzaA__AFK74965

SEQ ID NO: 131068 - RNA, 1701 nt, Artificial Sequence; identical to SEQ ID NO: 124776
  derived and/or modified sequence opt3 from hemagglutinin__InfluenzaA__AFK74975

SEQ ID NO: 131069 - RNA, 1701 nt, Artificial Sequence; identical to SEQ ID NO: 124685
  derived and/or modified sequence opt3 from hemagglutinin__InfluenzaA__AFK74985

SEQ ID NO: 131070 - RNA, 1701 nt, Artificial Sequence; identical to SEQ ID NO: 127240
  derived and/or modified sequence opt3 from hemagglutinin__InfluenzaA__AFK74995

SEQ ID NO: 131071 - RNA, 1701 nt, Artificial Sequence; identical to SEQ ID NO: 124685
  derived and/or modified sequence opt3 from hemagglutinin__InfluenzaA__AFK75005

SEQ ID NO: 131072 - RNA, 1701 nt, Artificial Sequence
  derived and/or modified sequence opt3 from hemagglutinin__InfluenzaA__AFK75015
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaaacuugaaagcaccaggaucuaucaaauucuggcuauauacucuacaguggcgucaaguuugguccucgugguuagccugggagcaaucuccuuuuggaugugcucuaacgguucguuacagugccggauuuguguguga

SEQ ID NO: 131073 - RNA, 1701 nt, Artificial Sequence; identical to SEQ ID NO: 124927
  derived and/or modified sequence opt3 from hemagglutinin__InfluenzaA__AFK75025

SEQ ID NO: 131074 - RNA, 1701 nt, Artificial Sequence; identical to SEQ ID NO: 124927
  derived and/or modified sequence opt3 from hemagglutinin__InfluenzaA__AFK75035

SEQ ID NO: 131075 - RNA, 1701 nt, Artificial Sequence; identical to SEQ ID NO: 124927
  derived and/or modified sequence opt3 from hemagglutinin__InfluenzaA__AFK75045

SEQ ID NO: 131076 - RNA, 1701 nt, Artificial Sequence; identical to SEQ ID NO: 124927
  derived and/or modified sequence opt3 from hemagglutinin__InfluenzaA__AFK75055

SEQ ID NO: 131077 - RNA, 1701 nt, Artificial Sequence; identical to SEQ ID NO: 124685
  derived and/or modified sequence opt3 from hemagglutinin__InfluenzaA__AFK75065

SEQ ID NO: 131078 - RNA, 1701 nt, Artificial Sequence; identical to SEQ ID NO: 124685
  derived and/or modified sequence opt3 from hemagglutinin__InfluenzaA__AFK75075

SEQ ID NO: 131079 - RNA, 1701 nt, Artificial Sequence; identical to SEQ ID NO: 125849
  derived and/or modified sequence opt3 from hemagglutinin__InfluenzaA__AFK75085

SEQ ID NO: 131080 - RNA, 1701 nt, Artificial Sequence; identical to SEQ ID NO: 125849
  derived and/or modified sequence opt3 from hemagglutinin__InfluenzaA__AFK75095

SEQ ID NO: 131081 - RNA, 1701 nt, Artificial Sequence; identical to SEQ ID NO: 124685
  derived and/or modified sequence opt3 from hemagglutinin__InfluenzaA__AFK75105

SEQ ID NO: 131082 - RNA, 1701 nt, Artificial Sequence; identical to SEQ ID NO: 124927
  derived and/or modified sequence opt3 from hemagglutinin__InfluenzaA__AFK77857

SEQ ID NO: 131083 - RNA, 1701 nt, Artificial Sequence; identical to SEQ ID NO: 124927
  derived and/or modified sequence opt3 from hemagglutinin__InfluenzaA__AFK77867

SEQ ID NO: 131084 - RNA, 1701 nt, Artificial Sequence; identical to SEQ ID NO: 130213
  derived and/or modified sequence opt3 from hemagglutinin__InfluenzaA__AFK77877

SEQ ID NO: 131085 - RNA, 1701 nt, Artificial Sequence; identical to SEQ ID NO: 124685
  derived and/or modified sequence opt3 from hemagglutinin__InfluenzaA__AFK77887

SEQ ID NO: 131086 - RNA, 1701 nt, Artificial Sequence
  derived and/or modified sequence opt3 from hemagglutinin__InfluenzaA__AFK77897
augaaggccauccuggugguccuccuuuacaccuucgcuacagcaaacgccgacacucugugcauuggcuaucacgcgaauaacagcacggauaccguugacacaguguuggagaaaaauguaacugugacccauuccauaaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaggagcucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccucaacgagcgcugaccaacagaguuuguaccagaaugccgaugcguacguuuucguggggacuucuaaguauuccaaaaaguuuaaaccugagaucgcaguccgcccaaaggugcgagaccaggagggacguaugaacuacuauuggacccugguggaacccggugauaaaauuacauucgaggccacuggcaaccuacucgucccuagauacgcuuuugccauggaaaggaaugcagggagcggaaucauaauuucggacaccccaguucaugauugcaacacaaccugucaaacgccgaagggcgcuaucaauacuucucugcccuuccagaacauucacccuaucacaaucgguaagugcccaaaauaugugaaguccaccaaacuucggcuggccacuggguugcgcaauguacccucaauucagaguagaggacucuuuggcgcgauagccggcuucaucgaagggggauggacagguaugguggacggcugguacggguaucaucaccagaacgaacaaggaagcggcuacgcagcugaccugaaguccacccagaaugccauugauaaaaucacgaacaaggucaauucugugauagagaagaugaacacccaguuuacagcuguugguaaagaguucaaucacuuagaaaagaggauugagaaccugaauaaaaagguggacgauggguuccucgacaucuggacuuacaacgccgaacuucuggucuugcuagagaaugaacggacccuggauuaucaugacagcaacgugaaaaaccucuacgagaagguacgcucacagcugaagaauaacgcaaaagagaucggcaauggauguuuugaguucuaucacaagugcgauaacacauguauggaaaguguuaaaaauggcacuuacgacuauccuaaguacuccgaagaggccaaacuuaaccgagaagagauugauggggugaagcuggagagcaccagaaucuaucaaauuuuggcuauauacucuacagucgcgucaagucucgugcuggucgugagcuuaggagcaaucuccuuuuggaugugcucuaaugguucgcugcagugcaggauuuguaucuga

SEQ ID NO: 131087 - RNA, 1701 nt, Artificial Sequence; identical to SEQ ID NO: 129066
  derived and/or modified sequence opt3 from hemagglutinin__InfluenzaA__AFK78028

SEQ ID NO: 131088 - RNA, 1701 nt, Artificial Sequence; identical to SEQ ID NO: 124927
  derived and/or modified sequence opt3 from hemagglutinin__InfluenzaA__AFK78187

SEQ ID NO: 131089 - RNA, 1701 nt, Artificial Sequence; identical to SEQ ID NO: 128871
  derived and/or modified sequence opt3 from hemagglutinin__InfluenzaA__AFM45476

SEQ ID NO: 131090 - RNA, 1701 nt, Artificial Sequence
  derived and/or modified sequence opt3 from hemagglutinin__InfluenzaA__AFM45487
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucugacagacuccgaaaugaauaaguuguucgagaaaacuaagaaacagcuacgggaaaacgcugaggauaugggcaauggaugcuuuaagaucuaccacaagugugacaacgccugcauuggcagcauccgaaaugggaccuauaaccaugauguauaccgcgacgaggcucugaauaacagauuccagauuaaaggaguggaacucaagucugguuacaaagacuggauccuguggauaucauuugccaucaguugcuuccuucugugugucgcauugcucggcuuuauuaugugggccugccaaaaggggaauaucagguguaacauuugcaucuga

SEQ ID NO: 131091 - RNA, 1701 nt, Artificial Sequence; identical to SEQ ID NO: 128871
  derived and/or modified sequence opt3 from hemagglutinin__InfluenzaA__AFM45489

SEQ ID NO: 131092 - RNA, 1701 nt, Artificial Sequence; identical to SEQ ID NO: 131090
  derived and/or modified sequence opt3 from hemagglutinin__InfluenzaA__AFM45494

SEQ ID NO: 131093 - RNA, 1701 nt, Artificial Sequence
  derived and/or modified sequence opt3 from hemagglutinin__InfluenzaA__AFM68954
augaaggccagacugcucgugcuucugugcgcuuuggcagccaccgacgcggauacaaucuguauuggcuaccacgcuaacaauagcacugacacggucgauaccuuacuggagaaaaacguuacagugacucauuccguaaaucuacucgaagacucucacaacgggaagcugugcaaacuuaagggaauagccccgcugcaguuggguaaauguaauaucgcaggcuggcuccuggggaacccugagugcgauucacugcucccagccaggaguuggagcuauauuguggaaacccccaauuccgagaacggagcuuguuaccccggcgacuucaucgauuaugaagaguuaaaggagcaacugucuucggucucaagccuugaacgguuugagauuuucccuaaggaaaguuccuggccaaaucauaacacauugaaaggugugaccgcaucuugcagccacgggggaaaguccucauuuuaccgcaaucugcuauggcucacuaaaacagaggacaguuaucccaagcugagcaacucuuacguuaauaacaaaggcaaggaggugcuuguccuguggggcgugcaucacccuuccucaagcgaugaacagcagaguuuguaucacaauguaaacgccuacguuucuguggucuccagcaacuacaaugggcgauucaccccagagaucgcugcccgucccaaggugagaaaccagccuggaaggaugaauuauuacuggacgcuccuggaaccaggugacacuauaaucuuugaggcgaccggcaacuuaauugcaccgugguaugccuucgcucugucgcggggguuuggaucuggcaucauuacauccaaugccucaaugcaugaauguaacacuaaaugccaaacaccccagggugcaaucaauaguagccucccuuuccagaacauacacccagugaccauuggggagugucccaaguacguccgcuccaccaaacuuagaaugguuacgggacugaggaauaucccuucuauucaguuucggggcuuguucggcgcuaucgccggguuuaucgagggagguuggacuggcaugauugaugggugguauggauaccaucaccaaaacgaacagggcagcgguuaugcggccgaccagaagucaacacagaaugcaauaaacgggaucaccaauaaagugaacaguguaauugagaagaugaauacucaauucacagcuguguccaaagaauuuaacaaccuagagaagcgcauggaaaaucugaacaagaaagucgaugacggcuuccucgacaucuggaccuacaaugccgagcugcuugugcuguuggagaacgaacgaacgcucgauuuccacgaccugaauguuaagaacuuauacgagaaagucaagagccagcugaaaaauaacgcuaaggaaauaggaaauggcugcuuugaguucuaucauaagugugauaacaaaugcauggaaucugugagaaaugggaccuacgacuauccaaaguacucagaggagaguaaacuaaacagggaaaagauugauggagugaaacucgagagcauggguguauaucagauccuggccaucuacuccacaguugcaucuucgcuuguguugcuggucagccucggcgccauuuccuuuuggaugugcucaaaugggagucugcaaugucggaucugcauuuga

SEQ ID NO: 131094 - RNA, 1701 nt, Artificial Sequence
  derived and/or modified sequence opt3 from hemagglutinin__InfluenzaA__AFM68965
augaagaccaucauugcccugagcuacauauucugccaggugcucgcucaaaaccuucccggcaaugacaacuccacagcaacucuguguuuggggcaccaugccgucccuaauggaacguuaguuaaaaccaucacaaacgaucagauugaggugacuaaugcgaccgaacugguacagucuucaaguacagguagaaucugcgacagcccacacaggauucuagauggcaagaacuguacccucaucgacgcucugcuuggggauccgcauugcgacggauuucagaaugagaaaugggaucuguucguggaacgguccaaggccuuuucuaacuguuaucccuacgacgucccugauuaugcaucguugcgcucacucguggccagcaguggcacucuggaguucauaaaugaagguuuuaacuggacagggguuacccaaaauggaggcuccuacgcuugcaaacgaggcccagacaacucuuucuuuagccgucugaauuggcucuauaaguccgagucaacguaccccguguuaaacgucacuaugccuaauaacgauaacuucgacaagcuguauaucuggggagugcaccauccaaguaccgauaaagagcagacaaaucuuuacguacaggcaagcgggagaguuacugugucuaccaagaggucccagcaaacaauuauccccaacgucgguucacggccuugggugcgcggcuugagcagugggauuucuaucuacuggaccauagugaaaccaggagacauucugcuaaucaauuccaacggcaaucucauugccccgagagguuauuuuaagaucaggacggggaaaagcucgaucaugcggucugacgcucccauuggaacuuguuccucagaaugcauaacaccuaacggcaguaucccaaaugauaagcccuuccagaacgucaauaagauuaccuacggcgccuguccuaaauauguuaagcagaacacucugaaacuugcgacagggaugcgcaaugugccagagaagcagacccgaggaaucuuuggugcaaaagccggcuucauagaaaacgggugggagggaaugauugacggcugguacgguuuuagacaccaaaauagcgaggggacgggccaggcugccgaucugaaguccacccaggcagcuaucgaccaaaucaacggaaaauugaauaggguaauugaaaagacaaacgagaaguuccaccagaucgaaaaagaguucucugaaguggagggccggauucaggaucucgagaaguaugucgaagacacuaaaauagaucuguggagcuacaacgccgaguuacugguggcgcucgaaaaucagcauaccaucgaccuuacagauucagagaugaacaagcuguuugagaaaacucgucgccaauugagagaaaaugccgaggacauggggaacggaugcuucaagauuuaucacaagugugauaaugcaugcaucgguaguaucaggaacggcaccuacgaccaugacguuuaccgggaugaagcucuaaauaaccgauuucagauuaaagggguggagcugaaguccggauauaaagacuggauacucuggaucagcuucgccauuucuugcuuucugcuuugugucgugcuguugggcuucaucaugugggcuugccagaaggguaauauucgcuguaacaucugcauauga

SEQ ID NO: 131095 - RNA, 1701 nt, Artificial Sequence
  derived and/or modified sequence opt3 from hemagglutinin__InfluenzaA__AFM68987
augaagaccaucauugcccugagcuacauauucugccucguguuugcucagaaccuucccggcaaugacaacuccacagcaacucuguguuuggggcaccaugccgucccuaauggaacguuaguuaaaaccaucacaaacgaucaaauugaggugacuaaugcgaccgaacugguacagucuucaaguacagguagaaucugcgacagcccacacaggauucuagauggcaagaacuguacccucaucgacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuauaaaugaagguuucaacuggacagggguuacccaguccggaggcucuuacgcuugcaaacgaggcagcgacaaguccuuuuucucacgucugaauuggcucuaugagagugagagcaaguacccaguguuaaacgucacgaugcccaauaacgggaauuuugauaaacuguauaucuggggagugcaccauccuucuacugacaaggaacaaaccaaccuuuacguaagagcauccgguaggguuacagugucaacuaaacggagccagcagaccgucauuccaaacaucggcagucgccccugggugagaggguugucuuccaggauuagcaucuacuggacaauagugaagccuggagauauucugcuaaucaauucgaacggcaaucucauugccccacgggguuauuucaaaauccgcaccgggaagucuuccaucaugcgaucagacgcuccgauuggaacguguaguagcgagugcauaacucccaacggcuccaucccuaaugacaagccauuucagaacgucaauaaaauuacauacggcgccugucccaaguauguuaaacaaaacacccugaagcuggcgacugggaugagaaaugugccugaaaaacagacaaggggaaucuucggugcaauagccggcuuuauugagaacgggugggagggaaugguagauggcugguacgguuuccggcaccaaaauucugaagggaccggccaggcugccgaccuuaagagcacgcaggcagcuaucgaucagaucaacggaaaauugaaucgugugauugagaagaccaacgaaaaguuccaccagaucgagaaagaauuuucagaggucgagggccgcauucaagaccucgaaaaguauguggaggauacaaaaauagaccuguggaguuacaaugccgaauuacugguugcgcucgagaaccagcauacuaucgaucuuaccgacuccgaaaugaacaagcuguucgagaaaacaagaaggcaguugcgggagaaugccgaagauauggggaacggaugcuuuaagauuuaucacaagugugacaaugcaugcaucgguagcauccgaaacggcacuuacgaucaugacguguaccgcgacgaggcucuaaauaacagauuccagauuaaaggggucgaacugaagucuggauauaaagauuggauacucuggaucucauuugccauuaguugcuuccugcuuugugugguacuguugggcuuuaucaugugggcuugccaaaaggguaauauuagguguaacaucugcauauga

SEQ ID NO: 131096 - RNA, 1701 nt, Artificial Sequence
  derived and/or modified sequence opt3 from hemagglutinin__InfluenzaA__AFM71720
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcuccacgagagugaguacaaguauccagcauuaaacgucgccaugcccaauaacggcaaauucgauaagcuguacaucuggggagugcaucacccuauuacggacagagaacaaacuaaucuuuacguaagggcuagcgggcggguuaccgugucuacaaaacgcucccagcagacugucaucccaaacauugguucaagacccugggugaggggcuugagcagucggaucucuauauauuggaccauugugaagccuggggauauccuguuuauuaacuccacaggaaaucuaaucgccccacgcggcuacuucaaaauccgaaccgguaagagcucgauuaugagaucugacgcgccgauagggacguguuccucagagugcaucacucccaacggaaguauuccuaaugacaagccauuucagaacgucaauaaaaucacauauggcgcaugucccagguacguuaagcaaaacacccucaaacuggccacuggcaugcggaaugugccugaaaagcagacacgugggauauucggagcuauugccgguuuuaucgagaacggcugggaggggaugguagauggaugguauggcuuccgccaccagaauagcgaagguaccgggcaggcagcugaccuuaaauccacgcaagccgcgaucgaucagauuaacggcaagcugaauagauugaucgagaaaaccaacgaaaaguuccaucagauugagaaggaauuuucugagguggagggaaggauacaagaccucgaaaaauacgucgaggauacaaagaucgaccuguggagcuauaaugccgaauuacugguggcacucgagaaccagcacacuauugaucuuaccgacucagaaaugaauaaacuguucgagaagacacggaaacaguugcgagagaacgcugaagauaugggcaacgggugcuuuaagaucuaccauaagugugacaaugccugcaucggaaguauucgcaacgguacuuacgaucacgacguuuauagagacgaggcucuaaauaacagguuccagauaaaaggcguggaacugaaguccggguacaaagauuggauccucuggauuagcuuugccaucucuugcuuccugcuuugugucgugcuguugggauuuauuaugugggcaugccaaaagggcaauauccgguguaacauaugcaucuga

SEQ ID NO: 131097 - RNA, 1701 nt, Artificial Sequence
  derived and/or modified sequence opt3 from hemagglutinin__InfluenzaA__AFM71731
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuauaaacgaagacuucaauuggacagguguugcucaguccggggagucuuaugcaugcaagcgaggaagcgugaaguccuuuuucucacgucucaacugguuacacaaaagugaguacaaguauccagcccugaaugucaccaugcccaacaauggcaaauuugauaaacuuuacaucuggggcgugcaucacccuagcacggacagagaacaaacuaacuuguacguaagggcuucugggcggguuaccguguccacaaagcgcucacagcagacugucauuccaaauaucggaagcagacccugggugaggggucugaguucucggauuuccaucuauuggaccauagugaagccuggcgauauucuacucaucaacagcacagggaaccugauugccccacgcggauacuucaagauccgaaccggcaaaucgucuaucaugagauccgacgcgccgauugguacguguucaagugagugcauaacucccaaugggagcaucccuaacgacaagccauuucagaaugucaacaggauuacauauggagcauguccccgguacguuaaacaaaauacccuuaagcuggccacuggcaugcguaacgugccugaaaaacagacacgcggcaucuucggggcuauagccggauuuauugagaaugguugggagggcaugguagaugggugguauggauucagacaccagaacuccgaaggcaccggucaggcagcugacuugaagucuacgcaagccgcgaucgaucagaucaaugggaaacucaacaggcugauugagaagaccaaugaaaaguuucaucagaucgagaaagaguucagcgaaguggagggccggauucaagacuuagaaaaguacgucgaggauacaaaaauagaccuguggucauauaacgccgaacuccuuguggcacuggagaaucagcacacuaucgauuugaccgacagugaaaugaacaagcuauucgagaaaacacgaaagcagcugcgcgagaaugcugaagauaugggaaacggcugcuuuaagauuuaccauaaaugugacaacgccugcaucggguccaucagaaauggaacuuacgaucacgacguuuauagggacgaggcucucaacaaucgguuccagauuaaggguguggaacugaaaagcggcuacaaggauuggauacuuuggaucucuuuugccauuucaugcuuccuguugugugucgugcuccugggguuuaucaugugggcaugccaaaaaggaaacauucgcuguaauaucugcauauga

SEQ ID NO: 131098 - RNA, 1701 nt, Artificial Sequence
  derived and/or modified sequence opt3 from hemagglutinin__InfluenzaA__AFM71754
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccagaaugggacgucuagcgcuugcauccggcgcuccaagaacucauuuuucagucgacugaauuggcucacucauuuaaacuuuaaauauccagcacugaaugugaccaugcccaacaacgagcaguucgacaaacuuuacauuuggggaguccaccauccuggcacagauaaagaccagaucuuuccauaugcccaagcuagcggccguauuacugugucuaccaagagaucccagcagacagccauccccaauauagggucaaggccucggguacgcaacauuccaagcagaaucaguauuuacuggaccaucguuaaaccgggagauaucuugcugauuaauucuacggguaaccuaauagcgcccaggggcuacuucaagauccgguccggaaagagcucgauuaugcgcucugacgcaccuaucgggaaauguaauuccgagugcauaacuccaaacggcucaauucccaaugacaagccuuuucagaacgugaaucgaaucacauauggugccuguccaagauacgucaaacaaaacacccucaagcuggcuacugggaugaggaaugugcccgaaaaacagacacggggaaucuucggcgccauugcaggcuuuaucgagaacgggugggaaggaaugguggaugguugguauggcuuccgucaccagaauagugaggggcgcggacaagcugccgaccuuaagagcacccaggcggccauugaucagauaaacggcaaacugaauagauugaucgguaagacgaacgagaaguuccaccagauugaaaaagaguuuuccgaagucgaggggaggauccaagaccucgaaaaguacguugaggauaccaaaaucgaccuguggucuuauaacgcagaguuacugguggcucucgaaaaucagcauacaauugaucuuacugacagcgagaugaacaagcuguucgaaaagaccaagaagcaguugcgggagaaugccgaagauaugggcaacggaugcuuuaaaauauaccacaagugugacaaugcuugcaucggcucaauucgaaacgggacauaugcccaugauguauaccgcgacgaggcacuaaauaacagauuccagaucaaaggaguggagcugaagagugguuacaaagacuggauucucuggaucuccuuugccauaagcugcuuccugcuuugugucgcucuguugggcuuuaucaugugggcgugccaaaaggggaauauuagguguaacaucugcauuuga

SEQ ID NO: 131099 - RNA, 1701 nt, Artificial Sequence
  derived and/or modified sequence opt3 from hemagglutinin__InfluenzaA__AFM71768
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacgauuuucaaaacaagaaaugggaccuguucguggaaagauccaaggccuauucuaauuguuaccccuaugaugucccugacuacgcaucguugaggucacucguggccagcaguggaacucuggaguuuaacaaugaauccuucaacuggacaggcguuacccagaaugguacgucuagcgcuugcauccggcgcuccaagaacucauuuuucagucgacugaauuggcucacucauuuaaacuuuaaauauccagcacugaaugugaccaugcccaacaacgagcaguucgauaaacuuuacauuuggggaguccaccauccugggacagacaaagaucagaucuuuccauaugcccaagcuagcggccguauuacugugucuaccaagagaucccagcagacagccauccccaauauaggcucaaggccucggguacgcaacauuccaagcagaaucaguauuuacuggaccaucguuaaaccgggggacaucuugcugauuaauucuacgggaaaccuaauagcgcccagggguuacuucaagauccgguccggcaagagcucgauuaugcgcucugacgcaccuaucgggaaauguaauuccgagugcauaacuccaaacggaucaauucccaaugauaagccuuuucagaacgugaaucgaaucacauauggcgccuguccaagauacgucaaacaaaacacccucaagcuggcuacugguaugaggaaugugcccgaaaaacagacacgggggaucuucggagccauugcaggcuuuaucgagaacggcugggaagggaugguggacggaugguaugguuuccgucaccagaauagugagggccgcgggcaagcugccgaucuuaagagcacccaggcggccauugaccagauaaacggaaaacugaauagauugaucggcaagacgaacgagaaguuccaccagauugaaaaagaguuuuccgaagucgaggguaggauccaagaucucgaaaaguacguugaggacaccaaaaucgaucuguggucuuauaacgcagaguuacugguggcucucgaaaaucagcauacaauugaccuuacugauagcgagaugaacaagcuguucgaaaagaccaagaagcaguugcgggagaaugccgaagacauggggaacggcugcuuuaaaauauaccacaagugugauaaugcuugcaucggaucaauucgaaacggcacauaugcccaugacguauaccgcgacgaggcacuaaauaacagauuccagaucaaagggguggagcugaagaguggauacaaagauuggauucucuggaucuccuuugccauaagcugcuuccugcuuugugucgcucuguuggguuuuaucaugugggcgugccaaaagggcaauauuagguguaacaucugcauuuga

SEQ ID NO: 131100 - RNA, 1701 nt, Artificial Sequence
  derived and/or modified sequence opt3 from hemagglutinin__InfluenzaA__AFM71791
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccggugagaucugcgacagcccacaccagauucuagauggcaaaaauuguacucucaucgacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacacuggaguuuaacaaugaauccuucaacuggaccgguguuacgcagaaugggacuucuagcgcuugcauacggcgcuccaagaacucauuuuucagucgacugaauuggcucacccauuuaaacuuuaaauauccagcacugaaugugacaaugcccaacaacgagcaguucgacaaacuuuacaucuggggaguccaccauccuggcacugauaaggaccagauuuuuccauaugcccaagcuagcggccguaucaccgugucuacaaagagaucccagcagaccguaauucccaauaucgggucaaggccucggguucgcaacauaccaagcagaauuaguaucuacuggacgauugugaaaccgggagauaucuugcugaucaauucuacugguaaccuaauugcccccaggggcuacuucaagauacgguccggaaagagcucgaucaugcgcucugacgcgccuauugggaaauguaauuccgagugcaucacaccaaacggcucaauacccaaugacaagccuuuucagaacgucaaucgaauuaccuauggugcauguccaagauacgugaaacaaaacacucucaagcuggccacagggaugaggaaugugcccgaaaaacagacccggggaaucuucggcgcuaucgccggcuuuauugagaacgggugggaaggaauggucgaugguugguauggcuuccgucaccagaauagugaggggcgcggacaagcagcugaccuuaagagcacgcaggccgcgaucgaucagauuaacggcaaacugaauagauugauagguaagaccaacgagaaguuccaccagaucgaaaaagaguuuuccgaaguugaggggaggauucaagaccucgaaaaguacguggaggauacaaaaaucgaccuguggucuuauaacgccgaguuacugguagcacucgaaaaucagcauacuaucgagcuuaccgauagcgaaaugaacaagcuguucgagaaaacaaagaagcaguugcgggaaaaugcugaggacaugggcaacggaugcuuuaaaauuuaccacaagugugauaaugccugcauaggcucaauccgaaacgggacuuaugaccaugauguguaccgcgacgaggcucuaaauaacagauuccagauuaaaggagucgaacugaagagugguuacaaagacuggauccucuggauuuccuuugccaucagcugcuuccugcuuuguguggcacuguugggcuuuauaaugugggccugccaaaaggggaauaucagguguaacauuugcaucuga

SEQ ID NO: 131101 - RNA, 1701 nt, Artificial Sequence
  derived and/or modified sequence opt3 from hemagglutinin__InfluenzaA__AFM71824
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcaaaaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaauccuucaacuggacagguguuacccaggacgggacgucuagcgcuugcauccggcgcuccaagaauagcuuuuucagucgacugaacuggcucacucauuuaaauuuuaaauauccagcacugaacgugaccaugcccaauaacgagcaguucgauaaacuuuacauuuggggaguccaccauccuggcacagacaaagaucagaucuuuccauaugcccaagcuagcggccguauuacugugucuaccaagagaucccagcagacagccauccccaacauagggucaaggccucggguacgcaauauuccaagcagaaucaguauuuacuggaccaucguuaaaccgggagacaucuugcugauuaacucuacggguaaucuaauagcgcccaggggcuacuucaagauccgguccgggaagucaucgauuaugcgcucugacgcaccuaucggaaaauguaacuccgagugcauaacuccaaauggcucaauucccaacgauaagccuuuucagaaugugaaccgaaucacauauggugccuguccaagauacgucaaacaaaauacccucaagcuggcuacugggaugaggaacgugcccgaaaaacagacacggggaaucuucggcgccauugcaggcuuuaucgagaaugggugggaaggaaugguggacgguugguauggcuuccgucaccagaacagugaggggcgcggacaagcugccgaucuuaagagcacccaggcggccauugaccagauaaauggcaaacugaacagauugaucgguaagacgaaugagaaguuccaccagauugaaaaagaguuuuccgaagucgaggggaggauccaagaucucgaaaaguacguugaggacaccaaaaucgaucuguggucuuauaacgcagaguuacugguggcucucgaaaaccagcauacaauugaccuuacugauagcgagaugaauaagcuguucgaaaagaccaagaagcaguugcgggagaacgccgaagacaugggcaauggaugcuuuaaaauauaccacaagugugauaacgcuugcaucggcucaauucgaaaugggacauaugaccaugacguauaccgcgaugaggcccuaaacaauagauuccagaucaaaggaguggagcugaagagugguuacaaagacuggauucucuggaucuccuuugcaauaagcugcuuccugcuuugugucgcccuguugggcuuuaucaugugggcuugccaaaaggggaacauuagguguaauaucugcauuuga

SEQ ID NO: 131102 - RNA, 1701 nt, Artificial Sequence
  derived and/or modified sequence opt3 from hemagglutinin__InfluenzaA__AFM71835
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuucguguuaccccuaugacgucccugauuacgcaucauugaggagccucguggccaguuccggcacucuggaauuuaauucugagagcuucaacuggacagguguuacccagaaugggacguccucagcuugcauccggcgcaguuauaacagcuuuuucucucgacugaauuggcucacucauuuaaacuuuaaguacccagcacugaaugugaccaugcccaacaaugagcaguucgacaaacuuuauauuuggggaguccaccauccuggcacagauaaggaccagaucuuuccauacgcccaggcuuccggccguauuacugugucaaccaagagaagccaacaggccguaauccccaacauagggaguaggccucggguucgcaacauuccaucuagaaucuccauuuacuggacaaucgugaaaccgggagauaucuugcugauuaauagcaccgguaaccuaauagcgcccaggggcuauuucaagauccggucggggaaaucuuccauuaugcgcucagacgcaccuaucggaaaguguaauagugaaugcauaacgccaaacggcagcauucccaaugacaagccuuuucagaacgucaaucgaaucacuuacggugccuguccaagauauaucaaacaauccacacucaagcuggcuaccgggaugaggaacgugcccgagaaacagacucggggaauuuucggcgccaucgcaggcuuuauugaaaaugggugggagggaaugguggaugguugguacggcuuccgucaccagaacucugaggggcgcggacaagcugccgaccuuaagagcacacaggcggccauagaucagaucaauggcaaacugaacagauugauugguaagaccaaugaaaaauuccaccagaucgagaaggaauuuucagaggucgaagggaggauccaagaccucgagaaguauguugaggauacgaaaauugaccuguggaguuacaacgcagaauuacugguggcucucgagaaucagcauaccauagaucuuacagacuccgaaaugaacaagcuguucgagaaaacuaagaaacaguugcgggaaaacgccgaggauaugggcaauggaugcuuuaagaucuaucacaagugugacaacgcuugcauuggcagcauccgaaaugggaccuacgaucaugacguauaccgcgacgaggcccuaaacaauagauuccagauuaaaggaguggaacugaagucugguuauaaagauuggauccucuggauaucacuggcaaucaguugcuuucuucugugugucgccuugcucggcuucauuaugugggcuugccaaaaggggaacaucagguguaauauuugcaucuga

SEQ ID NO: 131103 - RNA, 1698 nt, Artificial Sequence
  derived and/or modified sequence opt3 from hemagglutinin__InfluenzaA__AFM71846
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacucauacgucaauaaaaagggcaaagaggugcuaguacucuggggcauacaucacccaaguaacagcaaggaacagcagaaccuguaucagaaugagaacgccuacguuucuguggucacuuccaauuacaaccguagauuuacacccgaaaucgcugagaggccuaaggugcgggaccaagccgggcgcaugaauuauuacuggacccuucugaaaccaggagauacgauuaucuucgaggcgaacgguaauuugauugcaccgauguaugccuuugcucucucaagaggcuucgggagcggaaucauaaccaguaacgccucuaugcacgaauguaauacuaagugccagacaccccugggcgcaauuaacuccagcuuaccuuaccagaauauccauccagugacuauuggugagugucccaaauaugucaggucggcuaagcugcggaugguuaccgggcuccgcaacaucccuucuauccagucccgaggacuuuuuggcgccauugcgggcuucauagaagggggauggacagguaugaucgacggcugguacggguaucaccaucaaaaugagcagggaucaggcuacgccgcagaucagaaaaguacccagaacgcuauuaaugguaucacgaacaaggugaacacuguaauagagaaaaugaauauucaauuuacagccguggggaaggaguucaacaagcuggagaaaagaauggaaaauuugaacaagaaagucgacgauggcuuucuagacaucuggaccuacaaugcugagcugcucgugcugcuugaaaacgagaggacucuggacuuccacgauagcaauguuaagaacuuguaugaaaaagugaagucccagcucaagaauaacgccaaagagaucggaaauggcugcuucgaguuuuaccacaagugugacaacgaaugcauggagucuguccggaaugggacauaugauuacccaaaauauagcgaagagucaaagcugaaccgugagaaaguggacggaguaaaguuagaaaguauggguauuuaccagauccuggcaauuuauuccaccguugccagcucucuagugcuccuggucucacuuggcgcuauaaguuucuggaugugcagcaauggguccuugcaaugucgcaucugcauuuga

SEQ ID NO: 131104 - RNA, 1701 nt, Artificial Sequence; identical to SEQ ID NO: 124334
  derived and/or modified sequence opt3 from hemagglutinin__InfluenzaA__AFM71857

SEQ ID NO: 131105 - RNA, 1701 nt, Artificial Sequence
  derived and/or modified sequence opt3 from hemagglutinin__InfluenzaA__AFM71868
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcuccugcaagcggcgcucaaacaauagcuuuuucagucgacugaacuggcucacucauuuaaaguuuaaauauccagcucugaaugugaccaugcccaacaacgagaaguucgacaaacuuuacaucuggggcguccaccauccugugacagauaaugaccagauucguuuguaugcacaggccucuggcagaaucacuguauccaccaagaggucacaacagacaguuauuccaaacaucgggagccggccccgcgugagagauauaccuaguaggauuucuaucuacuggaccauugucaaaccaggagacauccugcuaaucaauuccacggguaaccucauugcuccgcggggcuacuuuaagauacgcagcgggaagucgucuaucaugcgauccgacgcccccauuggaaaauguaauucagagugcaucacuccuaacggcaguauaccaaaugauaagcccuuccagaacgugaauagaauuacauauggugcguguccuagguacgugaaacagaacacccugaaacuugcaacugggaugcggaaugucccagaaaagcaaacacguggaaucuuuggcgccaucgcuggcuucauugagaacgggugggaaggaaugguugacgguugguauggcuuucgccaccagaauagcgaggggaucggacaggccgcagaucugaaguccacccaagcugccauuaaccagauaaauggcaaauugaacagacucaucgguaagacgaacgagaaguuccaccagauugaaaaagaguucucugaaguggaggggaggauccaggaccuggaaaaguacguagaggauaccaaaaucgacuuauggagcuauaaugcggagcugcucguggcccuugaaaaccaacauacaauugaucugacugacucagagaugaauaaguuguuugaacggaccaaaaagcagcuacgagagaacgcagaagauaugggcaauggaugcuucaagauauaccacaaaugugacaacgcuugcaucggcaguauucgcaaugggacauaugaucaugacgucuacagagacgaggcccugaacaauagguuucagaucaagggaguggagcucaaauccgguuacaaggauuggauucuguggaucagcuucgcuauaucuugcuuucuucuguguguuguguugcucggcuucaucaugugggccugccagaaagggaacauucgguguaauaucugcauuuga

SEQ ID NO: 131106 - RNA, 1701 nt, Artificial Sequence; identical to SEQ ID NO: 129014
  derived and/or modified sequence opt3 from hemagglutinin__InfluenzaA__AFM71879

SEQ ID NO: 131107 - RNA, 1701 nt, Artificial Sequence
  derived and/or modified sequence opt3 from hemagglutinin__InfluenzaA__AFM71890
augaaggccagacugcucgugcuucugugcgcuuuggcagccaccgacgcggauacaaucuguauuggcuaccacgcuaacaauagcacugacacggucgauaccuuacuggagaaaaacguuacagugacucauuccguaaaucuacucgaagacucucacaacgggaagcugugcaaacuuaagggaauagccccgcugcaguuggguaaauguaauaucgcaggcuggcuccuggggaacccugagugcgauucacugcucccagccaggaguuggagcuauauuguggaaacccccaauuccgagaacggagcuuguuaccccggcgacuucaucgauuaugaagaguuaaaggagcaacugucuucggucucaagccuugaacgguuugagauuuucccuaaggaaaguuccuggccaaaucauaacacauugaaaggugugaccgcaucuugcagccacgggggaaaguccucauuuuaccgcaaucugcuauggcucacuaaaacagaggacaguuaucccaagcugagcaacucuuacguuaauaacaaaggcaaggaggugcuuguccuguggggcgugcaucacccuuccucaagcgaugaacagcagaguuuguaucacaauguaaacgccuacguuucuguggucuccagcaacuacaaucgacguuucaccccagagaucgcugccagacccaaggugaggaaccagccugggcggaugaauuauuacuggacgcuccuggaaccaggagacacuauaaucuuugaggcgaccgguaacuuaauugcaccgugguaugccuucgcucugucgcgcggcuuugggucuggaaucauuacauccaaugccucaaugcaugaauguaacacuaaaugccaaacaccccagggcgcaaucaauaguagccucccuuuccagaacauacacccagugaccauuggugagugucccaaguacgucagauccaccaaacuuaggaugguuacggggcugcggaauaucccuucuauucaguuucgcggauuguucggcgcuaucgccggcuuuaucgaagggggauggacugguaugauugauggcugguauggguaccaucaccaaaacgagcagggaagcggcuaugcggccgaccagaagucaacacagaaugcaauaaacgguaucaccaauaaagugaacaguguaauugagaagaugaauacucaauucacagcuguguccaaagaauuuaacaaccuagagaagcgaauggaaaaucugaacaagaaagucgaugacggguuccucgacaucuggaccuacaaugccgagcugcuugugcuguuggagaacgaaagaacgcucgauuuccacgaccugaauguuaagaacuuauacgagaaagucaagagccagcugaaaaauaacgcuaaggaaauaggcaauggaugcuuugaguucuaucauaagugugauaacaaaugcauggaaucugugaggaauggcaccuacgacuauccaaaguacucagaggagaguaaacuaaaccgggaaaagauugauggggugaaacucgagagcaugggaguauaucagauccuggccaucuacuccacaguugcaucuucgcuuguguugcuggucagccucggugccauuuccuuuuggaugugcucaaauggcagucugcaaugucguaucugcauuuga

SEQ ID NO: 131108 - RNA, 1701 nt, Artificial Sequence; identical to SEQ ID NO: 131093
  derived and/or modified sequence opt3 from hemagglutinin__InfluenzaA__AFM71901

SEQ ID NO: 131109 - RNA, 1701 nt, Artificial Sequence
  derived and/or modified sequence opt3 from hemagglutinin__InfluenzaA__AFM71923
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgagcuaguacagucuucaaguacaggcaagaucugcaauaacccacacaggauucucgaugggaucgacuguacccugauagaugcgcuucugggagacccgcauugcgauagcuuucagaaugaaacuugggacuuguucguggaaagauccaaggcuuuuucuaacuguuaucccuacgaugucccugacuaugccucgcuccggucacugguggcaagcaguggcacacuggaguucaucaaugaagguuuuaccuggacggggguuacucagaacggaggcuccaaugccugcaagcgcggcccagauucuggguucuuuagccgacucaacugguuauacaaauccggaucaaccuaucccgugcugaaugucacaaugccuaacaaugacaacuucgauaaacuuuacauuuggggugugcaccauccaaguacuaaccaagagcagaccagcuuguauguacaggcuucuggccguguuacaguguccaccaagagaucacagcaaacgaucauucccaauaucgggagcaggccuuggguccggggacugaguucucgcauauccauuuacuggacuaucgugaaaccaggcgacauucuagugaucaacagcaaugguaaccucaucgcaccgagaggguacuuuaagaugaggacaggaaaaucgucuauuaugcgguccgacgcccccauaggcaccuguaucucagagugcauuacuccuaauggcaguaucccaaacgauaagcccuuccagaaugucaacaaaauaacauauggggcuuguccuaaguacguuaagcagaauacccugaaacuugccacgggaaugcgcaacgugccagaaaagcagacccgaggucuguuuggcgcgauugcaggguucaucgagaauggaugggaaggcaugaucgacgguugguauggguuuagacaccaaaacagcgagggcacaggacaggccgcugauuugaaauccacucaggccgcaauugaccaaaucaauggcaagcucaacaggguaauugagaaaaccaaugaaaaguuccaccagauagagaaagaguucucugaaguggaagggcggauccaggaucuggagaaguacgucgaggacacaaagauugauuuauggagcuauaacgcugaacugcucguggcccuugagaaccagcauacuaucgaccugaccgauucagaaaugaauaaauuguuugagaagacacgucgccaacuaagagaaaacgcggaggacaugggaaaugguugcuucaggaucuaccacaaaugugauaacgccugcauuggcaguauacggaaugggaccuaugaccaugacguuuaccgagaugaggcacugaacaaucgcuuucagaucaagggaguggaacucaaauccggcuacaaggacuggauucuguggaucagcuucgcuauuucuugcuuucuucugugugucguguugcucgguuucaucaugugggccugccagaaggggaacauaagauguaauaucugcauuuga

SEQ ID NO: 131110 - RNA, 1701 nt, Artificial Sequence
  derived and/or modified sequence opt3 from hemagglutinin__InfluenzaA__AFM71934
augaagaccaucauugcccugagcuacauauucugccucgugcuuggccaggaccugcccgggaacgauaauuccacagcuacuuuguguuuaggacaccaugcagucccuaacgguacgcugguuaaaaccaucacaaaugaccaaauugaggugacuaacgccaccgagcuaguacagucuucaaguacaggcaagaucugcaauaacccacacaggauucucgaugggaucgacuguacccugauagaugcgcuucugggagacccgcauugcgauggcuuucagaaugaaacuugggacuuguucguggaaagaagcaaggcuuuuuccaacuguuaucccuacgaugucccugacuaugccucucuccggucgcugguggcaucaagcgguacacuggaguucaucaaugaaggguuuaccuggacgggaguuacucagaacggcggcaguaaugccugcaagcgcgggccagauuccggauucuuuucucgacucaacugguuauacaaaagcgguuccaccuaucccgugcugaaugucacaaugccuaacaaugacaacuucgauaaacuuuacauuuggggcgugcaccauccaucaacuaaccaagagcagaccaguuuguauguacaggcuagcgggcguguuacagugucuaccaagggaucccagcaaacgaucauucccaauaucggcucaagaccuugggucaggggucugagcagucggauaucuauuuacuggacuaucgugaaaccaggggacauucuagugaucaacuccaauggaaaccucaucgcaccgcgcggcuacuuuaagaugagaacaggcaaaagcucgauuaugaggucugacgcccccauagggaccuguaucuccgagugcauuacuccuaauggaucaaucccaaacgauaagcccuuccagaaugucaacaaaauaacauauggugcuuguccuaaguacguuaagcagaauacccugaaacuugccacgggcaugcggaacgugccagaaaagcagacccgcgggcuguuuggagcgauugcaggcuucaucgagaaugguugggaagggaugaucgacggcugguauggauuucgacaccaaaacagugagggcacagggcaggccgcugauuugaaaagcacucaggccgcaauugaccaaaucaauggaaagcucaacagaguaauugagaaaaccaaugaaaaguuccaccagauagagaaagaguucuccgaaguggaagguaggauccaggaucuggagaaguacgucgaggacacaaagauugauuuauggucuuauaacgcugaacugcucguggcccuugagaaccagcauacuaucgaccugaccgauagcgaaaugaauaaauuguuugagaagacacggcgucaacuacgcgaaaacgcggaggacaugggcaaugggugcuucagaaucuaccacaaaugugauaacgccugcauuggaucaauaaggaauggcaccuaugaccaugacguuuaccgggaugaggcacugaacaaucgauuucagaucaaggguguggaacucaaaaguggguacaaggacuggauucuguggaucuccuucgcuauuagcugcuuucuucugugugucguguugcucggcuucaucaugugggccugccagaagggaaacauacgcuguaauaucugcauuuga

SEQ ID NO: 131111 - RNA, 1701 nt, Artificial Sequence
  derived and/or modified sequence opt3 from hemagglutinin__InfluenzaA__AFM71945
augaagaccaucauugcccugagcuacauauucugccucgugcuuggccaggacuuucccgggaacgauaauuccacagcuacucuguguuugggacaccaugcagucccuaacgguacguuaguuaaaaccaucacaaaugaccaaauugaggugacuaacgccaccgaacugguacagucuucaaguacaggcaagaucugcaauaacccacacaggauucuagaugggaucaauuguacccucauagacgcgcugcuuggagauccgcauugcgacggcuuccagaacgagacuugggaucuguuuguggaaagaagcaaggcuuucuccaauuguuaucccuacgacgucccugauuaugccucuuugcggucgcucguggcaucaagcgguacacuggaguuuaucaacgaaggguucaccuggacgggaguuacucagaauggcggcaguaacgccugcaaacgcgggccagacuccggauuuuucucucgacugaauuggcucuacaaaagcgguuccgcuuaucccguguuaaacgucaccaugccuaauaacgauaacuuugacaagcuguacauuuggggcgugcaccauccaucaacagaucaagagcagacuaaucuuuauguacaggcaagugggcguguuaccgugagcacaaagagaucucagcaaaccaucauucccaacaucggauccaggccuuggguccggggcuugucaagccgcauaaguauuuacuggacgaucgugaaaccaggugacauucuggugaucaauucuaacgggaaucuaaucgccccgagaggauacuucaagaugaggacuggcaaauccagcauuaugcggucggacgcucccauaggcacauguaucucugagugcauuaccccuaacggguccaucccaaaugauaagcccuuucagaacgucaauaaaauaacuuauggagccuguccuaaguacguuaagcagaacacacucaaacuggcgaccgguaugcgcaaugugccagaaaagcagacgcgaggcauuuucggggcaaucgccggauuuaucgagaacggcugggaagguaugauugacgggugguauggcuucagacaccaaaauucagagggaaccggccaggcugccgaucuuaaaaguacacaggcagcuaucgaccaaauuaacgggaagcugaauaggguaauagagaaaacuaacgaaaaguuccaccagaucgagaaagaauuuagcgagguggaaggacggauucaggauuuggagaaguacgucgaggacaccaagaucgaucucugguccuauaacgccgaacuguuaguggcgcuggagaaucagcauacaaucgaccucacugauucugaaaugaacaaacuuuucgagaagacccgucgccaacugagagaaaaugccgaggacauggguaacggcugcuuuaaaauuuaccacaagugugauaaugcaugcauagggagcaucaggaacggaacauaugaccaugacguuuaccgggaugaggcuuugaauaaccgauuccagauuaaaggcguggaacuaaagucagguuacaaggacuggauccuguggauuaguuuugccaucuccugcuuccuccugugugucgugcuucugggguuuauaaugugggcuugccagaaaggcaauauccgcuguaacauuugcaucuga

SEQ ID NO: 131112 - RNA, 1701 nt, Artificial Sequence; identical to SEQ ID NO: 131111
  derived and/or modified sequence opt3 from hemagglutinin__InfluenzaA__AFM71956

SEQ ID NO: 131113 - RNA, 1704 nt, Artificial Sequence
  derived and/or modified sequence opt3 from hemagglutinin__InfluenzaA__AFM71978
augaagaccaucauugcccugagcuacauauucugccucguguuugcucaggaccuucccggcaacgauaauaacuccacagcaacucuguguuuggggcaccaugccgucccuaauggaacguuaguuaaaaccaucacaaacgaccaaauugaggugacuaaugcgaccgaacugguacagucuucaaguacagguaagaucugcaacaauccacacaggauucuagauggcaucaacuguacccucauagacgcucugcuuggggauccgcauugcgacggauuccagaaugagaaaugggaucuguuuguggaaagaagcaaggccuucuccaacuguuaucccuacgacgucccugauuaugcaucuuugcggucgcucguggccucaagcggcacucuggaguuuaucaaugaagguuucaacuggacagggguuacccagaauggaggcaguaacgcuugcaaacgcggcccagacuccggguuuuucucucgacugaauuggcucuacaagagcggauccacguaucccgugcaaaacgucacuaugccuaacaaugauaacucagacaaguuauacauuuggggugugcaccauccaaguaccgauaaagagcagacaaaucuguauguacaggcaagcggcaagguuacugugucuaccaaacguucccagcaaacaaucauucccaacgucgggucaagaccuugggugaggggacuuagcagucggaucucuauauacuggaccauugugaagccaggcgacaucuuggucauuaauuccaacgguaaucugaucgccccgcgcggguacuuuaaaaugagaacgggaaagagcucgaucaugaggucugacgcucccauuggcacuuguuccucagagugcauaacaccuaacggcaguaucccaaaugauaagcccuuccagaacguuaauaaaauuaccuauggggccuguccuaaguacgugaaacagaacacucuaaagcucgcgacaggaaugcggaauguaccagaaaaacagacccgcgguaucuuuggcgcaauagccggguucauugagaacggaugggaaggcaugaucgacgguugguauggguuucgacaccaaaauagcgagggcacgggacaggcugccgaucugaaguccacccaggcagcuaucgaccaaauuaacggcaaacuuaacagagugaucgagaagacaaaugaaaaguuccaccagauugagaaagaguucucugaagucgaagggaggauacaggaucuggagaaguacguggaggacacuaaaaucgauuuguggagcuauaacgccgaacuccugguugcguuagagaaucagcauaccauugaccugacagauucagaaaugaacaagcucuuugagaaaacucggcgucaacuucgcgaaaaugccgaggacaugggaaacgguugcuucaagaucuaccacaagugugauaaugcaugcaucggcaguauuagaaacgggaccuaugaccaugacguguacagggaugaggcucugaauaaccgguuucagauaaaaggagucgaauugaaguccggcuacaaagacuggauccuauggauuagcuucgccaucucuugcuuucugcucugugugguacugcuugguuucauuaugugggcuugccagaaggggaauauccgauguaacauaugcaucuga

SEQ ID NO: 131114 - RNA, 1701 nt, Artificial Sequence
  derived and/or modified sequence opt3 from hemagglutinin__InfluenzaA__AFM71989
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuagcacagacaaagaucagaucuuuuuguacacucaagccgcuggccguauuaccgugucuacaaagagaucccagcaggccguaaucccaaauauaggcucaaggccccggguucgcaacauuccuagcagagugaguaucuauuggaccauugucaaaccaggggacauccugcuaaucaauucuacgggaaaccucauugcgccgagggguuacuucaagauacgguccggcaaaagcucgaucaugcgcucugaugcacccauugggaaguguaauuccgccugcaucacuccuaacggaucaauaccaaaugacaagcccuuucagaacgugaaucgaauuacauacggcgcuuguccuagauaugugaaacaaaacacccugaaacuugccacugguaugaggaaugucccagaaaaacagacacgggggaucuucggagcaaucgcuggcuuuauugagaacggcugggaagggaugguugacggaugguacgguuuccgucaccagaauagugagggccgcgggcaagccgcggaucuuaagagcacccaggccgcaaucgaccagauuaacggaaaauugaacagacucauaggcaagacgaaugagaaauuccaucagaucgaaaaggaguuuuccgaaguggaggguaggauucaagaucuggaaaaguauguagaggacaccaaaaucgauuuauggucuuacaacgcugagcugcucguggcccuugaaaaucagcacacaaucgaccugacugauagcgagaugaacaaguuguucgaaaagaccaagaaacagcuacgggagaaugcugaagacauggggaacggcugcuuuaagauuuaucauaagugugauaaugccugcauaggaucaauccgaaacggcacauacgaccacgaugucuaucgcgacgaggcacugaauaacagauuccagauuaaagggguggagcucaagaguggauacaaagacuggauccuguggauuuccuuugccaucagcugcuuccuucuguguguugcuuugcucgguuuuauaaugugggcgugccaaaagggcaauaucagguguaacauuugcaucuga

SEQ ID NO: 131115 - RNA, 1701 nt, Artificial Sequence
  derived and/or modified sequence opt3 from hemagglutinin__InfluenzaA__AFM72010
augaagaccaucauugcccugagcuacauauucugccaggugcucgcucaaaaccuucccggcaaugacaacuccacagcaacucuguguuuggggcaccaugccgucccuaauggaacguuaguuaaaaccaucacaaacgaucagauugaggugacuaaugcgaccgaacugguacagucuucaaguacagguagaaucugcgacagcccacacaggauucuagauggcaagaacuguacccucaucgacgcucugcuuggggauccgcauugcgacggauuucagaaugagaaaugggaucuguucguggaacgguccaaggccuuuucuaacuguuaucccuacgacgucccugauuaugcaucguugcgcucacucguggccagcaguggcacucuggaguucauaaaugaagguuuuaacuggacagggguuacccaaaauggaggcuccuacgcuugcaaacgaggcccagacaagucuuucuuuagccgucugaacuggcucuaugaguccgagucaacguaccccguguuaaaugucacuaugccuaacaaugauaacuucgacaagcuguauaucuggggagugcaccauccaaguaccgauaaagaacagacaaaacuuuacguacaggcaagcgggagaguuacugugucuaccaagaggucccagcaaacaauuauccccaacgucgguucacggccuugggugcgcggcuugagcaguagaauuucuaucuacuggaccauagugaagccaggggacauucugcuaaucaauuccaacggaaaucucauugccccgaggggcuauuuuaaaauccggacggguaagagcucgaucaugcgcucugacgcucccauugggacuuguuccucagagugcauaacaccuaacggaaguaucccaaaugauaagcccuuccagaacgucaauaaaauuaccuacggcgccuguccuaaguauguuaaacagaacacucugaaacuugcgacaggcaugcgaaaugugccagaaaagcagaccagagggaucuuuggagcaauagccgguuucauugagaacggcugggaggggaugaucgacggaugguacggcuuuaggcaccaaaauagcgaagguacggggcaggcugccgaucugaaguccacccaggcagcuaucgaccaaauuaacggcaaauugaaucggguaaucgagaagacaaacgaaaaguuccaccagauugagaaagaguucucugaaguggagggacguauacaggaucucgaaaaguaugucgaggacacuaaaaucgaucuguggagcuacaaugccgaauuacugguggcgcucgagaaccagcauaccauugaccuuacagauucagaaaugaacaagcuguuugagaaaacucgcagacaauugagggagaaugccgaagacaugggcaacgggugcuucaagaucuaucacaagugugauaaugcaugcaucggaaguauucggaacgguaccuacgaccaugacguuuaccgagaugaggcucuaaauaaccgcuuucagauaaaaggcguggaacugaaguccggguauaaagacuggauccucuggauuagcuucgccaucucuugcuuucugcuuugugucgugcuguugggauucauuaugugggcuugccagaagggcaauaucagauguaacauaugcaucuga

SEQ ID NO: 131116 - RNA, 1701 nt, Artificial Sequence; identical to SEQ ID NO: 122931
  derived and/or modified sequence opt3 from hemagglutinin__InfluenzaA__AFM72021

SEQ ID NO: 131117 - RNA, 1701 nt, Artificial Sequence
  derived and/or modified sequence opt3 from hemagglutinin__InfluenzaA__AFM72032
augaagaccaucauugcccugagcuacauguucugccucguguuugcucagaaccuucccggcaaugacaacuccacagcaacucuguguuuggggcaccaugccgucccuaauggaacguuaguuaaaaccauaacaaacgaucaaaucgaggugacuaaugcgaccgaacugguacagucuucaaguacagguagaauuugcgacagcccacacaggauccuagauggcaagaacuguacccucauugacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuaucaaugaagguuucaacuggacagggguuacccaguccggaggcucuuacacgugcaaacgaggcagcaauaacuccuuuuucucacgucugaauuggcucuaugagagugagagcaaguacccaguguuaaacgucacuaugcccaauaacgggaaguuugacaaacuguauauauggggaauccaccauccuucuaccgauaaggaacaaacaaaccuuuacauuagagcuuccgguagggugacuguaucaaccaaacggagccagcagacaguuaucccaaauauuggcagucgccccugggugagaggguugucuuccaggaucagcauauacuggaccauugucaagccuggagacauccugcuaauuaacucgacgggcaaucucaucgcaccacgggguuauuucaaaauccgcacugggaagucuuccauuaugcgaucagaugccccgauaggaacauguaguagcgagugcaucacccccaacggcuccauuccuaaugacaagccauuucagaacgugaauaaaaucacuuacggcgcuugucccagauaugugaagcaaaacacacugaaacuugccaccgggaugaggaaugucccugaaaagcagacgcggggaauauucggugcgauugcaggcuuuaucgagaacgggugggagggaaugguugacggcugguacgguuuccgucaccaaaauucugaagggaccggccaggccgcugaucugaaaagcacacaggccgcaaucgaccagauuaacggaaaguugaaucgcgugaucgagaaaacuaacgaaaaguuccaccagauugagaaggaauuuucagagguagagggcagaauacaagaucucgaaaaauauguggaggacaccaagaucgaucuguggaguuacaaugcugaauuacuggucgcccucgagaaccagcauacaauugaccuuacugauuccgaaaugaacaaacuguucgagaagaccaggaaacaguugcgggagaaugcggaagacauggggaacggaugcuuuaagaucuaucacaagugugauaaugccugcaucgguagcauucgaaacggcacauacgaccaugauguguaccgcgacgaggcacuaaauaacagauuccagauaaaagggguugaacugaagucuggauauaaagacuggauccucuggauuucauuugcuaucaguugcuuccugcuuugugugguccuguugggcuuuauuaugugggccugccaaaaggguaauaucagguguaacauaugcaucuga

SEQ ID NO: 131118 - RNA, 1701 nt, Artificial Sequence
  derived and/or modified sequence opt3 from hemagglutinin__InfluenzaA__AFM72043
augaagaccaucauugcccugagcuacauguucugccucguguuugcucagaaccuucccggcaaugacaacuccacagcaacucuguguuuggggcaccaugccgucccuaauggaacguuaguuaaaaccauaacaaacgaucaaaucgaggugacuaaugcgaccgaacugguacagucuucaaguacagguagaauuugcgacagcccacacaggauccuagauggcaagaacuguacccucauugacgcucugcuuggggauccgcauugcgacggauuccagaaugagaaaugggaucuguuuguggaacgguccaaggccuucucuaacuguuaucccuacgacgucccugauuaugcaucguugcgcucacucguggccagcaguggcacucuggaguuuaucaaugaagguuucaacuggacagggguuacccaguccggaggcucuagcacgugcaaacgaggcuccaauaacucauuuuucagucgucugaauuggcucuacgagagcgagucuaaguauccaguguuaaacgucacuaugcccaauaacgggaaguuugacaaacuguacauauggggaauccaccauccuuccaccgauaaggaacaaacaaaccuuuauauuagagcuucagguagggugacuguaagcaccaaacggagucagcagacaguuaucccaaauauuggcucucgccccugggugagaggguuguccagcaggaucucgauauacuggaccauugucaagccuggagacauccugcuaauuaacucuacgggcaaucucaucgcaccacgggguuacuucaaaauccgcacugggaaguccucaauuaugcgaagugaugccccgauaggaacauguagcuccgagugcaucacccccaacggcucuauuccuaaugacaagccauuucagaacgugaauaaaaucacuuauggcgcuugucccagauacgugaagcaaaacacacugaaacuugccaccgggaugaggaaugucccugaaaagcagacgcggggaauauucggugcgauugcaggcuuuaucgagaacgggugggagggaaugguugacggcugguaugguuuccgucaccagaauagcgaagggaccggccaggccgcugaucugaaaucaacacaagccgcaaucgaccagauuaacggaaaguugaaucgcgugaucgagaaaacuaacgaaaaguuccaccagauugagaaggaauuuagugagguagagggcagaauacaagaucucgaaaaauacguggaggacaccaagaucgaucugugguccuauaaugcugaauuacuggucgcccucgagaaccagcauacaauugaccuuacugauagcgaaaugaacaaacuguucgagaagaccaggaaacaguugcgggagaaugcggaagacauggggaacggaugcuuuaagaucuaccacaagugugauaaugccugcaucgguucuauucgaaacggcacauaugaccaugauguguaccgcgacgaggcacuaaauaacagauuccagauaaaagggguugaacugaagucaggauacaaagacuggauccucuggauuaguuuugcuaucagcugcuuccugcuuugugugguccuguugggcuuuauuaugugggccugccaaaaggguaauaucagguguaacauaugcaucuga

SEQ ID NO: 131119 - RNA, 1701 nt, Artificial Sequence
  derived and/or modified sequence opt3 from hemagglutinin__InfluenzaA__AFM72054
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacaaccacaaugggaaacucugcaagcugaaaggaauagcuccccuucagcuggguaaguguucaaucgccggcuggauuuuggggaacccugagugcgaaagucucuucagcaagaaauccuggucuuauaucgcagagaccccaaauucggaaaacggaacauguuacccgggcuauuuugccgauuacgaggagcugagagaacaacugucaagcgucaguuccuucgagagguuugaaauuuuccccaaggagucuagcuggccuaaacauaaugugaccaaggguguuacugcugcaugcucccacaaagggaagucaaguuuuuaucggaaccucuuauggcugacagagaagaauggaagcuacccaaaccuuucuaaauccuaugugaauaacaaggaaaaagaggucuuggugcuguggggcguacaucaccccucaaauaucgaagaccagaagaccauauaccgcaaagagaacgccuacguuagcguggucaguucucacuauaaccgacguuucacgccugaaaucgcuaagagaccaaaagugaggaaucaggagggccggauuaacuacuauuggacucuacucgagcccggggauaccaucauuuuugaagccaauggaaaccugaucgcgccuugguacgcauucgcccuuucccgcgguuuuggcagcgggauaauuacaucgaaugcuucuauggacgagugugaugccaagugccagacuccacaaggagcaaucaacuccucacugccguuccagaaugugcaucccgucaccauuggcgaauguccuaaguauguuagaaguacaaaauugaggauggugaccggucuccggaacaucccaagcauccagucccgcgggcuguuuggagcuauugccggcuucauagagggcggguggacgggaaugaucgacgguugguacggcuaucaccaucagaaugaacaagggucuggauacgcggccgaucaaaagagcacucagaacgcaauuaauggcaucacaaacaaaguaaauucaauaauugagaagaugaacacccaguuuacugcuguggguaaagaguucaauaaguuagaaaagcgaauggagaaccugaacaaaaaggucgacgauggguuccucgacaucuggacauacaaugccgaacuucugguguugcuagagaacgaaagaacccuggacuuucacgauaguaauguuaaaaaccucuaugagaaggugaaaucccagcugaagaauaacgcuaaggagaucggcaauggaugcuucgaauuuuaccacaaauguaacaaugagugcauggaaagcgucaagaacggcacguaugacuaccccaaauauucugaggagucaaaacuuaauagggaaaagauugauggggugaagcuggagaguaugggaguauaccagaucuuggccauuuauagcaccguugcauccucucucgugcuguuagucucgcugggugccaucagcuucuggaugugcuccaacggcucacuacagugucggauaugcauuuga

SEQ ID NO: 131120 - RNA, 1701 nt, Artificial Sequence; identical to SEQ ID NO: 131119
  derived and/or modified sequence opt3 from hemagglutinin__InfluenzaA__AFM72065

SEQ ID NO: 131121 - RNA, 1701 nt, Artificial Sequence
  derived and/or modified sequence opt3 from hemagglutinin__InfluenzaA__AFM72087
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuauagaacgguccaaagccuucucuaauuguuaucccuacgacgugccugauuaugcaucguugcgcucacucgucgccagcaguggcacucuggaguuuaucaacgaagguuucaauuggacaggggugacccaguccggaggcucuuacacgugcaagcgaggcagcguuaacuccuuuuucucacgucugaauuggcucuaugagagugaguacaaguauccagcuuuaaacgugacuaugcccaauaacgggaaauuugacaagcuguacauuuggggaguccaccauccuagcaccgaaaaagagcaaacaaaucuuuacgugagagcaucugguaggguaacuguuuccaccaagcggucacagcagacagugaucccaaacauuggcagcagucccuggguccgcggguugucuuccagaaucagcauauauuggaccauugugaaaccuggagauauccugcuaauuaacucgacgggcaaucucaucgccccaagggguuacuucaagauccggacugggaagucuuccauuaugcgcucagacgcuccgauaggaacauguaguagcgaaugcaucacccccaacggcuccauuccuaaugauaaaccauuucagaacgugaauaagaucacuuauggcgccuguccccgauacgucaaacaaaacacacugaagcuggcgaccgggaugagaaauguuccugagaaacagacgaggggaauauucggugcaauugccggcuuuaucgagaacgggugggaaggaaugguggacggcugguaugguuuccggcaccaaaauucugaggggaccggccaggcugccgaccuuaagagcacacaggcagcuaucgaucagauuaacggaaaauugaaucgucucaucgaaaagacuaacgagaaguuccaccagauugaaaaagaguuuucagagguagaaggccgcauacaagaccuggagaaguacguggaagauaccaaaaucgacuuauggaguuauaaugccgagcugcucgucgcgcuugaaaaccaguacacaauugaucugacugacuccgagaugaauaaguuguucgagaaaaccagaaagcagcuaagggaaaacgccgaggauauggggaacggaugcuuuaagaucuaccauaaaugugacaaugcaugcaucgguagcauucggaacggcacauaugaucacgacguguaccgagaugaagcucugaauaaccgcuuccagauaaaggggguugagcucaaaucuggauauaaggacuggauccuguggauuucauuugccaucaguugcuuccuucuguguguggucuugcucggcuuuauuaugugggcuugccaaaaagguaauaucagauguaacauaugcaucuga

SEQ ID NO: 131122 - RNA, 1701 nt, Artificial Sequence
  derived and/or modified sequence opt3 from hemagglutinin__InfluenzaA__AFM72098
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcucuacaagagugaguauaaauacccagcauuaaacgucacgaugcccaauaacggcaaguucgauaaacuguacaucuggggagugcaccauccuguaacugacagagagcaaaccaaucuuuauguuagggccagcgggcgggugacagucucuacuaagcgcucccagcagaccgugauuccaaacaucgguucaagacccugggugaggggcuugagcagucggauuucuaucuacuggacaauagucaaaccuggggauauucugcuaaucaacuccaccggaaaucucauugcuccacgcggcuauuuuaagauccgaacggguaagagcucgaucaugagaucugacgccccgauugggacuuguuccucagaaugcauaacacccaacggaaguaucccuaaugacaaaccauuccagaacguuaauaagauuaccuacggcgcgugucccagguaugugaaacaaaacacucugaaacuugcaacaggcaugcggaauguaccugagaaacagacccgugggaucuuuggagccauagcugguuucauugaaaacggcugggaggggaugguggauggaugguacggcuuucgccaccagaauagcgaggguacggggcaggccgcagaccugaaguccacccaagcugccaucgaucagaucaacggcaaauugaauagacucauugaaaagacaaacgagaaguuccaccagaucgaaaaagaguucucugaagucgagggaaggauucaagaccuggagaaguauguggaagauacuaaaauagacuuauggagcuacaaugcggagcugcucguugcccuugaaaaccagcauaccaucgaucugacagacucagagaugaauaaguuguuugaaaagacucggaagcagcuacgagagaacgcagaggauaugggcaacgggugcuucaagauuuaccacaaaugugacaaugcuugcaucggaaguauccgcaacgguaccuaugaucaugacguguacagagacgaagcccugaauaacagguuucagauuaagggcgucgagcucaaauccggguauaaggauuggauacuguggaucagcuucgcuauuucuugcuuucuucugugugugguauugcucggauucaucaugugggccugccaaaaaggcaauauucgguguaacaucugcauauga

SEQ ID NO: 131123 - RNA, 1701 nt, Artificial Sequence
  derived and/or modified sequence opt3 from hemagglutinin__InfluenzaA__AFM72109
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcuccacaagagugaguacaaauauccagcauuaaacgucacgaugcccaauaacggcaaguucgauaaacuguacaucuggggagugcaucacccuauuacugacagagagcaaaccaaucuuuacguaagggccagcgggcggguuacagugucuacuaagcgcucccagcagaccgucaucccaaacauugguucaagacccugggugaggggcuugagcagucggaucucuauauauuggacaauugugaaaccuggggauauccugcuaauuaacuccaccggaaaucucaucgcuccacgcggcuacuuuaagauccgaacggguaagagcucgauuaugagaucugacgccccgauagggacuuguuccucagaaugcaucacacccaacggaaguauuccuaaugacaaaccauuccagaacgucaauaagaucaccuauggcgcgugucccagguacguuaaacaaaacacucugaaacuugcaacaggcaugcggaaugugccugagaaacagacccgugggauauuuggagccauugcugguuucaucgaaaacggcugggaggggaugguagauggaugguauggcuuucgccaccagaauagcgaggguacggggcaggccgcagaccugaaguccacccaagcugccaucgaucagauuaacggcaaauugaauagacucaucgaaaagacaaacgagaaguuccaucagauugaaaaagaguucucugaaguggagggaaggauacaagaccuggagaaguacgucgaagauacuaaaaucgacuuauggagcuauaaugcggagcugcucguggcccuugaaaaccagcacaccauugaucugacagacucagagaugaauaaguuguuugaaaagacucggcgacagcuacgcgagaacgcagaggauaugggcaacgggugcuucaagaucuaccauaagugugacaaugcuugcaucggaaguauuagaaacgguaccuacgaucacgacguuuauagggacgaagcccugaauaaccgguuucagauaaaaggcguggagcucaaguccggguacaaagauuggauccuguggauuagcuucgcuaucucuugcuuucuucugugugucguguugcucggauucauuaugugggccugccaaaagggcaauauccgcuguaacauaugcaucuga

SEQ ID NO: 131124 - RNA, 1701 nt, Artificial Sequence
  derived and/or modified sequence opt3 from hemagglutinin__InfluenzaA__AFM72120
augaagaccaucauugcccugagcuacauauucugccucguguuugcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuccagaacgagaagugggaucuguuuguggaacgguccaaagccuauucuaauuguuaccccuaugacgucccugauuacgcaucguugcgcucacucguggccagcaguggcacucuggaguucauaaacgaagacuuuaauuggacagguguuacccaguccgggggaucuuaugcuugcaagcgaggcagcgugaacuccuucuuuucacgucugaauuggcuccacgagagugaguacaaguauccagcauuaaacgucacgaugcccaauaacggcaaauucgauaagcuguacaucuggggagugcaucacccuauuacugacagagaacaaaccaaucuuuacguaagggccagcgggcggguuacagugucuacuaaacgcucccagcagaccgucaucccaaacauugguuuuagacccugggugaggggcuugucaagccggaucaguauauauuggacaauugugaagccuggggauauccugcuaauuaacucuaccggaaaucucaucgcuccacgcggcuacuucaaaauccgaaacgguaaguccagcauuaugagaucggacgccccgauagggacguguucuuccgagugcaucacucccaauggaucaauuccuaacgacaagccauuucagaaugucaacaaaaucacauauggcgcgugucccagguacguuaagcaaaauacccugaaacuugcaacuggcaugcggaacgugccugaaaagcagacacgugggauauucggagccauugcugguuuuaucgagaauggcugggaggggaugguagauggaugguauggcuuccgccaccagaacagugaagguaccgggcaggccgcagaccugaaaagcacgcaagcugccaucgaucagauuaauggcaaguugaacagacucaucgagaaaaccaaugaaaaguuccaucagauugagaaggaauuuuccgagguggagggaaggauacaagaccuggaaaaauacgucgaggauacaaagaucgacuuauggucuuauaacgcggaacugcucguggcccuugagaaucagcacacuauugaucugaccgacagcgaaaugaacaaauuguucgagaagacacggaaacagcuacgagagaacgcagaagauaugggcaaugggugcuuuaagaucuaccauaagugugacaacgcuugcaucggaucaauucgcaaugguacuuacgaucacgacguuuauagagacgaggcccugaacaauagguuccagauaaaaggcguggaacucaagaguggguacaaagauuggauccuguggauuuccuuugcuaucagcugcuuccuucugugugucguguugcucggauuuauuaugugggccugccaaaagggcaacauccgguguaauauaugcaucuga

SEQ ID NO: 131125 - RNA, 1701 nt, Artificial Sequence
  derived and/or modified sequence opt3 from hemagglutinin__InfluenzaA__AFM72131
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaagacuguacccugaucgaugcucuacugggggacccgcauugcgauggauuucagaauaaggagugggacuuguucguggaacgguccaaagccuauucuaacuguuaccccuaugaugucccugacuacgcaucgcuccgcucacugguggccagcaguggcacucuggaguuuauaaaugaagauuucaacuggaaugguguugcucaguccggggagucuuaugcaugcaagcgaggaagcgugaaguccuuuuucucacgucucaacugguuacacgagagugaauacaaauauccagcccugaaugucacaaugcccaacaauggcaaguuugacaaacuuuacaucuggggcgugcaucacccuagcaccgauagagagcaaacgaaguuguacguaagggcuucugggcggguuacuguguccaccaaacgcucacagcagacagucauuccaaacaucggaagcagacccugggugaggggucugaguucucggauuuccaucuauuggacuauagugaagccuggcgacauucuacucaucaauagcaccgggaaccugauugccccacgcggauacuucaagauccgaacaggcaaaucgucuaucaugagauccgacgcgccgauugguaccuguucaagugaaugcauaacgcccaacgggagcaucccuaaugauaagccauuucagaacgucaauaggauuacuuauggagcauguccccgguacguuaaacaaaacacacuuaagcuggccaccggcaugcguaaugugccugagaaacagacucgcggcaucuucggggcuauagccggauuuauugagaacgguugggaaggcaugguagacgggugguauggauucagacaccaaaauuccgagggcacaggucaggcagcugauuugaagucuacccaggccgcgaucgaccagaucaacgggaaacucaauaggcugauugaaaagacgaacgagaaguuucaucagaucgaaaaagaguucagcgagguggaaggccggauucaagauuuagagaaguacgucgaagacaccaaaauagaucuguggucauauaaugccgagcuccuuguggcacuggaaaaccagcacacaaucgacuugacugauagugagaugaauaagcuauucgagaaaacccgaaagcagcugcgcgaaaacgcugaggacaugggaaauggcugcuuuaagauuuaccauaaaugugauaacgccugcaucggguccaucagaaacggaacauacgaccacgacguuuauagggaugaagcucucaauaaccgguuccagauuaaggguguggagcugaaaagcggcuacaaggacuggauacuuuggaucucuuuugccauuucaugcuuccuguugugugucgugcuccugggguuuaucaugugggcaugccaaaaaggaaauauucgcuguaacaucugcauauga

SEQ ID NO: 131126 - RNA, 1701 nt, Artificial Sequence
  derived and/or modified sequence opt3 from hemagglutinin__InfluenzaA__AFM72142
augaagaccaucauugcccugagcuacauauccugccucguguucgcucagaaacuucccggcaacgacaauucuacagcaacucuguguuuggggcaccaugccgucccuaacggaacguuaguuaagaccaucacaaaugaucaaauugaggugacuaacgcgaccgaacugguacagucaaguagcacagguagaaucugcgacuccccacacaggauucuagauggcaaaaauuguacccucaucgacgcucugcuuggggauccgcauugcgacggauuucagaacaaggagugggaucuguucguggaacggucuaaagccuauucgaauuguuaccccuaugacgucccugauuacgcaucauugcgcagccucguggccaguuccggcacucuggaguuuauaaacgaagacuucaauuggacagguguugcucaggaugggggaucuuaugcaugcaagcgaggcagcgugaacuccuuuuucucacgucugaauuggcuccacaaguuagaguacaaauauccagcccugaacgucaccaugcccaauaacggcaaguuugacaaacuuuacaucuggggagugcaucacccuaguacggauagagaccaaacuagcuuguacguaagggcuucugggcggguuaccguguccacaaagcgcucacagcagacugucauuccaaauaucgguagcagacccugggugaggggccagaguucucggauuuccaucuauuggaccauagugaaaccuggggacauucugcuaaucaacagcacaggaaaccucauugccccacgcggcuacuucaagauccgaaaugguaagucgucuaucaugagauccgaugcgccgauugggaacuguucaagugagugcauaacccccaauggaagcaucccuaacgacaaaccauuucaaaaugucaacaggauuacguauggcgcauguccccgguacguuaagcagaauacucugaaacuugccacaggcaugcguaacgugccugaaaagcagacccgcgggaucuucggagcuauagccgguuuuauugagaauggcugggaagggaugguagauggaugguauggcuucagacaccagaacuccgaggguacugggcaagcagcugaccugaaaucuacacaggccgcgaucgaucagaucaauggcaaguugaacaggcucauugagaaaaccaaugaaaaguuucaucaaaucgagaaggaguucagcgaaguggaaggacggauucaggaccuggagaaauacgucgaggauacgaagauagacuuauggucauauaacgccgaacugcucguggcacuugagaaucagcacaccaucgaucugacagacagugaaaugaacaaauuguucgagcgaacucgcaagcagcuaagagaaaacgcugaggauaugggcaaugggugcuuuaaaauuuaccauaagugugacaacgccugcaucggauccaucaggaaugguaccuacgaccacgauguuuaucgggacgaggcucugaacaaucgcuuccaaauuaagggcguggaacucaaaagcggguacaaggauuggauacuguggaucucuuuugccauuucaugcuuccuucugugugucguguugcucggauuuaucaugugggcaugccagaaaggcaacauuagauguaauaucugcauauga

SEQ ID NO: 131127 - RNA, 1701 nt, Artificial Sequence
  derived and/or modified sequence opt3 from hemagglutinin__InfluenzaA__AFM72153
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcggcagcccacacaggauucucgacgggaaaaauuguacccugaucgaugcucuacugggagacccgcauugcgauggcuuucagaacaaggagugggacuuguucguggaacgguccaaagccuauucuaauuguuaccccuaugaugucccugacuacgcaucgcuccgcucacugguggccagcagugguacucuggaguuuauaaacgaagauuucaauuggacagggguugcucaggacggaggcuccuaugcaugcaagcgaggcucugugaacagcuuuuucucccgucucaauugguuacacaagcuggaguacaaauauccagcccuuaacgucaccaugcccaauaacgggaaguuugauaaauuguacaucuggggagugcaucacccuucaacggacagugaucaaacuagccuguacguaagagcuucugguaggguuaccguguccacaaagcggucacagcagacugucaccccaaauauuggcagccgccccugggugagagggcagaguucuaggaucggaauuuauuggacaaucgugaaaccuggcgacauacuacucauuaacuccaccgguaaccugaucgccccacggggguacuucaagauucgcaauggaaagagcucgaucaugcgaucugacgcgccgaucggcaacuguuccucagagugcauuacgcccaauggcaguauaccuaacgauaaaccauuucaaaaugucaacagaaucacuuauggggcaugucccagguacguuaagcagaauacacuuaaacuggccaccggaaugcggaacgugccugaaaagcagacucgugguauuuucggcgcuaucgccggguuuauagagaauggaugggaaggcaugguagacgguugguauggguuccgccaccagaacagcgagggcacaggacaagcagcugauuugaaauccacccaggccgcgauugaccagaucaauggcaagcucaacagacugaucgagaaaacgaaugaaaaguuucaucaaauugagaaggaguucucugaaguggaagggaggauccaggauuuagagaaauacgucgaggacaccaagauugaucuguggagcuauaacgccgaacuccuuguggcacuggagaaucagcacacaauagacuugacugauucagaaaugaacaaacuauucgagaagacccggaaacagcugcgagaaaacgcugaggacaugggaaaugguugcuuuaagaucuaccauaagugugauaacgccugcauuggcaguauccgcaaugggacauacgaccacgacguuuauagagaugaggcucucaacaauagguuccaaaucaaaggaguggaacugaaguccggcuacaaagacuggauucuuuggaucagcuuugccauaucuugcuuccuguugugugucgugcuccuggguuuuauuaugugggcaugccagaaggggaacauccgguguaauauuugcaucuga

SEQ ID NO: 131128 - RNA, 1701 nt, Artificial Sequence
  derived and/or modified sequence opt3 from hemagglutinin__InfluenzaA__AFM72164
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgagcuaguacagucuucaccaacagguagaaucugcgacaguccgcacaggauucucgauggcaaaaauuguacccugaucgacgcuuugcugggggauccccauugcgacggauuucagaacaaggaaugggauuuguucguggaacggagcaaagccuauuccaauuguuacccuuaugacgucccagauuacgcaucucuccgcucgcugguggccucaagcggcacucuggaguuuauaaacgaaaauuucaacuggacagguguugcucaggacgggaagaguuaugcaugcaagcgaggauccgugaauaguuucuucagccgucucaacugguuacacaaacuggaguacaaguaucccgcccuuaaugucaccaugccuaacaauggcaaauuugauaaguuguacaucuggggcgugcaucacccauccacggacucagaucaaacuucucuguacguaagagcuagcgggaggguuaccgugucuacaaaacggucccagcagacugucauucccgacaucggauaucgcccuugggugagaggucagucaagcaggauuaguauccacuggaccauagugaagccaggcgacauucuacucaucaacucuacagggaaccugauugccccgcggggauacuucaagauccgcaauggcaaauccagcaucaugcgaucggaugcgcccauugguaacuguucuuccgagugcauaaccccuaaugggucaaucccaaacgacaagcccuuucaaaaugucaacagaauuacguauggagcauguccuagguacguuaaacagaauacucuuaagcuggccacaggcaugcggaacgugccagaaaaacagacccguggcaucuucggggcuauagccggauuuauugagaaugguugggaaggcaugguagaugggugguauggauuccgccaucagaacagugagggcacuggucaagcagcugaccuuaagagcacacaggccgcgaucgaucagaucaaugggaaacucaacagacugguggagaagaccaaugaaaaguuucaccaaauugagaaagaauuuuccgaggucgaaggcaggauccaggacuuagagaaguacguggaggauacgaaaauugaccuguggucuuauaacgccgaacuccuuguugcacuggagaaucagcauaccauagauuugacagacagcgaaaugaacaagcuauucgagcggacucgaaaacagcugcgcgaaaacgcugaggauaugggaaauggcugcuuuaagaucuaccacaagugugacaacgccugcauugggucaaucagaaauggaaccuacgaccacgauguguauagggacgaggcucucaacaaucgguuccaaaucaaaggugucgaacugaagaguggcuacaaagauuggauucuuuggauauccuuugccaucagcugcuuccuguugugugugguacuccugggguuuauuaugugggcaugccagaagggaaacauccgcuguaauauuugcaucuga

SEQ ID NO: 131129 - RNA, 1701 nt, Artificial Sequence
  derived and/or modified sequence opt3 from hemagglutinin__InfluenzaA__AFM72175
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaccaacagguagaaucugcgacaguccgcacaggauucucgauggcaaaaauuguacccugaucgacgcucuacugggggauccccauugcgacggauuucagaacaaggagugggauuuguucguggaacggagcaaagccuauuccaauuguuacccuuaugacgucccagauuacgcaucucuccgcucgcugguggccucaagcggcacucuggaguuuauaaacgaaaauuucaacuggacagguguugcucaggacgggaagaguuaugcaugcaagcgaggauccgugaauagcuuuuucucucgucucaacugguuacacaaacuggaguacaaguaucccgcccuuaaugucaccaugccuaacaauggcaaauuugauaaguuguacaucuggggcgugcaucacccauccacggacucagaucaaacuaaccuguacguaagagcuagugggaggguuaccgugagcacaaaacggucucagcagacugucauucccgacaucggauaucgcccuugggugagaggucaguccucaaggauuagcauccacuggaccauagugaagccaggcgacauucuacucaucaacaguacagggaaucugauugccccgcggggauacuucaagauccgcaacggcaaaucuuccaucaugcgaagcgaugcgcccauugguaauuguucgucugagugcauaaccccuaacggguccaucccaaaugacaagcccuuucaaaacgucaauagaauuacguauggagcauguccuagguacguuaaacagaacacucuuaagcuggccacaggcaugcggaaugugccagaaaaacagacccguggcaucuucggggcuauagccggauuuauugagaacgguugggaaggcaugguagaugggugguauggauuccgccaucaaaauucagagggcacuggucaggcagcugacuugaagaguacacaggccgcgaucgaucagaucaacgggaaacucaauagacugguggagaagaccaacgaaaaguuucaccaaauugagaaagaguucagcgaagucgaaggcaggauccaggacuuagagaaguacguggaggauacgaaaauugaccugugguccuauaaugccgaacuccuuguugcacuggagaaccagcauaccauagauuugacagacucugaaaugaacaagcuauucgagcggacucgaaaacagcugcgcgaaaaugcugaggauaugggaaacggcugcuuuaagaucuaccacaagugugacaaugccugcauugggagcaucagaaacggaaccuacgaccacgauguguauagggacgaggcucucaauaaccgguuccaaaucaaaggugucgaacugaagucaggcuacaaagauuggauucuuuggauaaguuuugccaucuccugcuuccuguugugugugguacuccugggguuuauuaugugggcaugccagaagggaaauauccgcuguaacauuugcaucuga

SEQ ID NO: 131130 - RNA, 1701 nt, Artificial Sequence
  derived and/or modified sequence opt3 from hemagglutinin__InfluenzaA__AFM72197
augaagaccaucauugcccugagcuacauacucugcaugguguucgcucagaaacuucccggcaacgacaauuccacagcaacucuguguuuggggcaccaugccgucccuaacggaacguuaguuaagaccaucacaaaugaucaaauugaggugacuaacgcgaccgaacugguacagucuucaaguacagguagaaucugcgacagcccacacaggauucuagauggcaaaaauuguacccucaucgacgcucugcuuggggauccgcauugcgacggauuucagaacaaggagugggaucuguucguggaacgguccaaagccuauucuaauuguuaccccuaugacgucccugauuacgcaucguugcgcucacucguggccagcaguggcacucuggaguuuaacaaugaauccuucaacuggacagguguugcucagaaugggaccucuuaugcaugcaagcgacguagcgugaaguccuuuuucucaagacugaacuggcuccacaaauuagaguacaaguauccagcccugaaugucacgaugcccaacaaugacaaauuugauaaacuuuacauauggggagugcaucacccuaucacugacagugagcaaaccagcuuguacguacaggcuucuggcaggguuacaguguccacuaagcggucacagcagaccgucauuccaaacaucggcuaucgccccugggugagaggggugagcaguaggauuucuaucuacuggacaauagucaagccuggagauauucugcuaaucaacuccaccgguaaucucauugccccacggggcuauuucaagauccgcagcgggaaaucgucuaucaugcgauccgacgcgccgauuggaaacuguaauucagaaugcauaacgcccaacggcaguaucccuaaugacaagccauuucaaaacguuaauagaauuacuuacggugcaugucccagguaugugaaacagaacacacugaaacuugccaccgggaugcggaauguaccugagaagcagacucguggaaucuucggcgcuauagccggcuuuauugaaaacgggugggagggaaugguggaugguugguacggcuuccgccaccagaauagcgaggggacaggacaagcagcugaccugaaguccacccaggccgcgaucaaccagaucaauggcaaauugaacagacucauugaaaagacgaaugagaaguuucaucaaaucgaaaaagaguucucugaagucgaggguaggauucaggaucuggagaaguauguggaagacaccaaaauagauuuauggagcuacaacgccgagcugcucguugcacuugaaaaccagcacacaaucgaccugacugauucagagaugaauaaguuguucgaacggacccgaaaacagcuacgcgagaacgcugaggacauggggaauggcugcuuuaagauuuaccauaagugugauaacgccugcaucggaaguaucagaaauggcacauaugaccacgauguguacagggacgaagcucugaacaaucgguuccaaauuaaaggggucgagcucaaguccggauauaaagacuggauacuguggaucagcuuugccauuucuugcuuccuucugugugugguauugcucgguuuuaucaugugggcaugccagaagggcaacauuaaauguaauaucugcauauga

SEQ ID NO: 131131 - RNA, 1701 nt, Artificial Sequence
  derived and/or modified sequence opt3 from hemagglutinin__InfluenzaA__AFM72208
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccauaaacucauuuuucagucgucucaauugguuacaccagcugaaguauagauacccagcccuuaacgugacgaugcccaauaacgacaaguuugauaaauuguauaucuggggaguccaucacccuagcacugacucugaucagaccucccuguacacacaggcuucaggcagggugacuguaagcaccaagcggagucaacagacaguuauuccaaacaucggcucucgccccugggugagagggauuuccagcaggaucucgauauacuggaccauugucaaaccuggagacauccuacucauuaauucuacggguaaccugaucgccccacggggcuauuucaagauccgcuccgggaaaucaaguauuaugcgaagcgacgcgccgauaggaaaguguaauuccgagugcaucacucccaacggcucuauuccuaaugauaagccauuucagaacgugaauagaaucacauacggugcaugucccagguaugugaaacagaacacccuuaagcuggccacugggaugcggaaugucccugaaaaacaaacacguggaauauucggcgcuauugccggcuuuaucgagaacgggugggaaggaaugauggacgguugguacggcuuccgccaccagaauagcgaggggaccggacaggcagcugauuugaagucaacgcaagccgcgaucaaccagauuaauggcaaacucaacagacugaucgagaagaccaaugaaaaauuucaucagauugagaaggaguucagugaaguugaagguaggauacaggacuuagagaaguauguggaggauacaaaaaucgaccugugguccuacaacgccgaacuccuuguagcacuggagaaccaacacacuauugauuugaccgacagcgaaaugaauaagcuauucgagcggacacgaaaacagcugcgcgaaaacgcugaggauauggggaauggcugcuuuaagaucuaucauaaaugugacaacgccugcaucggaucuauuagaaauggcacuuacgaucacgacguguacagggacgaggcucucaacaaucgguuccagauaaagggggucgaacugaagucaggauauaaagauuggauccuuuggauuaguuuugccaucagcugcuuccuguugugugugguucuccuggguuuuauuaugugggcaugccagaagggcaacauccgcuguaauauaugcaucuga

SEQ ID NO: 131132 - RNA, 1701 nt, Artificial Sequence
  derived and/or modified sequence opt3 from hemagglutinin__InfluenzaA__AFM72219
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacaccagauucucgauggcgagaauuguacccugaucgacgcucuacugggggauccgcauugcgacggauuucagaacaaagaaugggauuuguucguggagagguccaaggccuauucuaauuguuaccccuaugacgucccugauuacgcaucgcuccggucacugguggccagcaguggcacucuggaauuuaacaaugaguccuucaacuggacagguguugcucaaaaugggaccucuagcgcaugcaaacgccgauccauaaacucauuuuucagucgucucaauugguuacaccagcugaaguauagauacccagcccuuaacgugacgaugcccaauaacgacaaguuugauaaauuguauaucuggggaguccaucacccuagcacugacucugaucagaccucccuguacacacaggcuucaggcagggugacuguaagcaccaagcggagucaacagacaguuauuccaaacaucggcucucgccccugggugagagggauuuccagcaggaucucgauauacuggaccauugucaaaccuggagacauccuacucauuaagucuacggguaaucugaucgccccacggggcuauuucaaaauccgcuccgggaagucaaguauuaugcgaagcgacgcgccgauaggaaaguguaacuccgagugcaucacucccaauggcucuauuccuaacgauaaaccauuucagaaugugaacagaaucacauacggugcaugucccagguaugugaagcagaauacccuuaaacuggccacugggaugcggaacgucccugaaaagcaaacacguggaauauucggcgcuauugccggcuuuaucgagaaugggugggaaggaaugauggacgguugguacggcuuccgccaccagaacagcgaggggaccggacaggcagcugauuugaaaucaacgcaagccgcgaucaaucagauuaacggcaagcucaauagacugaucgagaaaaccaacgaaaaguuucaucagauugagaaggaguucagugaaguugaagguaggauacaggacuuagagaaauauguggaggauacaaagaucgaccugugguccuacaaugccgaacuccuuguagcacuggagaaccaacacacuauugauuugaccgacagcgaaaugaacaaacuauucgagcggacacgaaagcagcugcgcgaaaaugcugaggauauggggaacggcugcuuuaaaaucuaucauaagugugacaaugccugcaucggaucuauuagaaacggcacuuacgaucacgacguguacagggacgaggcucucaauaaccgguuccagauaaagggggucgaacugaaaucaggauauaaggauuggauccuuuggauuaguuuugccaucagcugcuuccuguugugugugguucuccuggguuuuauuaugugggcaugccagaaaggcaauauccgcuguaacauaugcaucuga

SEQ ID NO: 131133 - RNA, 1698 nt, Artificial Sequence
  derived and/or modified sequence opt3 from hemagglutinin__InfluenzaA__AFM72230
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaaaagagcugguccuacaucguggagaccccaaauccggaaaacggaacuuguuaucccggcuacuuugccgacuaugaggagcugagagaacaacucucuucgguuucaucuuucgagagguuugaaauuuucccuaaggagaguuccuggccaaaucauacagugaccggugucucugcaagcugcucccacaacgggaaaucaaguuuuuaccggaauuuacuguggcuuacgggaaagaacggcuuguaucccaaucugagcaaaucuuacgugaacaauaaggagaaagaaguacuuguucucuggggcgugcaucacccuccaaacaucgggaaccagcgcgcccuguaccacacugagaaugcuuaugucuccguggugucaagccauuacagucgacguuucacccccgaaauagcaaagagaccuaaggucagggaucaggagggacggaucaacuauuacuggacacuucuggaaccaggugacacuauuaucuuugaggccaauggcaacuugauugcuccgugguaugccuucgcgcucucucgcggguuuggauccggcaucauaaccagcaaugcacccauggaugagugugacgccaaaugccagacaccucaaggugcuauuaacucgucucugccauuccagaauguucaccccgugaccaucggggaauguccuaaguacguaagauccgccaaauuaaggauggugacgggacugcggaacauuccaucaauccagagucgcggccucuuuggcgcaaucgcuggguucauugagggagguuggacuggcauggucgaugggugguauggauaccaucaccagaaugaacaaggcagcgguuacgccgcggaccagaaguccacacagaacgccauaaaugggaucaccaacaaagugaauagcguuauugagaagaugaacacucaguuuacagcagugggcaaagaguucaauaagcuagaacgaagaauggagaaccugaacaagaaagucgaugacggauucuuggauaucuggaccuauaaugcugaacuacuggugcuccuggagaacgaaaggacgcuugacuuucacgacagcaauguaaagaaccuguacgagaaaguuaagucacaauugaaaaauaacgccaaggaaauaggcaaugggugcuucgaguuuuaucauaaguguaacaaugagugcauggaaagugugaaaaacggaaccuacgauuaucccaaguacuccgaggaaagcaaacucaaucgggagaagauugacggugucaaacuggagucuaugggcguguaucagaucuuagcuaucuacucaacagucgccaguagccuggugcuacucguuucccugggggcaauuucuuucuggaugugcucgaacggaagccuucagugucguaucugcauuuga

SEQ ID NO: 131134 - RNA, 1701 nt, Artificial Sequence
  derived and/or modified sequence opt3 from hemagglutinin__InfluenzaA__AFM72246
augaagaccaucauugcccugagcuacauacucugccuuguguucgcucagaaacugcccggcaacgacaauuccacagcaacuuuguguuuagggcaccaugccgucucuaacggaacgcugguuaagaccaucacaaaugaucaaauugaggugacuaacgcgaccgaacuuguacagucaaguagcacagguagaaucugcgacuccccucaccagauucucgauggcgagaauuguacccugaucgacgcccuucugggggauccacauugcgacggauuucagaacaaagaaugggauuuguucguggagaggucuaaggcuuauucgaauuguuacccguaugacguccccgauuacgcaucacuccggagccugguggccaguuccggcacucuggaauuuaacaaugagucuuucaacuggacagguguugcucaaaaugggaccagcuccgcaugcaaacgccgaucaaacaagagcuuuuucagccgucucaauugguuacaccagcugaaguauaaauacccugcccuuaacgugacgaugccaaauaacgagaaguuugacaaauuguauauauggggaguccaucaccccucuacugauuccgaccagaucucaauuuacgcucaggccagcggcagagugaccguaaguacaaagaggucucaacagacuguuaucccuaacauuggcuccagcccaugggugcgcggggucucgucucggaucuccauauacuggaccauugugaaacccggagauauccugcuaauuaauucaacagguaaccucaucgcgccuagaggcuauuucaagaucaggagugggaagaguuccauuaugcggucugacgcaccaauaggaaaauguaauagcgaaugcaucaccccgaacggcucaauucccaaugacaagccuuuucagaacgugaaucgcaucacguacggugccuguccacgauaugucaaacagaacacucugaagcuagcuacagggaugagaaauguucccgagaaacaaaccaggggaauauucggcgccauugcaggcuuuaucgaaaacgggugggagggaaugguggaugguugguacggcuuccggcaccagaauagugaggggacuggacaggcugccgaccugaaguccacacaagcggccaucaaccagauuaauggcaaauugaaccgucucaucgaaaagaccaaugagaaguuucaucagauugaaaaagaguucagcgaaguagagggucgcauacaggaucuggagaaguauguggaagacacgaaaaucgauuuauggucuuacaacgcagagcugcucgucgcucuugaaaaccaacacaccauugaccugacagauucagagaugaauaaguuguucgaaagaacuaaaaagcagcuaagggagaacgccgaggacauggggaauggcugcuuuaagaucuaucauaaaugugauaacgcuugcaucggaaguauucggaauggcaccuacgaccacgauguguaccgagacgaagcccugaacaaucgcuuccagauaaaggggguugagcucaaaagcggauauaaggacuggauccuguggauuuccuuugcaaucucuugcuuccuucuguguguggucuugcucgguuuuauuaugugggccugccagaaaggcaacaucagauguaauauaugcaucuga

SEQ ID NO: 131135 - RNA, 1701 nt, Artificial Sequence
  derived and/or modified sequence opt3 from hemagglutinin__InfluenzaA__AFM72257
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcccuucugggcgauccgcacugcgacggguuucagaacaaagaaugggauuuguucgucgagagguccacugcuuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaauuauaaguacccagcccuuaacgucacuaugcccaauaacgagaaguuugacaaauuguauaucuggggagugcaccacccuagcaccgauucugaccagauuuccaucuacgcucaggccucagggagaguaacaguuagcacuaagaggagucagcaaaccgugauuccaaacaucggcucucggcccuggguccgcggcguguccagcgggauaucgauuuacuggacaaucgugaaaccuggagauauucugcuaaucaauucuaccgguaaccucaucgcgccaagaggcuauuucaagauuagguccgggaaaucaaguauaaugcggagcaaugcaccgaucggaaaguguaacuccgaaugcauuacgcccaauggcucuaucccuaacgacaagccauuucagaaugucaaccgcauaacuuacggugccuguccccgauauguuaaacagaauacacugaagcuagcuaccgggaugagaaacgugccugagaaacagacuaggggaauuuucggcgccaucgcaggcuuuaucgaaaaugggugggagggaaugguagacgguugguacggcuuccggcaucaaaacagcgaggggacaggacaggcugccgaucugaagucaacccaggcggccauuaaucaaaucaacggcaaauugaaucgucucauugaaaagacgaacgagaaauuucaccagauagaaaaggaguucagugaaguggagggucgcauccaggaccuggagaaguaugucgaagauaccaaaauugacuuaugguccuacaacgcagagcugcucguggcucuugaaaaucagcauacaaucgaucugacugacagcgagaugaacaaguuguucgaaagaaccaggaaacaacuacgggagaaugccgaggauauggggaacggcugcuuuaagaucuaucacaaaugugacaaugcuugcauuggaucuauacgaaacggcacauacgaucacgacguuuaccgcgaugaagcccugaauaacagauuccagaucaaggggguggagcucaagucaggauauaaagacuggauucuguggaucaguuuugcaauuagcugcuuccuucugugugucguguugcucgguuuuaucaugugggccugccagaagggcaauauaagguguaacaucugcauuuga

SEQ ID NO: 131136 - RNA, 1701 nt, Artificial Sequence
  derived and/or modified sequence opt3 from hemagglutinin__InfluenzaA__AFM72268
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuggugcaaucuucaaguacaggaagaaucugcgacagcccacaucagauucucgauggugagaauuguacccugaucgacgcccuucugggcgauccgcacugcgacggguuucagaacaaagaaugggauuuguucgucgagagguccacugcuuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaauuauaaguacccagcccuuaacgucacuaugcccaauaacgagaaguuugacaaauuguauaucuggggagugcaccacccuaacaccgauagcgaccagauuucuaucuacgcucaggccuccgggagaguaacaguuucaacuaagaggagccagcaaaccgugauuccaaauaucggcagucggcccuggguccgcggcgugucuuccgggauaagcauuuacuggacaaucgugaaaccuggagauauucugcuaaucaacucgaccgguaaucucaucgcgccaagaggcuauuucaagauuaggucugggaaauccucaauaaugcggaguaacgcaccgaucggaaaguguaauagcgaaugcauuacgcccaacggcuccaucccuaaugacaagccauuucagaacgucaaucgcauaacuuacggugccuguccccgauauguuaaacagaacacacugaaacuugcuaccgggaugagaaaugugccugagaagcagacuaggggaauuuucggcgccaucgcaggcuuuaucgaaaacgggugggagggaaugguagacgguugguacggcuuccggcaucaaaauucugaggggacaggacaggcugccgaucuaaagagcacccaggcggccauuaaccaaaucaauggcaaauugaaccgucucauugaaaagacgaacgagaaauuucaccagauagaaaaggaguucucagaaguggagggucgcauccaggaccuggagaaguaugucgaagauaccaaaauugacuuauggaguuacaaugcagagcugcucguggcucuugaaaaccagcauacaaucgaucugacugacuccgagaugaauaaguuguucgaaagaaccaggaaacaacuacgggagaacgccgaggauauggggaauggcugcuuuaagaucuaucacaaaugugacaacgcuugcauuggaagcauacgaaauggcacauacgaucacgacguuuaccgcgaugaagcccugaacaauagauuccagaucaaggggguggagcucaagucuggauauaaagacuggauucuguggaucucauuugcaauuaguugcuuccuucugugugucguguugcucgguuuuaucaugugggccugccagaagggcaacauaagguguaauaucugcauuuga

SEQ ID NO: 131137 - RNA, 1701 nt, Artificial Sequence
  derived and/or modified sequence opt3 from hemagglutinin__InfluenzaA__AFM72279
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcccuucugggcgauccgcacugcgacggguuucagaacaaagaaugggauuuguucgucgagagguccacugcuuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaguauaaguacccagcccuuaaugucacuaugcccaacaaugagaaauuugacaaguuguauaucuggggagugcaccacccuagcaccgauucugaccagauuuccaucuacgcucaggccucagggagaguaacaguuagcacuaaaaggagucagcaaaccgugauuccaaacaucggcucuaagcauuggguccggggcguguccagccgcauaucgauuuacuggacaaucgugaaacccggggauauucugcuaaucaacucuaccggaaaucucaucgcgccuagagguuauuucaagauuagguccggcaagucaaguauaaugcggagcaacgcaccaaucgggaaauguaauuccgaaugcauuacgccgaacggaucuauccccaaugacaagccuuuucagaacgucaaucgcauaacuuacggcgccuguccacgauauguuaaacagaacacacugaagcuagcuaccgguaugagaaaugugcccgagaaacagacuagggggauuuucggagccaucgcaggcuuuaucgaaaacggcugggaggggaugguagacggaugguacgguuuccggcaccaaaauagcgagggcacagggcaggcugccgaucugaagucaacccaggcggccauuaaccaaaucaauggaaaauugaaccgucucauugaaaagacgaaugagaaguuucaucagauagaaaaagaguucagugaaguggagggccgcauccaggaccuggagaaguaugucgaagauaccaaaauugacuuaugguccuacaacgcagagcugcucguggcucuugaaaaccagcacacaaucgaucugacugacagcgagaugaauaaguuguucgaaagaaccaggaaacaacuacgggagaacgccgaggauauggguaaugggugcuuuaagaucuaucacaagugugacaacgcuugcauuggcucuauacgaaauggaacauacgaucaugacguuuaccgcgaugaagcccugaacaauagauuccagaucaaaggcguggagcucaagucaggguauaaagacuggauucuguggaucaguuuugcaauuagcugcuuccuucugugugucguguugcucggauuuaucaugugggccugccagaaggguaacauaagguguaauaucugcauuuga

SEQ ID NO: 131138 - RNA, 1701 nt, Artificial Sequence
  derived and/or modified sequence opt3 from hemagglutinin__InfluenzaA__AFM72290
augaagaccaucauugcccugagcuacauacucugccuuguguucgcucagaaacugcccgucaacgacaauuccacagcaacuuuguguuuaggccaccaugccguuccuaacgggacgcuggugaagaccaucacaaaugaucacauugagguaacuaacgcgaccgaacuugugcaaucuucaaguacaggaagaaucugcgacagcccacaucagauucucgauggugagaauuguacccugaucgacgcccuucugggcgauccgcacugcgacggguuucagaacaaagaaugggauuuguucgucgagagguccacugcuuauucuaauuguuaccccuaugacgugccugauuacgcaucgcuccggucacugguugccagcaguggaacacuggaauuuaacaaugaguccuucaacuggaccggcguggcucagaaugguacgucuagcgcaugcaagcgccgauccauaaaaucauuuuucagucgucucaacugguuacaucaacugaaggacaaguauccagcccuuaaugucacuaugcccaacaaugagaaauuugauaaguuguacaucuggggagugcaccacccuagcaccgacucugaucagauuuccaucuaugcucaggccucagggagaguaacaguuagcacuaaaaggagucagcaaaccgugauuccaaacaucggcucuaagcauuggguccggggcguguccagccgcauaucgauuuacuggacaaucgugaaacccggggacauucugcuaaucaacucuaccggaaaucucaucgcgccuagagguuacuucaagauuagguccggcaagucaaguauaaugcggagcaacgcaccaaucgggaaauguaauuccgaaugcauuacgccgaacggaucuauccccaaugacaagccuuuucagaacgucaaucgcauaacuuauggcgccuguccacgauacguuaaacagaacacacugaagcuagcuaccgguaugagaaaugugcccgagaaacagacuagggggauuuucggagccaucgcaggcuuuaucgaaaacggcugggaggggaugguagauggaugguaugguuuccggcaccaaaauagcgagggcacagggcaggcugccgaccugaagucaacccaggcggccauuaaccaaaucaauggaaaauugaaccgucucauugaaaagacgaaugagaaguuucaucagauagaaaaagaguucagugaaguggagggccgcauccaggaucuggagaaguacgucgaagacaccaaaauugauuuaugguccuauaacgcagagcugcucguggcucuugaaaaccagcacacaaucgaccugacugauagcgagaugaauaaguuguucgaaagaaccaggaaacaacuacgggagaacgccgaggacauggguaaugggugcuuuaagaucuaccacaagugugauaacgcuugcauuggcucuauacgaaauggaacauaugaccaugauguuuaccgcgacgaagcccugaacaauagauuccagaucaaaggcguggagcucaagucaggguacaaagacuggauucuguggaucaguuuugcaauuagcugcuuccuucugugugucguguugcucggauuuaucaugugggccugccagaaggguaacauaagguguaauaucugcauuuga

SEQ ID NO: 131139 - RNA, 1701 nt, Artificial Sequence
  derived and/or modified sequence opt3 from hemagglutinin__InfluenzaA__AFM72301
augaagaccaucauugcccugagcuacauacucugccuuguguucucccagaaacugcccggcaacgacaauucuacagcuacuuuguguuuagggcaccaugcagucccuaacggaacgaucguuaagaccauuacaaaugaucaaaucgaggugacuaacgccaccgaacugguacagucaaguagcacagguggcauuugcgacuccccacaccagauccuagauggggagaauuguacccucauagacgcgcugcuuggagauccgcagugcgacggcuuucaaaacaaaaagugggaucuguucguggaaagaucuaaggcuuauucgaauuguuaccccuaugacgucccugauuacgccucauugaggagccucguggcaaguuccgguacucuggaguuuaacaaugaaucuuucaacugggccgggguuacacagaauggaaccagcuccgcuugcaagcggcgcucaaacaagagcuuuuucagucgacugaauuggcucacgcaguuaaaauauaaguacccagcacugaacgugacuaugcccaauaacgagaaauuugacaaacuuuauaucuggggcguccaucacccugugaccgauucugaccagauuuccuuguacgcccaggcuucaggccguaucacaguaagcacuaaaagaagucagcagaccguuauuccaaacaucggguacaggccccgggugcgcgauauaucuuccagaauuagcaucuauuggacaauugucaagccuggagacauccugcuaaucaauucgaccgguaaccucauugccccaaggggcuacuucaagauacggucugggaaauccucaaucaugcgcagugacgcgccgauuggaaaguguaauagcgagugcaucacgcccaacggcuccauaccuaaugauaaaccauuucagaacgugaaucgaauuacuuauggugcaugucccagauacgugaagcaaaacacacugaaacuugccaccgggaugaggaaugucccugaaaagcagacucggggaaucuucggcgcuaucgccggcuuuauugagaacgggugggaaggaaugguugacgguugguauggcuuccgucaucaaaauucugaggggacaggacaagcagcugaucugaaaagcacccaggccgcgaucaaccagauuaauggcaaguugaaccgccucauagguaagacgaaugagaaauuucaccagaucgaaaaggaguucucagaaguggaggggaggauucaagaccuggaaaaauacguagaggauaccaagaucgacuuauggaguuauaacgccgagcugcucguggcacuugaaaaccagcacacaaucgaucugacugacuccgagaugaauaaauuguucgaaagaaccaagaagcagcuacgggagaacgcugaagauaugggcaauggaugcuuuaaaauuuaccauaagugugacaacgccugcauagagagcauccgaaauggcacauacgaucacgacgucuaucgcgacgaggcucugaacaauagauuccagauuaaagggguggaacucaagucuggauacaaagauuggauccuguggauuucauuugccaucaguugcuuccuucuguguguugcauugcucgguuuuauaaugugggccugccaaaagggcaacaucagguguaauauuugcaucuga

SEQ ID NO: 131140 - RNA, 1701 nt, Artificial Sequence
  derived and/or modified sequence opt3 from hemagglutinin__InfluenzaA__AFM72312
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauauaaguacccagcacugaacgugaccaugcccaauaacgagaaauuugacaaacuuuauaucuggggcguccaccauccugugacagauagcgaccagauuaacuuguacgcccaggcuucuggccguaucacuguauccaccaagagaucacaacagacaguuauuccaaauaucggguacaggccccgggugcgcgauauaccuagcagaauuaguaucuauuggaccauugucaagccaggagacauccugcuaaucaacucuacggguaaucucauugccccgaggggcuacuucaagauacgguccgggaaaagcucgaucaugcgcucugacgcgcccauuggaaaguguaacuccgagugcaucacuccuaauggcucaauaccaaacgauaaacccuuucagaaugugaaccgaauuacauauggugcauguccuagauacgugaagcagaauacccugaaacuugccacugggaugaggaacgucccagaaaagcaaacacggggaaucuucggcgcuaucgccggcuuuauugagaaugggugggaaggaaugguugacgguugguauggcuuccgucaccagaacagugaggggaccggacaggcagcugaucugaaaagcacgcaagccgcgaucaaucagauuaacggcaaguugaaucgccucauagguaagaccaacgagaaauuucaccagaucgaaaaggaguucuccgaaguggaggggaggauucaggaccuggaaaaauacguagaggauacaaagaucgacuuauggucuuauaacgccgagcugcucguggcacuugaaaaucaacauacuaucgaucugaccgacagcgagaugaacaaauuguucgaaagaacaaagaagcagcuacgggagaaugcugaagauaugggcaacggaugcuuuaaaauuuaccacaagugugacaaugccugcauaggcucaauccgaaacgggacuuacgaucaugacgucuaucgcgacgaggcucugaauaacagauuccagauuaaaggaguggagcucaagagugguuacaaagauuggauccuguggauuuccuuugccaucagcugcuuccuucuguguguugcauugcucggcuuuauaaugugggccugccagaaggggaauaucagguguaacauuugcaucuga

SEQ ID NO: 131141 - RNA, 1701 nt, Artificial Sequence
  derived and/or modified sequence opt3 from hemagglutinin__InfluenzaA__AFM72323
augaaggccaucauugcucugagcuacauacucugccuuguguucgcacagaaacugcccggcaacgacaauuccaccgccacauuguguuuagggcaccaugcggucccuaacggaacuaucguuaagacgauuaccaaugaucaaaucgaggugacaaacgcuacugaacugguacagucuucaaguaccgguggcauuugcgacagcccacaccagauccuagauggggagaauuguacacucauagacgcccugcuuggagauccgcagugcgacggcuuucaaaacaaaaagugggaucuguucguggaaagauccaaagcauauucuaauuguuaccccuaugacgucccugauuacgccucguugaggucacucguggcuagcagugguacccuggaguuuaacaaugaauccuucaacuggacugggguuacacagaauggaaccucuagcgcaugcaagcggcgcuccaacaagucauuuuucagucgacugaauuggcucacgcauuuaaaauauaaguacccagcccugaacgugacuaugcccaauaacgagaaauuugacaaacuuuauaucuggggcguccaccauccugugaccgauagcgaccagauuaacuuguacgcucaggccucuggccguaucacaguauccacuaagagaucacaacagaccguuauuccaaauaucggguacaggccccgggugcgcgauaacccuagcagaauaaguauuuauuggacaaucgucaagccaggagacauucugcuaaucaauucuaccgguaaccucaucgcgccgaggggcuacuucaagauucgguccgggaaaagcucgauaaugcgcucugacgcacccaucggaaaguguaauuccgagugcauuacgccuaacggcucaaucccaaaugauaaacccuuucagaacgugaaucgaauaacuuauggugccuguccuagauacgugaagcagaacacacugaaacuugcuaccgggaugaggaaugucccagaaaagcaaacucggggaauuuucggcgccaucgcaggcuuuaucgagaacgggugggaaggaaugguugacgguugguauggcuuccgucaccagaauagugaggggacaggacaggcugccgaucugaaaagcacccaagcggccauuaaccagaucaauggcaaguugaaccgccucauugguaagacgaacgagaaauuucaccagauagaaaaggaguucuccgaaguggaggggagaauccaggaccuggaaaaauacguagaggauaccaagauugacuuauggucuuauaaugcagagcugcucguggcucuugaaaaccaacauacaaucgaucugacugacagcgagaugaauaaauuguucgaaaggaccaagaagcagcuacgggagaacgccgaagauaugggcaauggaugcuuuaaaaucuaccacaagugugacaacgcuugcauuggcucaauacgaaaugggacauacgaucaugacgucuaucgcgacgaggcccugaacaauagauuccagaucaaaggaguggagcucaagagugguuacaaagauuggauucuguggaucuccuuugcaauuagcugcuuccuucuguguguugccuugcucggcuuuaucaugugggcuugccagaaggggaacauaagguguaauaucugcauuuga

SEQ ID NO: 131142 - RNA, 1701 nt, Artificial Sequence
  derived and/or modified sequence opt3 from hemagglutinin__InfluenzaA__AFM72334
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggagucuugcauccuggcacauacaaagaccagaucuuucuguaugcccaagcuagcggccguauuacugugucuaccaagagaucccagcaggccguaaucccaaauauagggucaaggccccggguucgcaacauuccuagcagagugaguaucuacuggacaauugucaaaccaggagauauccuacucaucaauucuaccgguaaccugauugcgccgaggggcuacuucaagauacgguccgggaaaagcucgaucaugcgcucugacgcacccauuggaaaguguaauuccgccugcaucacgccuaacggcucaauaccaaaugauaagcccuuucagaacgugaaucgaauuacuuauggugcuuguccuagauacgugaaacaaaacacacuuaagcuggccaccgggaugaggaaugucccagaaaaacagacucggggaaucuucggcgcaaucgcuggcuuuauugagaacgggugggaaggaaugguugacgguugguauggcuuccgucaccagaauagugaggggcgcggacaagccgcggaccucaagagcacacaggccgcaaucgaucagauuaacggcaaauugaacagacugauagguaagaccaaugagaaauuccaccagaucgaaaaggaguuuuccgaaguggaggggaggauucaagacuuagaaaaguacguagaggauacgaaaaucgaccuguggucuuauaacgcugagcuccuuguggcccuggaaaaucagcauaccaucgauuugacagacagcgagaugaacaagcuauucgaaaagacuaagaaacagcugcgggagaaugcugaagauaugggcaacggaugcuuuaagauuuaccacaagugugacaaugccugcauaggcucaauccgaaacgggaccuaugaucaugacgucuaccgcgaugaggcacucaauaacagauuccagauuaaaggaguggagcugaagagugguuacaaagacuggauccuuuggauuuccuuugccaucagcugcuuccuguuguguguugcucuccugggcuuuauaaugugggcgugccaaaaggggaauaucagguguaacauuugcaucuga

SEQ ID NO: 131143 - RNA, 1701 nt, Artificial Sequence
  derived and/or modified sequence opt3 from hemagglutinin__InfluenzaA__AFM72345
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucgacuggacagggguuacccagaacggaacgucuagcgcuugcaagcggcgcuccaauaagucauuuuucagucgacugaacuggcucacucauuuaaaauauaaguacccagcacugaaugugaccaugcccaacaaugagaaauuugauaaacuuuauaucuggggcguccaccauccugugacagacagcgaucagauuucuuuguacacucaggccuccggccguaucaccguaucaacaaagagaagccaacagaccguuauuccaaacaucggguucaggccccgggugcgcgacauaaguucuagaauuuccaucuacuggacgauugucaagccuggagacauccugcuaaucaacagcacugguaaucucauugcuccaaggggcuauuuuaagauacggucggggaaaucuuccaucaugcgcucagaugccccgauuggaaaguguaacagugagugcaucacacccaauggcagcauaccuaacgacaaaccauuccagaaugugaaccgaauuaccuacggugcgugucccagauaugugaagcagaauacucugaaacuugcaacagggaugaggaacgucccugaaaagcaaacccggggaaucuuuggcgccaucgcuggcuucauugagaaugggugggaaggaaugguugaugguugguacggcuuucgucaccagaacuccgaggggacgggacaggccgcagaccugaaaucuacccaagcugccaucaaucagauuaacggcaaguugaaucgccucauagguaagacaaacgagaaauuccaccagaucgaaaaggaguucagcgaaguggaggggaggauucaggaucuggaaaaauauguagaggacacuaagaucgauuuauggucauacaaugcggagcugcucguggcccuugaaaaccaacauaccaucgaccugacagauagugagaugaacaaauuguuugaaagaacuaagaagcagcuacgggagaaugcagaagacaugggcaacggaugcuucaaaauuuaucacaagugugauaaugcuugcauaggcuccauccgaaacgggaccuacgaccaugacgucuaccgcgaugaggcccugaauaacagauuucagauuaaaggaguggagcucaagagcgguuauaaagacuggauccuguggauuucuuucgcuaucucaugcuuucuucuguguguugccuugcucggcuucauaaugugggcaugccagaaggggaauaucagguguaacauuugcaucuga

SEQ ID NO: 131144 - RNA, 1701 nt, Artificial Sequence
  derived and/or modified sequence opt3 from hemagglutinin__InfluenzaA__AFM72356
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccuggcacagauaacgaccagauuaauuuguaugugcaggccagcgggcguaucacuguaucuaccaagagaucccaacagacaguuauuccaaacaucggaucaaggccccgggugcgcgaugucccuagcagaauaaguauuuacuggaccaucgugaagccaggugacauucugcuaaucucuuccacgggcaaucucaucgcuccgaggggguacuuuaagauucggagcggaaaaucgucuauaaugcgcuccgacgcccccaucggcaaguguaacucagagugcauuacuccuaaugguaguaucccaaacgauaaacccuuccagaaugugaaccgaauaacauauggggcguguccuagauacgucaagcagaauacccugaaacuugcaacuggaaugaggaacguuccagaaaagcaaacacggggcauuuuuggcgccaucgcuggguucaucgagaauggaugggaagguaugguggacggcugguauggguuucgucaccagaacagcgagggaaccggccaggccgcagaucugaaauccacgcaagcugccauuaaucagaucaacgguaaguugaaucgccucauugggaagaccaacgagaaauuccaccagauagaaaaggaguucucugaaguagagggcagaauccaggaccuggaaaaauacguggaggauacaaagauugacuuauggagcuauaacgcggagcugcucgucgcccuugaaaaucaacauacuaucgaucugaccgacucagagaugaacaaauuguuugaaaggacaaagaagcagcuacgggagaaugcagaagauaugggaaacggcugcuucaaaaucuaccacaagugugacaaugcuugcauugggaguauacgaaacggaacuuaugaucaugacguguaccgcgacgaggcccugaauaacagauuucagaucaaagguguugagcucaaguccggcuacaaagauuggauucuguggaucagcuucgcuauuucuugcuuucuucuguguguggccuugcucggguucaucaugugggcaugccagaagggaaauauaagguguaacaucugcauuuga

SEQ ID NO: 131145 - RNA, 1701 nt, Artificial Sequence
  derived and/or modified sequence opt3 from hemagglutinin__InfluenzaA__AFM72367
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaagucauuuuucagucgacugaauuggcucacucauuuaaaauuuaaguauccagcacugaacgugaccaugcccaauaacgagaaauucgacaaacuuuacaucuggggcguccaccauccugugacagauaacgaccagauuaauuuguaugcccaggcuagcggccguaucacuguaucuaccaagagaucccaacagacaguuauuccaaacaucgggucaaggccccgggugcgcgaugucccuagcagaauaaguauuuacuggaccaucgugaagccaggagacauucugcuaaucucuuccacggguaaucucaucgccccgaggggcuacuuuaagauucggagcgggaaaucgucuauaaugcgcuccgacgcgcccaucggaaaguguaacucagagugcauuacuccuaauggcaguaucccaaacgauaaacccuuccagaaugugaaccgaauaacauauggugcauguccuagauacgucaagcagaauacccugaaacuugccacugggaugaggaacguuccagaaaagcaaacacggggaauuuuuggcgcuaucgccggcuucaucgagaaugggugggaaggaaugguggacgguugguauggcuuucgucaccagaacagcgaggggaccggacaggcagcugaucugaaauccacgcaagccgcgauuaaucagaucaacggcaaguugaaucgccucauugguaagaccaacgagaaauuccaccagauagaaaaggaguucucugaaguagaggggagaauccaggaccuggaaaaauacguggaggauacaaagauugacuuauggagcuauaacgccgagcugcucgucgcacuugaaaaucaacauacuaucgaucugaccgacucagagaugaacaaauuguuugaaaggacaaagaagcagcuacgggagaaugcugaagauaugggcaacggaugcuucaaaaucuaccacaagugugacaaugccugcauuggcaguauacgaaacgggacuuaugaucaugacguguaccgcgacgaggcucugaauaacagauuucagaucaaaggaguugagcucaaguccgguuacaaagauuggauucuguggaucagcuucgccauuucuugcuuucuucuguguguggcauugcucggcuucaucaugugggccugccagaaggggaauauaagguguaacaucugcauuuga

SEQ ID NO: 131146 - RNA, 1701 nt, Artificial Sequence
  derived and/or modified sequence opt3 from hemagglutinin__InfluenzaA__AFM72378
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucaguuaaacuuuaaguacccagcacugaacgugaccaugcccaauaacgagcaguucgauaaacuuuauauuuggggaguccaccauccugugacagacaaagaucaaaucuuuuuguacgcccaggcuagcggccguauuacuguaucuaccaagagaucccagcaggccguuaucccaaauauaggcuauaggccccgggugcgcaacauuccuucaagagucagcaucuacuggacaauugugaaaccaggggacauccugcuaaucaauaguaccggaaaccucauugcgccgagggguuacuucaagauacggucuggcaaauccagcaucaugcgcucggaugcacccauugggaaguguaauucugccugcaucacgccuaacggauccauaccaaaugacaagcccuuucaaaacgugaaucgaauuacuuauggcgcuuguccuagauacgucaaacagaacacacugaaacuugccaccgguaugaggaauguuccagaaaagcagacucgggggaucuucggagcaaucgcuggcuuuauugagaacggcugggaagggaugguggacggaugguaugguuuccgucaccaaaauucagagggccgcgggcaggccgcggaucugaagaguacacaggccgcaaucgaccagauuaacggaaaauugaacagacucauaggcaagaccaaugagaaauuccaccaaaucgaaaaggaguuuagcgaaguagaggguaggauucaggaucuggaaaaguacguggaggacacgaaaaucgauuuaugguccuauaacgcugagcugcucgucgcccuugaaaaucagcauaccaucgaccugacagauucugagaugaacaaguuguucgaaaagacuaagaaacagcuacgggagaaugcugaagacauggggaacggcugcuuuaagauuuaccacaagugugauaaugccugcauaggaagcauccgaaacggcaccuaugaccaugauguguaccgcgacgaggcacugaauaacagauuccaaauuaaagggguugagcucaagucaggauacaaagacuggauccuguggauuaguuuugccaucuccugcuuccuucuguguguggcuuugcucgguuuuauaaugugggcgugccagaagggcaauaucagguguaacauuugcaucuga

SEQ ID NO: 131147 - RNA, 1701 nt, Artificial Sequence
  derived and/or modified sequence opt3 from hemagglutinin__InfluenzaA__AFM72389
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccugugacagacaaagaucagaucuuuuuguacgcccaagcuagcggccguauuacuguaucuaccaagagaucccagcaggccguuaucccaaauauaggcuauaggccccgggugcgcaacaauccuucaagagucagcauuuacuggacaaucgugaaaccaggggacauucugcuaaucaacaguaccggaaaucucaucgcgccgagggguuacuucaagauucggucuggcaaauccagcauaaugcgcucggaugcacccaucgggaaguguaacucugccugcauuacgccuaauggauccaucccaaacgacaagcccuuucagaaugugaaccgaauaacuuauggcgcuuguccuagauacgucaaacaaaauacacugaaacuugccaccgguaugaggaacguuccagaaaagcagacucgggggauuuucggagcaaucgcuggcuuuaucgagaauggcugggaagggaugguggacggaugguaugguuuccgucaccagaacucagagggccgcgggcaagccgcggaucugaagaguacacaggccgcaauugaccagaucaacggaaaauugaauagacucauuggcaagaccaacgagaaauuccaucagauagaaaaggaguuuagcgaaguagaggguaggauccaagaucuggaaaaguacguggaggacacgaaaauugauuuaugguccuauaaugcugagcugcucgucgcccuugaaaaccagcacaccaucgaccugacagauucugagaugaauaaguuguucgaaaagacuaagaaacagcuacgggagaacgcugaagacauggggaauggcugcuuuaagaucuaccauaagugugauaacgccugcauuggaagcauacgaaauggcaccuaugaccacgauguguaccgcgacgaggcacugaacaauagauuccagaucaaagggguugagcucaagucaggauacaaagacuggauucuguggaucaguuuugccauuuccugcuuccuucuguguguggcuuugcucgguuuuaucaugugggcgugccaaaagggcaacauaagguguaauaucugcauuuga

SEQ ID NO: 131148 - RNA, 1701 nt, Artificial Sequence
  derived and/or modified sequence opt3 from hemagglutinin__InfluenzaA__AFM72400
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacaggugagaucugcgacagcccacaccagauacuagauggcgaaaacuguacccucaucgacgcucugcuuggggauccgcagugcgacggauuucaaaauaaaaagugggaucuguucguggagagauccaaagccuauucuaacuguuaccccuaugacgucccugauuacgcaucguugaggucacucguggccagcaguggcacucuggaauuuaauaacgaguccuucaauugggcugguguuacacagaacgggaccucuagcgcaugcaagcggggauccaauaacucauuuuucagucgccugaauuggcucacgcauagcaaguuuaaauauccagccuuaaacgugacuaugcccaauaacgaggaguucgacaagcuguacauuuggggcguccuucacccuggcaccgauaacgaccagaucuuuuuguaugcucaggccucugggcgaauuacaguguccacuaaacguucacaacagaccguaaucccaaauauaggaagcagacccaggguucggaacauuccuagucgcaucucuauuuacuggacaaucgugaagccaggugauauccugcuaauuaauuccaccggcaaccucauagcgccgagaggguacuucaaaaucaggagcggaaagucgucuauuaugcgguccgacgcacccaucggcaaguguaauucagaaugcauaacgccuaacgguaguauuccaaaugacaaacccuuucagaacgucaaucgcaucacuuauggggccuguccucgauacgugaagcagaacacacugaaacuugcuaccggaaugagaaaugugccagaaaagcaaacuaggggcaucuucggcgccauugcaggguuuaucgagaacggaugggaggguauggucgauggcugguauggguuccggcaucagaauagcgaaggaauuggccaggcugccgaccugaaauccacacaagcggccauagaucagaucaacgguaaguugaaucgucucauugggaaaaccaacgagaaguuccaccagaucgaaaaggaguuuucugaaguugagggccgcauccaggaccuggagaaauacguggaagauacgaagauugacuuauggagcuauaacgcagagcugcucguagcucuugaaaaucaacacaccauagaucugacagacucagagaugaacaaauuguucgaaaagacuaaaaagcagcuaagagagaaugccgaggauaugggaaacggcugcuuuaagaucuaccauaaaugugacaaugcuugcauugggaguaucaggaacggaaccuaugaucacgacguguaccgggacgaagcccugaauaaccgauuccagauuaagggugucgagcucaaauccggcuacaaggauuggauccuguggaucagcuuugcaauaucuugcuuccuucuguguguggccuugcucggguuuauuaugugggcuugccagaaaggaaauauccgcuguaacauuugcaucuga

SEQ ID NO: 131149 - RNA, 1701 nt, Artificial Sequence
  derived and/or modified sequence opt3 from hemagglutinin__InfluenzaA__AFM72411
augaagaccaucauugcccugagcuacauacucugccuuguguucgcucagaaacugcccggcaucgacaacuccacagcaacuuuguguuuagggcaccaugccgucccuaauggaacgauuguuaagaccaucacaaacgaucaaauugaggugacuaaugcgaccgaacugguacagucuucaaguacaggugagaucugcgacagcccacaccagauacuagauggcgaaaacuguacccucaucgacgcucugcuuggggauccgcagugcgacggauuucaaaauaaaaagugggaucuguucguggagagauccaaagccuauucuaacuguuaccccuaugacgucccugauuacgcaucguugaggucacucguggccagcaguggcacucuggaauuuaauaacgaguccuucaauugggcugguguuacacagaacgggaccucuagcgcaugcaagcggggauccaauaacucauuuuucagucgccugaauuggcucacgcagagcaaguuuaaauauccagccuuaaacgugacuaugcccaauaacgaggaguucgacaagcuguacauuuggggcguccaucacccugugaccgauaacgaccagaucuuucuuuaugcucaagccucuggccgaauuacaguauccacuaaacguucacagcagaccguuaucccaaauauagggagcagacccagggugcggaacauuccuagucgcaucucuauuuacuggacaaucgucaagccaggagauaucuugcugauuaauuccaccgguaaccuaauagcgccgagaggcuacuucaaaaucaggagcgggaagucgucuauuaugcgguccgacgcacccaucggaaaguguaauucagaaugcauaacgccuaacggcaguauuccaaaugacaaacccuuucagaacgugaaucgcaucacuuauggugccuguccucgauacgugaagcaaaacacacucaaacuggcuaccgggaugagaaaugucccagaaaagcagacuaggggaaucuucggcgccauugcaggcuuuaucgagaacgggugggagggaaugguugaugguugguauggcuuccggcaucagaauagcgaagggauuggacaagcugccgaccuuaaauccacacaggcggccauagaucagaucaacggcaagcugaaucguuugauugguaaaaccaacgagaaguuccaccagaucgaaaaggaguuuucugaaguggaggggcgcauccaagacuucgagaaauacguagaagauacgaagauugaccucuggagcuauaacgcagagcuguuaguggcucuggaaaaucagcacaccauagaucucacagacucagagaugaacaaacuuuuugaaaagacuaaaaagcagcugagagagaaugccgaggauaugggcaacggaugcuucaagaucuaccauaaaugugacaaugcuugcauuggcaguaucaggaacgggaccuaugaucacgacgucuaccgggacgaagccuugaauaaccgauuucagauuaagggaguggagcuaaaauccgguuacaaggauuggauccuguggaucagcuucgcaauaucuugcuuucuccuguguguugcccuucugggcuucauuaugugggcuugccaaaaagggaauauccgcuguaacauuugcaucuga

SEQ ID NO: 131150 - RNA, 1701 nt, Artificial Sequence
  derived and/or modified sequence opt3 from hemagglutinin__InfluenzaA__AFM72422
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccugugacagauaaugaccagaucuuuuuguaugcccaggcuagcggccguauuacuguaucuaccaagagaucccaacagacaguuaucccaaacauaggcuucaggccccgggugcgcaauauuccuucaagaaucagcauuuacuggaccaucgucaaaccaggggauauccugcuaauuaacaguacgggaaaucucauagccccgagggguuacuuuaagauccggucuggcaaauccagcauuaugcgcucggacgcgcccaucgggaaguguaacucugaaugcauaacuccuaauggauccauuccaaacgacaagcccuuccagaaugugaaccgaaucacauauggcgcauguccuagauacgugaaacagaauacccugaaacuugccacugguaugaggaacgucccagaaaaacaaacacgggggaucuuuggagcuauugccggcuucaucgagaauggcugggaggggaugguugauggaugguaugguuuccgucaccagaacucagaaggcauugggcaggcagcugaccugaagaguacccaagccgcgauagaucagaucaauggaaaauugaaccgccucauuggcaagacgaacgagaaauuucaccagaucgaaaaggaguucagcgaaguggaggguagaauccaggaccuggagaaguacgccgaagauaccaaaauugacuuaugguccuauaaugcagagcugcucguagcucuugaaaaccaacauacaauagaucugacugacucugagaugaauaaguuguuugaaaagaccaagaaacagcuaagggagaacgccgaggauauggggaauggcugcuucaagaucuaccacaagugugacaacgcuugcauuggaagcauccggaauggcacauaugaucaugacguguaccgagacgaagcccugaacaaucgcuuucagauuaaaggggucgagcucaagucaggauacaaagauuggauccuguggauaaguuucgcaaucuccugcuuucuucuguguguggccuugcucgguuucauuaugugggcuugccagaagggcaacaucagauguaauauuugcaucuga

SEQ ID NO: 131151 - RNA, 1701 nt, Artificial Sequence
  derived and/or modified sequence opt3 from hemagglutinin__InfluenzaA__AFM72433
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccugugacagauaaugaccagaucuuuuuguaugcccaggcuagcggccguauuacuguaucuaccaagagaucccaacagacaguuaucccaaacauaggcuucaggccccgggugcgcaauaacccuucaagaauuagcaucuacuggaccauugucaaaccaggggauauccugcuaaucaauaguacgggaaaccucauugccccgagggguuacuuuaagauacggucuggcaaauccagcaucaugcgcucggacgcgcccauugggaaguguaauucugaaugcaucacuccuaacggauccauaccaaaugacaagcccuuccagaacgugaaucgaauuacauauggcgcauguccuagauacgugaaacagaacacccugaaacuugccacugguaugaggaaugucccagaaaaacaaacacgggggaucuuuggagcuaucgccggcuucauugagaacggcugggaggggaugguugauggaugguaugguuuccgucaccaaaauucagaaggcaucgggcaggcagcugaccugaagaguacccaggccgcgauugaucagauaaacggaaaauugaaccgccucaucggcaagacgaaugagaaauuucaccagauugaaaaggaguucagcgaaguggaggguagaauccaggaccuggagaaguacgccgaagauaccaaaaucgacuuaugguccuauaacgcagagcugcucguagcucuugaaaaucaacauacaauugaucugacugacucugagaugaacaaguuguuugaaaagaccaagaaacagcuaagggagaaugccgaggauauggggaacggcugcuucaagauauaccacaagugugacaaugcuugcaucggaagcauucggaacggcacauaugaucaugacguguaccgagacgaagcccugaauaaccgcuuucagaucaaaggggucgagcucaagucaggauacaaagauuggauucuguggaucaguuucgcaauauccugcuuucuucuguguguggccuugcucgguuucaucaugugggcuugccagaagggcaauauuagauguaacaucugcauuuga

SEQ ID NO: 131152 - RNA, 1701 nt, Artificial Sequence
  derived and/or modified sequence opt3 from hemagglutinin__InfluenzaA__AFM72444
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccugugacagauaaugaccagaucuugcuguaugcccaggcuagcggccguauuacuguaucuaccaagagaucccaacagacaguuaucccaaacauaggcuuuaggccccgggugcgcaauaacccuucaagaauuagcaucuacuggaccauugucaaaccaggggauauccuacucaucaauaguacgggaaaccugauugccccgagggguuacuucaagauacggucuggcaaauccagcaucaugcgcucggacgcgcccauugggaaguguaauucugaaugcaucacuccuaacggauccauaccaaaugacaagcccuuucagaacgugaaucgaauuacauauggcgcauguccuagauacgugaaacagaacacccuuaagcuggccacugguaugaggaaugucccagaaaaacaaacacgggggaucuucggagcuaucgccggcuuuauugagaacggcugggaggggaugguugauggaugguaugguuuccgucaccaaaauucagaaggcaucgggcaggcagcugacuugaagaguacccaggccgcgauugaucagauaaacggaaaacucaaccgccugaucggcaagacgaaugagaaauuccaccagauugaaaaggaguuuagcgaaguggaggguagaauccaggacuuagagaaguacgccgaagauaccaaaaucgaccugugguccuauaacgcagagcuccuuguagcucuggaaaaucaacauacaauugauuugacugacucugagaugaacaagcuauucgagaaaaccaagaaacagcugagggaaaaugccgaggauauggggaacggcugcuuuaagauauaccacaagugugacaaugcuugcaucggaagcauucggaacggcacauaugaucaugacguguaccgagacgaagcccucaauaaccgcuuccagaucaaaggggucgagcugaagucaggauacaaagauuggauucuuuggaucaguuuugcaauauccugcuuccuguuguguguggcccuccuggguuuuaucaugugggcuugccagaagggcaauauuagauguaacaucugcauuuga

SEQ ID NO: 131153 - RNA, 1701 nt, Artificial Sequence
  derived and/or modified sequence opt3 from hemagglutinin__InfluenzaA__AFM72455
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucaguuaaaguuuaaguauccagcacugaaugugaccaugcccaacaacgaggaguucgacaaacuuuacauuuggggaguccaucacccugugacagauaaugaccagaucuuuuuguaugcccaagcuagcggccguauuacuguaucuaccaagagaucccagcagacaguuaucccaaacauaggcuucaggccccgggugcgcaauaacccuucaagaauuagcaucuacuggaccauugucaaaccaggggauauccugcuaaucaauaguacgggaaaccucauugccccgagggguuacuuuaagauacggucuggcaaauccagcaucaugcgcucggacgcgcccauugggaaguguaauucugaaugcaucacuccuaacggauccauaccaaaugacaagcccuuccagaacgugaaucgaauuacauauggcgcauguccuagauacgugaaacaaaacacccugaaacuugccacugguaugaggaaugucccagaaaaacagacacgggggaucuuuggagcuaucgccggcuucauugagaacggcugggaggggaugguugauggaugguaugguuuccgucaucaaaauucagaaggcaucgggcaggcagcugaccugaagaguacccaggccgcgauugaucagauaaacggaaaauugaaccgccucaucggcaagacgaaugagaaauuucaccagauugaaaaggaguucagcgaaguggaggguagaauccaagaccuggagaaguacgccgaagauaccaaaaucgacuuaugguccuauaacgcagagcugcucguagcucuugaaaaucagcacacaauugaucugacugacucugagaugaacaaguuguuugaaaagaccaagaaacagcuaagggagaaugccgaggauauggggaacggcugcuucaagauauaccauaagugugacaaugcuugcaucggaagcauucggaacggcacauaugaucacgacguguaccgagacgaagcccugaauaaccgcuuucagaucaaaggggucgagcucaagucaggauacaaagauuggauucuguggaucaguuucgcaauauccugcuuucuucuguguguggccuugcucgguuucaucaugugggcuugccaaaagggcaauauuagauguaacaucugcauuuga

SEQ ID NO: 131154 - RNA, 1701 nt, Artificial Sequence
  derived and/or modified sequence opt3 from hemagglutinin__InfluenzaA__AFM72466
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgaggaguucgacaaacuuuacauuuggggaguccaccauccugugacagauaaggaccagaucuuuuuguaugcccaggcuagcggccguauuacuguaucuaccaaaagaucccaacagacaguuaucccaaauauaggcuucaggccccgggugcgcaacaauccuucaagaauuagcaucuacuggaccauugucaagccaggggauauccugcuaaucaacaguacgggaaaucucauugccccgagggguuacuuuaaaauacggucuggcaaguccagcaucaugcgcucggacgcgcccauugggaaguguaacucugaaugcaucacuccuaauggauccauaccaaacgacaaacccuuccagaaugugaaccgaauuacauauggcgcauguccuagauacgugaagcagaauacccugaaacuugccacugguaugaggaacgucccagaaaagcaaacacgggggaucuuuggagcuaucgccggcuucauugagaauggcugggaggggaugguugauggaugguaugguuuccgucaccagaacucagaaggcaucgggcaggcagcugaccugaaaaguacccaagccgcgauugaucagauaaauggaaaguugaaccgccucaucggcaaaacgaacgagaaguuucaccagauugaaaaggaguucagcgaaguggaggguagaauccaggaccuggagaaauacgccgaagauaccaagaucgacuuaugguccuauaaugcagagcugcucguagcucuugaaaaccaacauacaauugaucugacugacucugagaugaauaaauuguuugaaaagaccaaaaagcagcuaagggagaacgccgaggauauggggaauggcugcuucaagauauaccacaaaugugacaacgcuugcaucggaagcauucggaauggcacauaugaucaugacguguaccgagacgaagcccugaacaaucgcuuucagaucaagggggucgagcucaaaucaggauacaaggauuggauucuguggaucaguuucgcaauauccugcuuucuucuguguguggccuugcucgguuucaucaugugggcuugccagaaaggcaacauuagauguaauaucugcauuuga

SEQ ID NO: 131155 - RNA, 1701 nt, Artificial Sequence
  derived and/or modified sequence opt3 from hemagglutinin__InfluenzaA__AFM72488
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucaguuaaaguuuaaauauccagcacugaaugugaccaugcccaacaacgagaaguucgacaaacuuuacaucuggggcguccaucacccugugacagauaaugagcagaucuuuuuguaugcccaagcuagcggccguauuacuguaucuaccaagagaucccagcagacaguuauuccaaacaucggguucaggccccgggugcgcaauauaccuucaagaauuagcaucuacuggaccauugucaaaccaggagacauccugcuaaucaacaguacggguaaucucauugccccgaggggcuacuuuaagauacggucugggaaguccagcaucaugcgcucggaugcgcccauuggaaaauguaacucuaagugcaucacuccuaauggcuccauaccaaacgacaaacccuuccagaaugugaaccgaauuacauauggugcauguccuagauacgugaagcaaaauacccugaaacuugccacugggaugaggaacgucccagaaaagcagacacggggaaucuuuggcgcuaucgccggcuucauugagaaugggugggaaggaaugguugacgguugguauggcuuccgucaucagaacucagaggggaucggacaagcagcugaucugaaaaguacccaggccgcgauugaccagauaaauggcaaguugaaccgccucaucgguaagacgaacgagaaauuucaccagauugaaaaggaguucagcgaaguggaggggagaauccaagaucuggaaaaauacguagaggacaccaagaucgauuuaugguccuauaaugccgagcugcucguggcacuugaaaaccagcacacaauugaccugacugauucugagaugaauaaauuguuugaaaagaccaagaaacagcuaagggagaacgcugaagacaugggcaauggaugcuucaagauauaccauaaaugugauaacgccugcaucggcagcauucggaaugggacauaugaccacgaugucuaccgagacgaggcucugaacaaucgcuuucagaucaagggaguggagcucaaaucagguuacaaggacuggauucuguggaucaguuucgccauauccugcuuucuucuguguguugcauugcucggcuucaucaugugggccugccaaaaggggaacauuagauguaauaucugcauuuga

SEQ ID NO: 131156 - RNA, 1701 nt, Artificial Sequence
  derived and/or modified sequence opt3 from hemagglutinin__InfluenzaA__AFM72499
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucaguuaaaguuuaaauauccagcacugaaugugaccaugcccaacaacgagaaguucgacaaacuuuacaucuggggcguccaucacccugugacagauaaugaccagaucuuuuuguaugcccaagcuagcggccguauuacuguaucuaccaagagaucccagcagacaguuauuccaaacaucgggucaaggccccgggugcgcaauauaccuagcagaauuaguaucuacuggaccauugucaaaccaggagauauccugcuaaucaacucuacggguaaucucauugccccgaggggcuacuucaagauacgguccgggaaaagcucgaucaugcgcucugacgcgcccauuggaaaauguaacuccgagugcaucacuccuaauggcucaauaccaaacgacaagcccuuucagaaugugaaccgaauuacauauggugcauguccuagauacgugaaacaaaauacccugaagcuggccacugggaugaggaacgucccagaaaaacagacacggggaaucuucggcgcuaucgccggcuuuauugagaaugggugggaaggaaugguugaugguugguauggcuuccgucaucagaacagugaggggaucggacaagcagcugaccuuaagagcacccaggccgcgauugaucagauaaauggcaaauugaaccgccucaucgguaagacgaacgagaaguuccaccagauugaaaaagaguuuuccgaaguggaggggagaauccaagaccuggaaaaguacguagaggauaccaaaaucgacuuauggucuuauaaugccgagcugcucguggcacuugaaaaccagcacacaauugaucugacugacagcgagaugaauaaguuguucgaaaagaccaagaagcagcuaagggagaacgcugaagauaugggcaauggaugcuuuaaaauauaccauaagugugacaacgccugcaucggcucaauucggaaugggacauaugaucacgacgucuaccgagacgaggcucugaacaaucgcuuccagaucaaaggaguggagcucaagagugguuacaaagauuggauucuguggaucuccuuugccauaagcugcuuccuucuguguguugcauugcucggcuuuaucaugugggccugccaaaaggggaacauuagauguaauaucugcauuuga

SEQ ID NO: 131157 - RNA, 1698 nt, Artificial Sequence
  derived and/or modified sequence opt3 from hemagglutinin__InfluenzaA__AFM72521
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggagacuaugccuccugaaaggaauagcccccuuacagcuggguaacuguucaguggcgggcuggaucuuggggaauccugagugcgaacuccugauuaguaaggagagcugguccuacaucguugaaaaaccaaacccggagaauggaaccuguuaucccggccauuuugcugauuacgaggaacugagggagcaacucucuucggugucaagccuugaacgguucgagauuuuuccuaaggagaguuccuggccaaaccacacugucacaggugugucugccagcugcucccauaauggggaaucaaguuucuaucgcaaccugcuuugguugaccggaaagaauggccuguaccccaaccuaagcaaaucuuaugcaaauaacaaggagaaagaaguacucguucuguggggcgugcaccacccuccaaacaucgggaaucagaaggcccuuuaccauacggagaacgcuuacgucuccguggugucaagccacuauagucgaaaauuuacucccgaaauagcaaagcguccuaaggucagagaccaggagggaaggaucaauuacuauuggacccuguuggagccaggugauacaauuaucuucgaagccaacggcaaucucauugcuccgcgguacgccuuugcgcugucucgcggguucggauccggcaucauaaacagcaaugcacccauggacaaaugugaugccaagugccagacuccucaaggugcuauuaacucgucuuuaccauuucagaauguucaucccgugaccaucggggaguguccuaaauauguaagauccgccaagcugaggauggugacaggacuccggaacauuccaucaauccagagucgcggccuuuucggcgcaaucgcuggguuuauugaaggagguuggaccggcauggucgacgggugguacggauaucaccaccagaaugagcaaggcagcgguuacgccgcggaucagaaauccacgcagaacgccauaaaugggaucacuaacaagguaaauucuguuauugagaaaaugaacacacaguucaccgcagugggcaaggaauuuaacaagcuggagcgaagaauggaaaauuugaacaaaaaggucgacgauggauucaucgacauauggacuuacaaugcugagcuacuggugcuccuggaaaacgagaggacacuugauuuccaugacagcaaugugaaaaaccuguaugaaaagguuaaaucacaauugaagaauaacgccaaggagauuggcaaugggugcuuugaguucuaccacaaauguaacgacgaaugcauggagagugugaagaauggaaccuaugauuaccccaaauauuccgaagagagcaagcucaaccgggagaaaaucgacggugucaagcuggaaucuaugggcguguaccagaucuuagcuauuuauucaacggucgccaguagccuggugcuacucguuucccugggggcaaucucuuuuuggaugugcucgaauggaagccuucagugucguauuugcauauga

SEQ ID NO: 131158 - RNA, 1698 nt, Artificial Sequence; identical to SEQ ID NO: 131157
  derived and/or modified sequence opt3 from hemagglutinin__InfluenzaA__AFM72532

SEQ ID NO: 131159 - RNA, 1698 nt, Artificial Sequence; identical to SEQ ID NO: 131157
  derived and/or modified sequence opt3 from hemagglutinin__InfluenzaA__AFM72543

SEQ ID NO: 131160 - RNA, 1698 nt, Artificial Sequence
  derived and/or modified sequence opt3 from hemagglutinin__InfluenzaA__AFM72554
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggagacuaugccuccugaaaggaauagcccccuuacagcuggguaacuguucaguggcgggcuggaucuuggggaauccugagugcgaacuccugauuaguaaggagagcugguccuacaucguugaaaaaccaaacccggagaauggaaccuguuaucccggccauuuugcugauuacgaggaacugagggagcaacucucuucggugucaagccuugaacgguucgagauuuuuccuaaggagaguuccuggccaaaccacacugucacaggugugucugccagcugcucccauaauggggaaucaaguuucuaucgcaaccugcuuugguugaccggaaagaauggccuguaccccaaccuaagcaaaucuuaugcaaauaacaaggagaaagaaguacucguucuguggggcgugcaccacccuccaaacaucgggaaucagaaggcccuuuaccauacggagaacgcuuacgucuccguggugucaagccacuauagucgaaaauuuacucccgaaauagcaaagcguccuaaggucagagaccaggagggaaggaucaauuacuauuggacccuguuggagccaggugauacaauuaucuucgaagccaacggcaaucucauugcuccgcgguacgccuuugcgcugucucgcggguucggauccggcaucauaaacagcaaugcacccauggacaaaugugaugccaagugccagacuccucaaggugcuauuaacucgucuuuaccauuucagaauguucaucccgugaccaucggggaguguccuaaauauguaagauccgccaagcugaggauggugacaggacuccggaacauuccaucaauccagagucgcggccuuuucggcgcaaucgcuggguuuauugaaggagguuggaccggcauggucgacgggugguacggauaucaccaccagaaugagcaaggcagcgguuacgccgcggaucagaaauccacgcagaacgccauaaaugggaucacuaacaagguaaauucuguuauugagaaaaugaacacacaguucaccgcagugggcaaggaauuuaacaagcuggagcgaagaauggaaaauuugaacaaaaaggucgacgauggauucaucgacauauggacuuacaaugcugagcuacuggugcuccuggaaaacgagaggacacuugauuuccaugacagcaaugugaaaaaccuguaugaaaagguuaaaucacaauugaagaauaacgccaaggagauuggcaaugggugcuuugaguucuaccacaaauguaacgacgaaugcauggagagugugaagaauggaaccuaugauuaccccaaauauuccgaagagagcaagcucaaccgggagaaaaucgacgaagucaagcuggagucuauggguguguaccagaucuuagcuauuuauucaacggucgccaguagccuggugcuacucguuucccugggcgcaaucucuuuuuggaugugcucgaaugggagccuucagugucguauuugcauauga

SEQ ID NO: 131161 - RNA, 1701 nt, Artificial Sequence
  derived and/or modified sequence opt3 from hemagglutinin__InfluenzaA__AFM72565
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcuccugcauccggcgcucaaacaauagcuuuuucagccgacugaacuggcucacucauuuaaaguuuaaguauccagcucugaaugugaccaugcccaacaacgagaaauucgacaaacuuuacauuuggggaguccaccauccuggcacagauaaugaccagaucuuuccauaugcacaggccucuggccguauuacuguguccaccaagagaucacaacagacaguaauccccaacauagggagcaggccucggguucgcaauauuccaaguagaaucucuauuuacuggaccaucgugaagccgggagauaucuugcugauuaacuccacggguaaucuaauagcucccaggggcuacuucaaaauccggagcgggaagucgucuauuaugcgcuccgacgccccuaucggaaaguguaacucagaaugcauaacuccaaauggcaguauucccaacgacaaaccuuuucagaaugucaaccgaaucacauauggugcguguccaagauacgugaagcagaauacccucaaacuggcaacugggaugaggaacgugcccgagaagcaaacacggggaaucuucggcgccauugcuggcuuuaucgaaaaugggugggagggaauggucgaugguugguauggcuuccgucaccagaacagcgaggggauuggacaggccgcagaccuuaaauccacccaagcugccauagaucagaucaauggcaagcugaaccgcuugauugguaaaacgaacgaaaaguuccaccagaucgagaaggaauuuucugagguugaagggagaauccaggaccucgagaaauacguggaggauaccaagauugaccuguggagcuauaaugcggaauuacugguagcccucgagaaccaacauacaauagaucuuacugacucagaaaugaauaaacuguucgagaagaccaaaaagcaguugagggaaaacgcagaggauaugggcaauggaugcuuuaagaucuaccacaaaugugacaacgcuugcauuggcaguauccggaaugggacauaugaucaugacguguaccgagacgaggcccuaaacaaucgcuuccagauuaagggagucgaacugaaauccgguuacaaggauuggauccucuggauaaguuuugcuaucucuugcuuccugcuuuguguggcccuguugggcuuuauuaugugggcaugccagaaagggaacaucagauguaauauuugcaucuga

SEQ ID NO: 131162 - RNA, 1701 nt, Artificial Sequence
  derived and/or modified sequence opt3 from hemagglutinin__InfluenzaA__AFM72576
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcuccugcauccggggaucaaacaauagcuuuuucagccgccugaacuggcucacucauuuaaaguuuaaguauccagcucugaaugugaccaugcccaacaacgagaaauucgacaaacuuuacauuuggggcguccaccauccuggcacagauaaugaccagaucuuuccauaugcacaggccucugggcgaauuacuguguccaccaagcguucacaacagacaguaauccccaacauaggaagcagaccuaggguucggaauauuccaagucgcaucucuauuuacuggaccaucgugaagccgggugauaucuugcugauuaacuccacgggcaaucuaauagcucccagaggguacuucaaaaucaggagcggaaagucgucuauuaugcgguccgacgccccuaucggcaaguguaacucagaaugcauaacuccaaaugguaguauucccaacgacaaaccuuuucagaaugucaaccgcaucacauauggggcguguccacgauacgugaagcagaauacccucaaacuggcaacuggaaugagaaacgugcccgagaagcaaacaaggggcaucuucggcgccauugcuggguuuaucgaaaauggaugggaggguauggucgauggcugguauggguuccggcaccagaacagcgagggaauuggccaggccgcagaccuuaaauccacccaagcugccauagaucagaucaaugguaagcugaaccguuugauugggaaaacgaacgaaaaguuccaccagaucgagaaggaauuuucugagguugaaggccgcauccaggaccucgagaaauacguggaggauaccaagauugaccuguggagcuauaaugcggaauuacugguagcccucgagaaccaacauacaauagaucuuacugacucagaaaugaauaaacuguucgagaagaccaaaaagcaguugagagaaaacgcagaggauaugggaaauggcugcuuuaagaucuaccacaaaugugacaacgcuugcauugggaguaucaggaauggaacauaugaucaugacguguaccgggacgaggcccuaaacaaucgauuccagauuaagggugucgaacugaaauccggcuacaaggauuggauccucuggauaaguuuugcuaucucuugcuuccugcuuuguguggcccuguugggguuuauuaugugggcaugccagaaaggaaacauccgcuguaauauuugcaucuga

SEQ ID NO: 131163 - RNA, 1698 nt, Artificial Sequence
  derived and/or modified sequence opt3 from hemagglutinin__InfluenzaA__AFM72799
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauaaccacaaugggaaacuaugccuccugaagggaaaagcgccccuucagcuggguaacuguucuguggccggcuggauauuggggaauccugagugcggacuccugaucucaaaggaaaguuggagcuacauuguugagagaccaaacccggaaaauggcaccuguuaucccggucauuuugcugacuacgaggagcugagggaacaacucuccucugugucgucauucgagcgguuugaaaucuucccuaaggagagcaguuggccaaaccacacugucacagggguguccgccucuugcagccauaauggagaguccucauuuuauaaaaacuuacuguggcuuaccggcaagaauggcuuguaccccaaccugaguaaaagcuaugcaaauaacaaggaaaaagaggugcuaguucucuggggagugcaccacccuccaaacauugggaaucagaugacgcuguaccauaaggaaaacgccuacgucucugugguguccucacacuauagccgcaaguucacucccgagaucgcuaaacgaccuaagguccgugaucaggaagguagaauaaauuacuauuggacccuucuggagccaggcgacacaaucauuuuugaggcaaacgggaauuugaucgccccgagguacgcuuucgcccucagucggggauuuggcucugguauuaucaacuccaaugcgcccauggaugaaugugacgcaaaaugccagacuccucaaggggccauaaacagcucgcugccauuccagaauguucaucccgugaccauuggagaguguccuaaguauguacgcucugcuaaauuaagaauggugacaggccugaggaacaucccauccauucagucacggggccucuuuggggccaucgcaggauucaucgaagguggcuggaccgggauggucgauggaugguacggcuaucaccaccagaaugagcaagguaguggguacgcugccgaccaaaagagcacgcagaacgcgauuaauggcauaacuaacaaaguaaauuccguuaucgaaaagaugaacacacaguuuaccgccgugggaaaggaguucaacaaacuugagcgccgaauggaaaaucugaacaagaaagucgaugacggcuucauugauguguggacuuacaaugcagaguugcuaguacugcucgaaaacgagagaacacuggacuuucaugacucuaauguuaagaaccuuuaugaaaaagugaagaaucagcugaagaacaaugcuaaagagaucgggaacggaugcuucgaguuuuaccacaaguguaaugaugaaugcauggagagcgucaaaaacgguaccuaugacuaccccaaguauucagaagagaguaaauuguccagggagaagauagauggcgugaagcucgaaagcaugggggucuaccagauucuggccaucuauucuacgguggcuucaaguuuaguucugcuagugagccucggagccaucuccuucuggaugugcucuaauggcucgcugcagugucggauuugcaucuga

SEQ ID NO: 131164 - RNA, 1698 nt, Artificial Sequence; identical to SEQ ID NO: 131163
  derived and/or modified sequence opt3 from hemagglutinin__InfluenzaA__AFM72810

SEQ ID NO: 131165 - RNA, 1698 nt, Artificial Sequence; identical to SEQ ID NO: 131163
  derived and/or modified sequence opt3 from hemagglutinin__InfluenzaA__AFM72821

SEQ ID NO: 131166 - RNA, 1701 nt, Artificial Sequence
  derived and/or modified sequence opt3 from hemagglutinin__InfluenzaA__AFM72852
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccgacaagggugucaccgccgcuuguccacaugcaggggccaaaucauuuuauaagaaccugaucuggcucgugaaaaagggaaauaguuaccccaaauuaagcaagucuuauauaaacgauaagggcaaagaaguacugguucuuuggggcauccaccacccuuccacgucagcugaccaacagagcuuguaccagaaugccgaugcguacguguucgucgggaguucucgcuauuccaagacuuuuaaaccagagauugcaauccgacccaaggugcgugacagagagggaaggaugaacuacuauuggacccugguggaaccuggugauaaaauuacauucgaggccacuggcaaucuagucguuccacgguacgcuuuugccauggaacgcaacgcagggagcggaaucauaauuucggacaccccggugcaugacugcaacacaaccugucagacgcccaagggcgcuaucaauacuucucucccuuuccaaaacauucacccaaucacaaucgguaaaugccccaaguauguaaaguccaccaaacugagacuugccacugggcugaggaauauuccuucaauacagagucggggauuguuuggcgcgaucgccggcuucauugaagggggauggacagguaugguggauggcugguacggguaucaucaccagaacgaacagggaagcggcuacgcagcugaccucaaguccacccaaaaugccaucgaugagauaacgaacaaagucaauucugugauugagaagaugaacacccaguuuacagcuguugguaaagaguucaaucaccuggaaaagcgcaucgaaaacuuaaauaagaaaguggacgauggguuccuggacaucuggacuuacaacgccgagcuccuuguccuguuggaaaaugagcgaacccuagauuaucaugacagcaacgugaagaaucuguacgagaaaguaagaucacagcucaagaacaacgcaaaagaaauuggcaauggauguuuugaguucuaucacaagugcgauaacacauguauggaaaguguuaagaauggcacuuacgacuauccaaaauacuccgaggaagccaagcugaacagggaggagaucgauggggugaaacuugaaagcacccggauuuaucagauacuggcuaucuacucuacagucgcgucaaguuuggugcucgucgugagccugggagcaauuuccuuuuggaugugcucuaaugguucguuacaaugccguaucuguaucuga

SEQ ID NO: 131167 - RNA, 1701 nt, Artificial Sequence
  derived and/or modified sequence opt3 from hemagglutinin__InfluenzaA__AFM72862
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccccaucuucggacaacggaacuugcuauccgggcgauuuuaucgacuacgaggagcucagggagcagcugucaagcgugaguuccuucgaacgguuugagauuuuccccaagacaucuagcuggccuaaucacgauuccaacaagggugucaccgccgcuuguccacaugcaggggccaaaucauuuuauaagaaucugaucuggcucgugaaaaagggaaacaguuaccccaaauuaagcaauucuuauauaaacgacaagggcaaggaaguacugguucuuuggggcauccaccacccuuccacgucagcugaucaacagagcuuguaccagaaugccgacgcguacguguucgucgggaguucucgcuauuccaaaacuuuuaagccagagauugcaauccgacccaaagugcgugauagagagggaaggaugaacuacuauuggacccugguggaaccuggugacaagauuacauucgaggccacuggcaaccuagucguuccacgguacgcuuuugccauggaacgcaaugcagggagcggaaucauaauuucggauaccccggugcaugacugcaacacaaccugucagacgcccaaaggcgcuaucaauacuucucucccuuuccaaaacauucacccaaucacaaucgguaagugccccaaauauguaaaguccaccaagcugagacuugccacugggcugaggaauauuccuucaauacagagucggggauuguuuggcgcgaucgccggcuucauugaagggggauggacagguaugguggacggcugguacggguaucaucaccagaacgaacagggaagcggcuacgcagcugaucucaaauccacccaaaaugccaucgacgagauaacgaacaaggucaauucugugauugagaaaaugaacacccaguuuacagcuguugguaaggaguucaaucaccuggaaaaacgcaucgaaaacuuaaauaagaagguggaugacggguuccuggauaucuggacuuacaacgccgagcuccuuguccuguuggaaaaugagcgaacccuagacuaucaugauagcaacgugaaaaaccuguacgagaagguaagaucacagcucaaaaauaacgcaaaggaaauuggcaauggauguuuugaguucuaucacaaaugcgacaacacauguauggaaaguguuaagaauggcacuuacgauuauccaaaguacuccgaggaagccaaacugaacagggaggagaucgacggggugaaacuugaaagcacccggauuuaucagauacuggcuaucuacucuacagucgcgucaaguuuggugcucgucgugagccugggagcaauuuccuuuuggaugugcucuaaugguucguuacaaugccguaucuguaucuga

SEQ ID NO: 131168 - RNA, 1701 nt, Artificial Sequence
  derived and/or modified sequence opt3 from hemagglutinin__InfluenzaA__AFM72872
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacagucuucaaguaccggugagaucugcgacagcccacaccagauucuagauggcaaaaauuguacucucaucgacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacacuggaguuuaacaaugaauccuucaacuggaccgguguuacgcagaaugggacuucuagcgcuugcauacggcgcuccaagaacucauuuuucagucgacugaauuggcucacccauuuaaacuuuaaauauccagcacugaaugugacaaugcccaacaacgagcaguucgacaaacuuuacaucuggggaguccaccauccuggcacugauaaagaccagauuuuuccauaugcccaagcuagcggccguaucaccgugucuacaaagagaucccagcagaccgccauucccaauaucgggucaaggccucggguacgcaacauaccaagcagaauuaguaucuacuggacgauuguuaaaccgggagauaucuugcugaucaauucuacugguaaccuaauugcgcccaggggcuacuucaagauacgguccggaaagagcucgaucaugcgcucugacgcaccuauugggaaauguaauuccgagugcaucacaccaaacggcucaauacccaaugacaagccuuuucagaacgugaaucgaauuaccuauggugccuguccaagauacgucaaacaaaacacucucaagcuggcuacagggaugaggaaugugcccgaaaaacagacccggggaaucuucggcgccaucgcaggcuuuauugagaacgggugggaaggaaugguggaugguugguauggcuuccgucaccagaauagugaggggcgcggacaagcugccgaccuuaagagcacgcaggcggccaucgaucagauuaacggcaaacugaauagauugauagguaagaccaacgagaaguuccaccagaucgaaaaagaguuuuccgaagucgaggggaggauucaagaccucgaaaaguacguugaggauacaaaaaucgaccuguggucuuauaacgcagaguuacugguggcucucgaaaaucagcauacuaucgaucuuaccgacagcgagaugaacaagcuguucgaaaagacaaagaagcaguugcgggagaaugccgaagauaugggcaacggaugcuuuaaaauuuaccacaagugugacaaugcuugcauaggcucaauccgaaacgggacuuaugaucaugacguauaccgcgacgaggcccuaaauaacagauuccagauuaaaggaguggagcugaagagugguuacaaagauuggauccucuggauuuccuuugcaaucagcugcuuccugcuuugugucgcccuguugggcuuuauaaugugggcuugccaaaaggggaauaucagguguaacauuugcaucuga

SEQ ID NO: 131169 - RNA, 1701 nt, Artificial Sequence
  derived and/or modified sequence opt3 from hemagglutinin__InfluenzaA__AFM72883
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcaaaaacuguacccucauagacgcucugcuuggggauccgcagugcgacggauuucagaauaagaaaugggaucuguucguggaaagaagcaaggccuauuccaacuguuaccccuaugacgucccugauuacgcaucuuugaggucgcucguggccucaagcggcacucuggaguuuaauaacgaaaguuucaauuggacagguguuacccagaacgggacguccucugcuugcauccggcgcagcaaaaauuccuuuuucucacgacugaacuggcucacucauuuaaauuuuaaauauccagcacugaacgugaccaugcccaacaaugagcaguucgacaaacuuuacauuuggggaguccaccauccugugacagauaaggaccagaucuuuuuguaugcccaagcuaguggccguauuacuguaagcaccaagagaucucagcagacaguuaucccaaacauaggcuccaggccccgggugcgcaauauuccuaccagaaucucaauuuacuggacgaucgucaaaccaggggauauccugcuaauuaacagcacuggaaaucucauagccccgagggguuacuucaagaugcagaguggcaagucuuccaucaugcggagcgacgcgcccauugggaaauguaacucggagugcaucacaccuaauggaucuauaccaaacgacaagcccuuucaaaaugugaaccgcauuaccuauggcgcauguccucgauacgugaaacagaauacucugaaacuugccacagguaugagaaacgucccagaaaagcagaccagggggaucuucggagcuaucgccggcuuuauugagaauggcugggaagggaugguugauggaugguaugguuuccggcaccaaaacuccgagggccgugggcaggcagcugaccugaagucaacgcaggccgcgaucgaucagauuaauggaaaauugaaccgccucauaggcaagaccaacgagaaguuccaccaaaucgaaaaagaguuuagugaaguggaggguaggauucaggaccuggaaaaguacguagaggauacaaaaaucgacuuauggagcuauaaugccgagcugcucguggcacuugaaaaccagcauacuaucgaucugaccgacuccgagaugaauaaguuguucgaaaagacaaagaagcagcuaagagagaacgcugaagauauggggaauggcugcuuuaaaauuuaccacaagugugacaacgccugcauaggaucuauccggaauggcacuuaugaucauaacgucuaccgagacgaggcucugaauaaccgcuuccaaauuaaagggguggagcucaagagcggauacaaagacuggauccuguggauuucauuugccaucaguugcuuccuucuguguguugcauugcucgguuuuauaaugugggccugccagaagggcaauaucagauguaacauuugcaucuga

SEQ ID NO: 131170 - RNA, 1701 nt, Artificial Sequence
  derived and/or modified sequence opt3 from hemagglutinin__InfluenzaA__AFM72894
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcgacaguccacaccagauccuagauggcaaaaacuguacccucauagacgcucugcuuggggauccgcagugcgacggauuucagaauaagaaaugggaucuguucguggaaagaagcaaggccuauuccaacuguuaccccuaugacgucccugauuacgcaucuuugaggucgcucguggccucaagcggcacucuggaguuuaauaacgaaaguuucaauuggacagguguuacccagaacgggacguccucugcuugcauccggcgcagcaaaaauuccuuuuucucacgacugaacuggcucacucaguuaaauuuuaaauauccagcacugaacgugaccaugcccaacaaugagcaguucgacaaacuuuacauuuggggaguccaucacccugugacagauaaggaccaaaucuuuuuguaugcccaggcuaguggccguauuacuguaagcaccaagagaucucagcagacaguuaucccaaacauaggcuccaggccccgggugcgcaauauuccuucaagaaucagcauuuacuggaccaucgucaaaccaggggauauccugcuaauuaacaguacgggaaaucucauagccccgagggguuacuucaagaugcaaucuggcaaguccagcaucaugcggucggacgcgcccauugggaaauguaacucugagugcaucacuccuaauggauccauaccaaacgacaagcccuuucagaaugugaaccgcauuacauauggcgcauguccucgauacgugaaacagaauacccugaaacuugccacugguaugagaaacgucccagaaaagcaaacaagggggaucuucggagcuaucgccggcuuuauugagaauggcugggaagggaugguugauggaugguaugguuuccggcaucagaacucagagggccgugggcaggcagcugaccugaagaguacccaggccgcgaucgaucaaauuaauggaaaauugaaccgccucauaggcaagacgaacgagaaguuccaccagaucgaaaaagaguuuagcgaaguggaggguaggauucaggaccuggaaaaguacguagaggauaccaaaaucgacuuaugguccuauaaugccgagcugcucguggcacuugaaaaccagcacacaaucgaucugacugacucugagaugaauaaguuguucgaaaagaccaagaagcaacuaagagagaacgcugaagauauggggaauggcugcuuuaaaauuuaccauaagugugacaacgccugcauaggaagcauccggaauggcacauaugaucacaacgucuaccgagacgaggcucugaauaaccgcuuccagauuaaagggguggagcucaagucaggauacaaagacuggauccuguggauuaguuuugccaucuccugcuuccuucuguguguugcauugcucgguuuuauaaugugggccugccagaagggcaauaucagauguaacauuugcaucuga

SEQ ID NO: 131171 - RNA, 1701 nt, Artificial Sequence
  derived and/or modified sequence opt3 from hemagglutinin__InfluenzaA__AFM72916
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcaaaaauuguacccuaaucgacgcucuccugggggauccgcagugcgacggauuucaaaacaagaaaugggaucuuuucguggaaagauccaaggccuauucuaauuguuaccccuaugacgucccugauuacgcaucgcugaggucauugguggccagcaguggcacucucgaguuuaacaaugaauccuucaacuggacagguguuacccagaaugggacgucuagcgcuugcauucggcgcuccaagaacucauuuuucagucgacugaauuggcugacucaucucaacuuuaaauauccagcauuaaaugugaccaugcccaacaacgagcaguucgacaagcuguacaucuggggaguccaccauccuggcacagauaaagaccagauuuuuccauaugcccaagcuagcggccguaucacugugucuaccaagagaucccagcagacagccauacccaauauugggucaaggccucggguacgcaacaucccaagcagaauuaguaucuacuggaccaucguuaaaccgggagauauucuuuugauaaauucuacggguaaccugaucgcgcccaggggcuacuucaagauucgguccggaaagagcucgaucaugcgcucugacgcaccuauagggaaauguaauuccggcugcauuacuccaaacgguucaauccccaaugacaagccuuuucagaacgugaaucgaaucacauauggggccuguccaagauacgucaaacaaaacacccuaaagcucgcuacuggaaugaggaaugugcccgagaaacagacacggggcauuuucggcgccaucgcaggguuuauugaaaacggaugggaggguaugguggauggcugguauggguuccgucaccagaauagugaaggacgcggccaagcugccgaccuuaagagcacccaggcggccauagaucagaucaacgguaaacuuaauagacugauugggaagacgaacgagaaguuccaccagaucgagaaagaauuuuccgaggucgaaggcaggauccaagacuuggagaaguacguugaagauaccaaaauugaccucuggucuuauaacgcagagcuguuaguggcucuggagaaucagcauacaauagaucucacugacagcgaaaugaacaagcuguucgagaaaaccaagaagcagcugcgggaaaaugccgaggauaugggaaacggcugcuuuaaaaucuaccacaagugugacaaugcuugcauugggucaauccgaaacggaacauaugaucaugacguauaccgcgacgaagccuugaauaacagauuccagauuaaagguguggagcuaaagaguggcuacaaagauugguuucuguggaucuccuucgcaauaagcugcuuucuccugugugucgcccuucugggguucaucaugugggcuugccaaaagggaaauauuagguguaacaucugcauuuga

SEQ ID NO: 131172 - RNA, 1701 nt, Artificial Sequence
  derived and/or modified sequence opt3 from hemagglutinin__InfluenzaA__AFM72927
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagacuagcuuguaugcccaggcuucuggccguaucaccguguccacaaagagaucacaacagaccguaauuccaaacaucgggagcaggccccggguucgcaauauaccuaguagaauuucuaucuacuggacgauugugaaaccaggagauauccugcuaaucaacuccauugguaaucucauagccccgaggggcuacuuuaagauccggagcgggaaaucgucuauuaugcgcuccgacgcgcccaucggaaaguguaacucagaaugcauaacuccuaauggcaguauuccaaacgacaagcccuuccagaaugucaaccgaaucacauauggugcauguccuagauacgugaaacaaaauacccugaaacuugccacugggaugaggaacgugccagagaagcagacacggggaaucuuuggcgcuauugccggcuucaucgaaaaugggugggagggaauggucgaugguugguauggcuuucgucaccagaacagcgaggggcgcggacaagcagcugaccugaaguccacccaggccgcgauugaucagauaaauggcaaauugaacagacucaucgguaagacgaacgaaaaauuccaccagauugagaaggaguucucugaaguugaagggaggauccaagaccuggagaaguacguggaggauaccaaaaucgacuuauggagcuauaaugccgaacugcucguagcacuugagaaccagcauacaauugaucugacugacucagaaaugaauaaguuguuugagaaaaccaagaaacagcuacgggaaaacgcugaggauaugggcaauggaugcuucaagauauaccacaagugugacaacgccugcaucggcaguauucgaaaugggacauaugaucauaacguguaccgcgacgaggcucugaauaacagauuucagaucaaaggagucgaacucaaguccgguuacaaagacuggauucuguggaucagcuucgccauaucuugcuuucuucuguguguggcauugcucggcuucaucaugugggccugccaaaaggggaauauuagguguaacaucugcauuuga

SEQ ID NO: 131173 - RNA, 1701 nt, Artificial Sequence
  derived and/or modified sequence opt3 from hemagglutinin__InfluenzaA__AFM72938
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagacuagcuuguaugcccaggcuucuggccguaucaccguguccacaaagagaucacaacagaccguaauuccaaacaucgggagcaggccccggguucgcaauaacccuaguagaauaucuauuuacuggacgaucgugaaaccaggagauauucugcuaaucaauuccaucgguaaccucauugccccgaggggcuacuuuaagauacggagcgggaaaucgucuaucaugcgcuccgacgcgcccauuggaaaguguaauucagaaugcaucacuccuaacggcaguauaccaaaugacaagcccuuccagaacgucaaucgaauuacauauggugcauguccuagauacgugaaacaaaacacccugaaacuugccacugggaugaggaaugugccagagaagcagacacggggaaucuuuggcgcuaucgccggcuucauugaaaacgggugggagggaauggucgaugguugguauggcuuucgucaccagaauagcgaggggcgcggacaagcagcugaccugaaguccacccaggccgcgaucgaucagauuaacggcaaauugaacagacucauagguaagacgaaugaaaaauuccaccagaucgagaaggaguucucugaaguugaagggaggauucaagaccuggagaaguacguggaggauaccaaaaucgacuuauggagcuauaacgccgaacugcucguagcacuugagaaucagcauacaaucgaucugacugacucagaaaugaacaaguuguuugagaaaaccaagaaacagcuacgggaaaaugcugaggauaugggcaacggaugcuucaagauuuaccacaagugugacaaugccugcauaggcaguauccgaaacgggacauaugaucauaauguguaccgcgacgaggcucugaacaauagauuucagauuaaaggagucgaacucaaguccgguuacaaagacuggauccuguggauuagcuucgccaucucuugcuuucuucuguguguggcauugcucggcuucauaaugugggccugccaaaaggggaacaucagguguaauauuugcaucuga

SEQ ID NO: 131174 - RNA, 1701 nt, Artificial Sequence
  derived and/or modified sequence opt3 from hemagglutinin__InfluenzaA__AFM72949
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucaguuaaaguuuaaguauccagcacugaaugugaccaugcccaacaacgagcaguucgacaaacuuuacauuuggggaguccaucacccuggcacagauaaugaccaaacuagcuuguaugcccaggcuucuggccguaucaccguguccacaaagagaucacagcagaccguaauuccaaacaucgggagcaggccccggguucgcaauaacccuaguagaauaucuauuuacuggacgaucgugaaaccaggagauauucugcuaaucaauuccaucgguaaccucauugccccgaggggcuacuuuaagauacggagcgggaaaucgucuaucaugcgcuccgacgcgcccauuggaaaguguaauucagaaugcaucacuccuaacggcaguauaccaaaugacaagcccuuccaaaacgucaaucgaauuacauauggugcauguccuagauacgugaaacagaacacccugaaacuugccacugggaugaggaaugugccagagaagcagacacggggaaucuuuggcgcuaucgccggcuucauugaaaacgggugggagggaauggucgaugguugguauggcuuucgucaucaaaauagcgaggggcgcggacaggcagcugaccugaaguccacccaggccgcgaucgaucagauuaacggcaaauugaacagacucauagguaagacgaaugaaaaauuccaccaaaucgagaaggaguucucugaaguugaagggaggauucaggaccuggagaaguacguggaggauaccaaaaucgacuuauggagcuauaacgccgaacugcucguagcacuugagaaucagcacacaaucgaucugacugacucagaaaugaacaaguuguuugagaaaaccaagaaacagcuacgggaaaaugcugaggauaugggcaacggaugcuucaagauuuaccauaagugugacaaugccugcauaggcaguauccgaaacgggacauaugaucacaauguguaccgcgacgaggcucugaacaauagauuucaaauuaaaggagucgaacucaaguccgguuacaaagacuggauccuguggauuagcuucgccaucucuugcuuucuucuguguguggcauugcucggcuucauaaugugggccugccagaaggggaacaucagguguaauauuugcaucuga

SEQ ID NO: 131175 - RNA, 1701 nt, Artificial Sequence
  derived and/or modified sequence opt3 from hemagglutinin__InfluenzaA__AFM72960
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaaguggacagguguuacccagaacgggacgucuagcgcuugcauccggcgcuccaauaacucauuuuucagucgacugaauuggcucacucauuuaaaguuuaaauauccagcacugaacgugaccaugcccaauaacgagcaguucgacaaacuuuacauuuggggaguccaccauccuggcacagauaacgaccagacuagcuuguaugcccaggcuucuggccguaucaccguguccacaaagagaucacaacagaccguaauuccaaauaucgggagcaggccccggguucgcaacauaccuaguagaauuucuaucuacuggacgauugugaagccaggagauauccugcuaaucaauuccauugguaaccucauagccccgaggggcuacuuuaaaauccggagcgggaagucgucuauuaugcgcuccgacgcgcccaucggaaaguguaauucagaaugcauaacuccuaacggcaguauuccaaaugacaaacccuuccagaacgucaaucgaaucacauauggugcauguccuagauacgugaagcaaaacacccugaaacuugccacugggaugaggaaugugccagagaagcagacacggggaaucuuuggcgcuauugccggcuucaucgaaaacgggugggagggaauggucgaugguugguauggcuuucgucaccagaauagcgaggggcgcggacaagcagcugaccugaaauccacccaggccgcgauugaucagauaaacggcaaguugaauagacucaucgguaaaacgaacgaaaaguuccaccagauugagaaggaguucucugaaguugaagggaggauccaagaccuggagaaauacguggaggauaccaagaucgacuuauggagcuauaacgccgaacugcucguagcacuugagaaucagcauacaauugaucugacugacucagaaaugaacaaauuguuugagaagaccaaaaagcagcuacgggaaaaugcugaggauaugggcaacggaugcuucaagauauaccacaaaugugacaaugccugcaucggcaguauucgaaacgggacauaugaucauaauguguaccgcgacgaggcucugaacaauagauuucagaucaagggagucgaacucaaauccgguuacaaggacuggauucuguggaucagcuucgccauaucuugcuuucuucuguguguggcauugcucggcuucaucaugugggccugccaaaaagggaacauuagguguaauaucugcauuuga

SEQ ID NO: 131176 - RNA, 1701 nt, Artificial Sequence
  derived and/or modified sequence opt3 from hemagglutinin__InfluenzaA__AFM72971
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaaguggacagguguuacccagaacgggacgucuagcgcuugcauccggcgcuccaauaacucauuuuucagucgacugaauuggcucacucaguuaaacuuuaaguauccagcacugaaugugaccaugcccaacaacgagcaguucgacaaacuuuacauuuggggaguccaucacccuggcacagauaaugaccaaacuagcuuguaugcccaggcuucuggccguaucaccguguccacaaagagaucacagcagaccguaauuccaaacaucgggagcaggccccggguucgcaauauaccuaguagaauuucuaucuacuggacgauugugaaaccaggagauauccugcuaaucaacuccauugguaaucucauagccccgaggggcuacuuuaagauccggagcgggaaaucgucuauuaugcgcuccgacgcgcccaucggaaaguguaacucagaaugcauaacuccuaauggcaguauuccaaacgacaagcccuuccaaaaugucaaccgaaucacauauggugcauguccuagauacgugaaacagaauacccugaaacuugccacugggaugaggaacgugccagagaagcagacacggggaaucuuuggcgcuauugccggcuucaucgaaaaugggugggagggaauggucgaugguugguauggcuuucgucaucaaaacagcgaggggcgcggacaggcagcugaccugaaguccacccaggccgcgauugaucagauaaauggcaaauugaacagacucaucgguaagacgaacgaaaaauuccaccaaauugagaaggaguucucugaaguugaagggaggauccaggaccuggagaaguacguggaggauaccaaaaucgacuuauggagcuauaaugccgaacugcucguagcacuugagaaccagcacacaauugaucugacugacucagaaaugaauaaguuguuugagaaaaccaagaaacagcuacgggaaaacgcugaggauaugggcaauggaugcuucaagauauaccauaagugugacaacgccugcaucggcaguauucgaaaugggacauaugaucacaacguguaccgcgacgaggcucugaauaacagauuucaaaucaaaggagucgaacucaaguccgguuacaaagacuggauucuguggaucagcuucgccauaucuugcuuucuucuguguguggcauugcucggcuucaucaugugggccugccagaaggggaauauuagguguaacaucugcauuuga

SEQ ID NO: 131177 - RNA, 1701 nt, Artificial Sequence
  derived and/or modified sequence opt3 from hemagglutinin__InfluenzaA__AFM72982
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacuccgagucuuucaauuggacagguguuacccagaacgggacgagcuccgcuugcauccggcgcucaaauaacagcuuuuucagucgacugaauuggcucacucauuuaaacuuuaaguauccagcacugaaugugaccaugcccaacaacgagcaguucgacaagcuguacauuuggggaguccaccauccuggcacagauaaagaccagaucuuuccauaugcccaggcuucuggccguauuacuguguccaccaagagaucacaacaggccguaauccccaauauagggagcaggccucggguucgcaacauuccaaguagaaucucuauuuacuggacaaucgugaaaccgggagauaucuugcugauuaauuccaccgguaaccuaauagcgcccaggggcuacuucaagauccggagcgggaaaucgucuauuaugcgcuccgacgcaccuaucggaaaguguaauucagaaugcauaacgccaaacggcaguauucccaaugacaagccuuuucagaacgucaaucgaaucacuuauggugccuguccaagauacaucaaacaaagcacacucaagcuggcuaccgggaugaggaacgugcccgagaaacagacucggggaauuuucggcgccaucgcaggcuuuauugaaaaugggugggagggaaugguggaugguugguauggcuuccgucaccagaacuccgaggggcgcggacaagcugccgaccuuaagucuacacaggcggccauagaucagaucaauggcaaacugaacagauugauugguaagaccaaugaaaaauuccaccagaucgagaaggaauuuagcgaggucgaagggaggauccaagaccucgagaaguacguugaggauacgaaaauugaccuguggucauauaacgcagaauuacugguggcucucgagaaccagcauaccauagaucuuacagacagugaaaugaauaagcuguucgagaaaacuaagaaacaguugcgggaaaacgccgaggauaugggcaauggaugcuuuaagaucuaccacaagugugacaacgcuugcauuggcuccauccgaaaugggaccuaugaucaugacguauaccgcgacgaggcccuaaacaauagauuccagauuaaaggaguggaacuuaagagcgguuacaaagauuggauccucuggauaucucuggcaaucucaugcuuucuucugugugucgccuugcucggcuucauuaugugggcuugccaaaaggggaacaucagguguaauauuugcaucuga

SEQ ID NO: 131178 - RNA, 1701 nt, Artificial Sequence
  derived and/or modified sequence opt3 from hemagglutinin__InfluenzaA__AFM72993
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccagauccuagauggcgaaaauuguacacucauagacgcccugcuuggggauccgcagugcgacggauuucaaaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacagaaugggaccucuagcgcaugcauccgccgauccaacaauucauuuuucagucgucugaacuggcucacgcauuuaaauuuuaaauauccagcccugaacgugacuaugcccaacaaugagcaguucgacaaacuuuacauuuggggagucuugcacccuggcaccuauaaggaucagaucuuucuguacgcucaagccagcggcagaauuacagugucuacuaaaaggucccagcaggcgguaaucccaaacauagggucacggccccgcguuagaaauauuccuagcaggaucaguauuuacuggaccaucgugaagccaggagacauccuacucauuaacucuacagguaaucugauagcaccgcggggcuauuucaaaauccgcuccggaaagagcucgauuaugcgaucugaugcccccaucgggaaauguaacuccgaaugcauaaccccuaauggcucaauuccaaacgacaagcccuuucagaaugucaacagaaucacguacggugcuuguccuagguaugugaagcaaaguacucuuaaacuggccacagggaugcggaaugugccagagaagcagacccguggaaucuucggcgcaauugcuggcuuuaucgaaaacgggugggagggaauggucgacgguugguacggcuuccgccaucagaauagcgaggggagaggacaagccgcggauuugaaauccacucaggccgcaauugaccagauaaacggcaagcucaauaggcugaucgguaaaacaaacgaaaaguuccaccagauugagaaagaauuuucugagguugaagggcggauccaagauuuagagaaguauguggaggacaccaagaucgaucuguggagcuacaacgcugaacuccuuguagcccuggagaaucagcacacgauugacuugaccgauucagaaaugaacaaacuauucgagaagacaaagaagcagcugcgagaaaaugcugaggacaugggcaacggaugcuuuaaaauauaucauaagugugauaaugccugcaucggcaguauucgcaacgggacuuacgaccacgauguguacagagacgaggcacucaauaacagguuccagaucaagggagucgaacugaaauccgguuauaaggacuggauucuuuggaucagcuuugccauaucuugcuuccuguuguguguggcucuccugggcuuuaucaugugggcgugccaaaaagggaauauucgguguaacaucugcauuuga

SEQ ID NO: 131179 - RNA, 1701 nt, Artificial Sequence
  derived and/or modified sequence opt3 from hemagglutinin__InfluenzaA__AFM73004
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccagauccuagauggcgaaaauuguacacucauagacgcccugcuuggggauccgcagugcgacggauuucaaaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacagaaugggaccucuagcgcaugcauccgccgauccaacaauucauuuuucagucgucugaacuggcucacgcauuuaaauuuuaaauauccagcccugaacgugacuaugcccaacaaugagcaguucgacaaacuuuacauuuggggagucuugcacccuggcaccuauaaggaucagaucuuucuguacgcucaagccagcggcagagugacaguaucuacuaaaaggucccagcaggcgguuauuccaaacaucgggucacggccccgcgugagaaauauaccuagcaggauuaguaucuacuggaccauugucaagccaggagacauccuacucaucaacucuacagguaaucugauugcaccgcggggcuauuucaaaauacgcuccggaaagagcucgaucaugcgaucugaugcccccauugggaaauguaacuccgaaugcaucaccccuaauggcucaauaccaaacgacaagcccuuucagaaugugaacagaauuacguacggugcuuguccuagguaugugaagcaaaguacucuuaaacuggccacagggaugcggaaugucccagagaagcagacccguggaaucuucggcgcaaucgcuggcuuuauugaaaacgggugggagggaaugguugacgguugguacggcuuccgccaucagaauagcgaggggagaggacaagccgcggauuugaaauccacucaggccgcaaucgaccagauuaacggcaagcucaauaggcugauagguaaaacaaacgaaaaguuccaccagaucgagaaagaauuuucugagguggaagggcggauucaagauuuagagaaguauguagaggacaccaagaucgaucuguggagcuacaacgcugaacuccuuguggcccuggagaaucagcacacgaucgacuugaccgauucagaaaugaacaaacuauucgagaagacaaagaagcagcugcgagaaaaugcugaggacaugggcaacggaugcuuuaaaauuuaucauaagugugauaaugccugcauaggcaguauccgcaacgggacuuacgaccacgaugucuacagagacgaggcacucaauaacagguuccagauuaagggaguggaacugaaauccgguuauaaggacuggauccuuuggauuagcuuugccaucucuugcuucuuucuguguguugcuuugcucggcuucauaaugugggcgugccaaaaagggaauauccgguguaacauuugcaucuga

SEQ ID NO: 131180 - RNA, 1701 nt, Artificial Sequence
  derived and/or modified sequence opt3 from hemagglutinin__InfluenzaA__AFM73015
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugauagagaggguaggaugaauuacuauuggacucugguggaacccggcgacaagauuaccuucgaggcaacagggaaccuagucguuccucgguacgccuuugcuauggaacgcaacgccggaucuggcaucauaauuuccgauaccccagugcaugacugcaauacgacuugucagacaccgaaaggugcaaucaacaccagccuccccuuccaaaauauucacccuaucacuaucgggaagugcccaaaguauguaaaaucgacaaagcugagacuugcuaccggacugaggaacgugcccucuauucagucccggggcuuguuuggcgccauagcgggguucaucgagggagguuggacgggcauggucgacgggugguacggauaucaucaccagaaugaacagggcucagguuacgccgcagaucucaaaaguacccaaaacgcuauugacaagaucacaaauaaagugaacagcguuauagagaagaugaauacucaguuuaccgccguggggaaggaguucaaccaccuggaaaaacgcauugagaauuuaaacaagaaagucgaugacggcuuccuggauaucuggacauacaaugcugaacuccuugugcuguuggagaacgaacgaacucuagacuaucaugauuccaauguaaagaaccuguacgagaaaguuagaaaccagcucaagaauaacgccaaggagaucggaaauggcuguuuugaguucuaucacaaaugcgacaacaccuguauggagucugugaagaaugggacauacgauuauccuaaauacagcgaagaggcaaagcugaacagggaagagauugacggagucaaacuugagucaacccggaucuaucagauucuggccauauacaguacuguggcuuccagcuugguccucgugguuucucugggugcgaucucauuuuggaugugcaguaauggcagcuuacaaugccguauuuguaucuga

SEQ ID NO: 131181 - RNA, 1701 nt, Artificial Sequence
  derived and/or modified sequence opt3 from hemagglutinin__InfluenzaA__AFM73025
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugaugaccaacagucauuguaccagaacgcugauaccuacguguucgucggaacaagccgcuauaguaagaaauuuaagccugagauugccauccgaccaaaagugcgugacagagaggguaggaugaauuacuauuggacucugguggaacccggcgauaagauuaccuucgaggcgacagggaaccuagucguuccucgguacgcauuugccauggaacgcaacgcuggaucuggcaucauaauuuccgacaccccagugcaugacugcaauacgacuugucagacaccgaaaggugccaucaacaccagccuccccuuccaaaauauucacccuaucacuaucgggaagugcccaaaguauguaaaaucgacaaagcugagacuugcaaccggacugaggaacgugcccucuauucagucccggggcuuguuuggcgcuauagccggguucaucgagggagguuggacgggcauggucgaugggugguacggauaucaucaccagaaugaacagggcucagguuacgcggccgaccucaaaaguacccaaaacgcaauugauaagaucacaaauaaagugaacagcguuauagagaagaugaauacucaguuuaccgcuguggggaaggaguucaaccaccuggaaaaacgcauugagaauuuaaacaagaaagucgacgauggcuuccuggacaucuggacauacaaugccgaacuccuugugcuguuggagaacgaacgaacucuagauuaucaugacuccaauguaaagaaccuguacgagaaaguuagaaaccagcucaagaauaacgcuaaggagaucggaaauggcuguuuugaguucuaucacaaaugcgauaacaccuguauggagucugugaagaaugggacauacgacuauccuaaauacagcgaagaggccaagcugaacagggaagagauugauggagucaaacuugagucaacccggaucuaucagauucuggcaauauacaguacuguggccuccagcuugguccucgugguuucucugggugcuaucucauuuuggaugugcaguaauggcagcuuacaaugccguauuuguaucuga

SEQ ID NO: 131182 - RNA, 1701 nt, Artificial Sequence; identical to SEQ ID NO: 131181
  derived and/or modified sequence opt3 from hemagglutinin__InfluenzaA__AFM73035

SEQ ID NO: 131183 - RNA, 1701 nt, Artificial Sequence
  derived and/or modified sequence opt3 from hemagglutinin__InfluenzaA__AFM73045
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgaaucaaacaagggugucaccgccgcuuguccucaugcaggggccaagaguuuuuauaaaaaucugaucuggcucgugaagaaaggaaacagcuacccaaaguuaucuaaauccuauauaaaugauaagggcaaggagguacugguucuuuggggcauccaccaccccucaacgagcgcugaccaacagaguuuguaccagaacgccgaugcguacguguucgucgggacuucucgauauuccaaaaaguuuaaaccugagauugcaauccguccaaaggugagagaccaggaaggaaggaugaauuacuauuggacccugguggagcccggugauaaaauuacauucgaagccacuggcaaccuagucguuccucgguacgcuuuugccauggagcgcaacgcagggagcggaaucauaauuucggacaccccagugcaugauugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugagcaaggaagcggcuacgcagcugaccucaaguccacccagaacgccauugaugagaucacgaauaaagugaacucuguuauagaaaagaugaauacccaguuuacagcuguggguaaagaguucaaccaccuggaaaagcgcauugagaauuuaaacaagaaagucgacgauggguuccuggacaucuggacuuacaaugccgaacuccuugugcuguuggagaacgagcgaacccuagauuaucaugacagcaauguaaagaaccuguacgaaaaaguuagaucacagcucaagaacaaugcaaaagagaucggcaacggauguuuugaguucuaucacaagugcgauaauacauguauggagagugugaagaacggcacuuacgacuauccuaaauacuccgaagaggccaagcugaauagggaggaaauugauggggucaaacuugagagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 131184 - RNA, 1701 nt, Artificial Sequence
  derived and/or modified sequence opt3 from hemagglutinin__InfluenzaA__AFM73055
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucguggaaaagggaaacagcuacccaaaauuaucuaaguccuauauaaaugacaaaggcaaggagguacugguucuuuggggcauccaccaccccucaacgagcgcugaucaacagaguuuguaccagaacgccgacgcguacguguucgucgggacuucucgauauuccaagaaauuuaagccugagauugcaauccguccaaaagugagagauagggaaggacggaugaauuacuauuggacccugguggagcccggugacaagauuacauucgaagccacuggcaaccuagucguuccucgcuacgcuuuugccauggagagaaacgcagggagcggaaucauaauuucggauaccccagugcaugacugcaauacaaccugucagacgccgaaaggcgcuaucaacacuucucuccccuuccaaaauauucacccuaucacaaucgguaagugcccaaaauauguaaaguccaccaagcugaggcuugccacugggcugcggaacgugcccucaauucagagucgcggauuguuuggcgcgauagccggcuucaucgaagggggauggacagguauggucgacggcugguacggguaucaucaccagaaugagcagggaagcggcuacgcagcugaucucaaauccacccaaaacgccauugacgagaucacgaauaaggugaacucuguuauagaaaagaugaauacccaguuuacagcuguggguaaggaguucaaccaccuggaaaaacgaauugagaauuuaaacaagaaggucgaugacggguuccuggauaucuggacuuacaaugccgaacuccuugugcuguuggagaacgagagaacccuagacuaucaugauagcaauguuaaaaaccuguacgaaaagguaaggucacagcucaaaaacaaugcaaaggagaucggcaacggauguuuugaguucuaucacaaaugcgacaauacauguauggagagugugaagaacggcacuuacgauuauccuaaguacuccgaagaggccaaacugaaucgggaggaaauugacggggucaaacuugagagcacccguaucuaucagauucuggcuauauacucuacaguggcgucaaguuugguccucgugguuagccugggagcaaucuccuuuuggaugugcucuaacgguucguuacaaugccgcauuuguaucuga

SEQ ID NO: 131185 - RNA, 1701 nt, Artificial Sequence
  derived and/or modified sequence opt3 from hemagglutinin__InfluenzaA__AFM73065
augaaggccauccuggugguccuccuuuacaccuucgcuacagcaaacgccgacacucugugcauuggcuaucacgcgaauaacagcacggauaccguugacacaguguuggagagaaauguaacugugacccauuccgucaacuuacuggaagauaaacacaaugggaagcuauguaaacucaggggaguggcuccccugcaucuugguaagugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaaaacaagcuccuggcccaaucacgauucaaacaagggugucaccgccgcuuguccucaugcaggggccaagaguuuuuauaaaaaucugaucuggcucgugaaggaaggaaacagcuacccaaaauuaucuaaguccuauauaaaugacaaaggcaaggagguacugguucuuuggggcauccaccaccccucaacgagcgcugaucaacagaguuuguaccagaacgccgacgcguacguguucgucgggacuucucgauauuccaagaaauuuaagccugagauugcaauccguccaaaagugagagauagggaaggacggaugaauuacuauuggacccugguggagcccggugacaagauuacauucgaagccacuggcaaccuagucguuccucgcuacgcuuuugccauggagagaaacgcagggagcggaaucauaauuucggauaccccagugcaugacugcaauacaaccugucagacgccgaaaggcgcuaucaacacuucucuccccuuccaaaauauucacccuaucacaaucgguaagugcccaaaauauguaaaguccaccaagcugaggcuugccacugggcugcggaacgugcccucaauucagagucgcggauuguuuggcgcgauagccggcuucaucgaagggggauggacagguauggucgacggcugguacggguaucaucaccagaaugagcagggaagcggcuacgcagcugaucucaaauccacccaaaacgccauugacgagaucacgaauaaggugaacucuguuauagaaaagaugaauacccaguuuacagcuguggguaaggaguucaaccaccuggaaaaacgaauugagaauuuaaacaagaaggucgaugacggguuccuggauaucuggacuuacaaugccgaacuccuugugcuguuggagaacgagagaacccuagacuaucaugauagcaauguuaaaaaccuguacgaaaagguaaggucacagcucaaaaacaaugcaaaggagaucggcaacggauguuuugaguucuaucacaaaugcgacaauacauguauggagagugugaagaacggcacuuacgauuauccuaaguacuccgaagaggccaaacugaaucgggaggaaauugacggggucaaacuugagagcacccguaucuaucagauucuggcuauauacucuacaguggcgucaaguuugguccucgugguuagccugggagcaaucuccuuuuggaugugcucuaacgguucguuacaaugccgcauuuguaucuga

SEQ ID NO: 131186 - RNA, 1701 nt, Artificial Sequence; identical to SEQ ID NO: 122931
  derived and/or modified sequence opt3 from hemagglutinin__InfluenzaA__AFM73477

SEQ ID NO: 131187 - RNA, 1707 nt, Artificial Sequence
  derived and/or modified sequence opt3 from hemagglutinin__InfluenzaA__AFM78567
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggagcuuuaacgacuaugaggaauugaagcaucuccuguccaggaucaaucacuucgagaaaauucagaucauuccuaagucuucguggucagaucaugaagcuagcaguggagucuccucugccuguccauaccugggcagccccuccuuuuuccggaacgugguauggcucaucaaaaagaacucaacuuauccuaccauuaaaaagaguuacaauaauacaaaccaggaggacuuacugguucuuugggguauacaccacccaaaugaugcagccgagcaaacccgcuuguaucagaaccccacuacauacaucagcauugggaccucuacgcugaaccagcggcuagugccuaagaucgcuacucguuccaaagucaauggacagucaggcagaauggaauuuuucuggaccauccucaagccaaacgacgcaauuaauuuugagagcaacggcaauuucauagccccggaauacgcuuauaaaaucgugaagaaaggggauagugccauuaugaagucugagcuggaauacggaaacugcaauacaaaaugucaaacucccaugggugcgaucaacuccagcaugccuuuucauaauauacacccacuuaccauuggcgagugccccaaguaugugaagucgaacaggcuggucuuggcaacagggcuccgaaauucuccucagcgcgaguccagaaggaaaaagcggggacuguucggcgccaucgcugguuuuaucgaagggggauggcagggcaugguugacggcugguacggguaucaucacucaaacgagcagggaagugguuacgccgcagacaaagaaagcacccaaaaggcuauugauggcgugacgaauaaaguaaacuccaucauugacaagaugaauacucaguucgaggccguggggcgcgaauuuaacaacuuagagcgaagaauagagaaucugaacaagaaaauggaagauggauuccucgacgucuggacauauaaugcggagcuucugguguugauggaaaacgagaggacccuagauuuccacgacucuaauguuaagaaccuguacgauaaagugcggcuccagcugcgugacaaugccaaggaacuuggcaacgguuguuuugaguucuaccauaaaugcgauaaugaguguauggaaagcauccgcaacgggacuuauaauuacccacaauauucagaggaagcaagacugaagagggaggagauuaguggcgucaaguuggaauccaucggaacauaccagauccucagcauuuauucuaccguggcuucaagucuggccuuagcuauaaugauggccggccugagccuauggaugugcuccaacgggucucuccagugccggaucuguauuuga

SEQ ID NO: 131188 - RNA, 1701 nt, Artificial Sequence
  derived and/or modified sequence opt3 from hemagglutinin__InfluenzaA__AFM78646
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagggguuguaccagaacgccgacgcguacguguucgucggaacuagccgcuauaguaagaaauuuaagccagagauugcaauccgacccaaagugcgugaucaggaggguagaaugaauuacuauuggacccugguggaaccuggcgacaagauuacauucgaggccacugggaaccuagucguuccaagguacgcuuuugccauggaacggaacgcaggaucuggcaucauaauuuccgauaccccggugcaugacugcaauacaaccugucaaacgcccaaaggugcuaucaacacuagccucccuuuccagaauauucacccaaucacaaucgggaagugccccaaguauguaaaaucgaccaagcugcgccuugccacuggacugagaaacgugccuucuauucaguccaggggcuuguuuggcgcgauagccggguucaucgagggagguuggacaggcauggucgacgggugguacggauaucaucaccagaaugaacaaggcucagguuacgcagcugaucucaaaaguacccagaacgccauugacgagaucacgaauaaggugaacagcguuauagagaaaaugaauacccaguuuacagcuguggggaaggaguucaaccaccuggagaagcggauugaaaauuuaaacaaaaaggucgaugacggcuuccuggauaucuggacuuacaaugccgagcuccuugugcuguuggaaaacgagcgcacccuagacuaucaugauuccaauguaaagaaccuguacgagaagguucgaucucagcucaaaaacaaugcaaaggaaaucggaaacggcuguuuugaguucuaucacaagugcgacaauacauguauggaaagcgugaaaaacgggacuuacgauuauccaaaguacucagaggaagccaaacugaauagagaggagauugacggagucaaacuugaaaguaccaggaucuaucaaauucuggcuauauacuccacaguggcgagcucuuugguccucgugguuucacugggugcaaucaguuuuuggaugugcagcaacggcuccuuacagugccggauuuguaucuga

SEQ ID NO: 131189 - RNA, 1698 nt, Artificial Sequence
  derived and/or modified sequence opt3 from hemagglutinin__InfluenzaA__AFM85179
augaaggugaaacugcucauccuucugugcaccuucacagccacuuacgcugacacgauuuguauaggcuaucacgcaaacaauagcaccgauacagucgacacuguuuuggagaagaacgugaccguaacacauuccgugaauuuacuggaaaacucucacaaugggaaacuaugccuccugaagggaaucgcgccccuucagcuggguaacuguucagucgccggcuggauuuuggggaauccugagugcgaacuccugaucaguaaagagagcugguccuacauuguggaaaccccaaacccggagaauggaacuuguuaucccggcuacuuugcugauuaugaggaacugagagagcaacucucuucgguuucaucuuucgaaagguuugagaucuucccuaaggagaguuccuggccaaaccauacagugaccggugucucugccagcugcucccacaaugggaagucaaguuuuuaccggaacuuacuguggcuuacgggcaaaaauggauuguaucccaaccugagcaagucuuacgcaaauaacaaagaaaaggaggugcuaauacucuggggcguacaucacccuccaaacaucggggaccagcgcacucuguacuauaccgaaaaugccuacguuuccguggucucaagccacuauagucgacguuucacacccgagauuacuaaaagaccuaaggugagggaucaggaaggacggaucaacuacuauuggacccuucuggagccaggugacacaauuaucuuugaggcuaauggcaacuugauagcaccgugguacgccuucgcucucucucgcggguuuggauccggcauuaucauuagcaaugcccccauggaugaaugugacgcgaagugccagaccccucaaggugcaaucaacucgucucugccauuccagaaugugcaucccgucacgaucggggaguguccuaaauauguuagauccgccaaguuaaggauggugacuggacugcggaacauuccaucaauacagagucgcggccucuuuggcgcuaucgccggguucauugaaggagguuggacaggcaugguagaugggugguacggauaccaccaucagaaugagcaaggcagcgguuaugcagcugaccagaaauccacccagaacgccaucaaugggauaacuaacaaggugaauagcgucauugaaaagaugaacacacaguuuaccgcggugggcaaagaguucaauaaauucgagcgaagaauggaaaaccuuaacaagaagguugaugacggauuucuggauaucuggacguacaaugccgaguugcuagugcugcucgaaaacgagaggacccuggacuuccacgacagcaaugucaaaaaccuuuaugaaaaggugaaaucacaacugaagaauaacgcaaaagagaucggcaaugggugcuuugaguucuaccacaaguguaacaaugaaugcauggagaguguaaagaacggaacauaugauuaccccaaauauuccgaagagagcaaguugaaucgggagaaaauugacgguguuaagcucgaaucuaugggcguguaccagauccuggcuauuuacucaacugucgccaguagcuuagugcugcuagucucccucggggcuauaucuuuuuggaugugcucgaacggaagccugcagugucguaucugcauuuga

SEQ ID NO: 131190 - RNA, 1701 nt, Artificial Sequence
  derived and/or modified sequence opt3 from hemagglutinin__InfluenzaA__AFN11846
augaagaccaucauugcccugagcuacauacucugccuuguguucgcucagaaacugcccggcaacgacaauuccacagcaacuuuguguuuagggcaccaugccgucccuaacggaacgcugguuaagaccaucacaaaugaucaaauugaggugacuaacgcgaccgaacuuguacagucuucaaguacagguagaaucugcgacagcccacacaggauucucgauggcaaaaauuguacccugaucgacgcucuacugggggauccgcauugcgacggauuucagaacaaggagugggauuuguucguggaacgguccaaagccuauucuaauuguuaccccuaugacgucccugauuacgcaucgcuccgcucacugguggccagcaguggcacucuggaguuuacaaacgaagguuucaauuggaccgggguugcucaggacggaaaguccuaugcaugcaagcgaggcucugugaaauccuuuuucagccgucucaacugguuacacaagcuggaguacaaauauccagcccuuaaugucacgaugcccaacaaugauaaguuugacaaauuguacauauggggcgugcaucacccuucaacugauagugaccaaaccagccuguacguacaggcuucugggagaguuacaguguccacuaagaggucacagcagaccgucaucccaaacauuggaagccggcccugggugcgcgguaucaguucuagaauuuccaucuauuggacaauagugaagccuggcgacauucuacucaucaauagcaccgggaaccugauugccccaaggggauacuucaaaauccggaacggcaagucgucuaucaugcgcuccgaugcgccgauugguaauuguaacucagagugcauaacgcccaaugggaguaucccuaacgacaaaccauuucaaaaugucaaccgaauuacuuauggagcaugucccagauacguuaagcagaauacacuuaaacuggccaccggcaugaggaacgugccugaaaagcagacucggggcaucuucggggcuauagccggauuuauugagaaugguugggaaggcaugguagaugggugguauggauuccgucaccagaacagcgagggcacaggucaagcagcugacuugaaauccacccaggccgcgaucgaucagaucaaugggaagcucaaccgccugauugagaagacgaaugaaaaauuucaucaaaucgagaaggaguucucugaaguggaaggcaggauucaggacuuagagaaauacgucgaggauaccaagauagaccuguggagcuauaacgccgaacuccuuguggcacuggagaaucagcacacaaucgauuugacugacucagaaaugaacaaacuauucgagagaacccggaagcagcugcgagaaaacgcugaggauaugggaaauggcugcuuuaagauuuaccauaaaugugacaacgccugcaucgggaguauccgcaauggaacauacgaccacgauguuuauagagacgaggcucucaacaauagguuccaaauuaaggguguggaacugaaauccggcuacaaggauuggauacuuuggaucagcuuugccauuucuugcuuccuguugugugucgugcuccugggguuuaucaugugggcaugccagaaaggaaacauucgguguaauaucugcauauga

SEQ ID NO: 131191 - RNA, 1701 nt, Artificial Sequence; identical to SEQ ID NO: 125546
  derived and/or modified sequence opt3 from hemagglutinin__InfluenzaA__AFN17371

SEQ ID NO: 131192 - RNA, 1701 nt, Artificial Sequence; identical to SEQ ID NO: 124685
  derived and/or modified sequence opt3 from hemagglutinin__InfluenzaA__AFN17381

SEQ ID NO: 131193 - RNA, 1701 nt, Artificial Sequence; identical to SEQ ID NO: 124685
  derived and/or modified sequence opt3 from hemagglutinin__InfluenzaA__AFN17391

SEQ ID NO: 131194 - RNA, 1701 nt, Artificial Sequence; identical to SEQ ID NO: 124685
  derived and/or modified sequence opt3 from hemagglutinin__InfluenzaA__AFN17401

SEQ ID NO: 131195 - RNA, 1701 nt, Artificial Sequence; identical to SEQ ID NO: 124685
  derived and/or modified sequence opt3 from hemagglutinin__InfluenzaA__AFN17411

SEQ ID NO: 131196 - RNA, 1701 nt, Artificial Sequence; identical to SEQ ID NO: 124685
  derived and/or modified sequence opt3 from hemagglutinin__InfluenzaA__AFN17421

SEQ ID NO: 131197 - RNA, 1701 nt, Artificial Sequence; identical to SEQ ID NO: 124776
  derived and/or modified sequence opt3 from hemagglutinin__InfluenzaA__AFN17431

SEQ ID NO: 131198 - RNA, 1701 nt, Artificial Sequence
  derived and/or modified sequence opt3 from hemagglutinin__InfluenzaA__AFN17441
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaaaggcaaguagcugguccuacauuguugagacaucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaaaggugucacagccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaaccagcgcugaucaacagaguuuguaccagaacgccgacgcguacguguucgucgggacgucucgcuauuccaaaaaguuuaaaccugagauugcaauccgaccaaaggugcgugaucaggagggaagaaugaauuacuauuggacucugguggaacccggugacaaaauuaccuucgaggccacaggcaaccuagucguuccuagguacgcuuuugccauggaacggaacgcagggagcggaaucauaauuucggauacuccagugcaugacugcaauaccacaugucaaaccccgaagggcgcuaucaacacgucucuccccuuccagaauauucacccuaucacuaucgguaagugcccaaaauauguaaaguccacaaaacugcgccuugccaccgggcugagaaacgugcccucaauucagaguaggggauuguuuggcgcgauagccggcuucaucgaagggggauggacugguauggucgacggcugguacggguaucaucaccagaaugaacaaggaagcggcuacgcagcugaucucaaguccacacagaacgccauugacgagaucaccaauaaagugaacucuguuauagagaagaugaauacgcaguuuaccgcuguggguaaggaguucaaccaccuggaaaaacggauugaaaauuuaaacaagaaagucgaugacggguuccuggauaucuggacauacaaugccgagcuccuugugcuguuggaaaacgagcgcacucuagacuaucaugauagcaauguaaagaaccuguacgagaaaguucgaucacagcucaagaacaaugcaaaggaaaucggcaacggauguuuugaguucuaucacaaaugcgacaauaccuguauggaaagugugaagaacggcacauacgauuauccuaaauacuccgaggaagccaagcugaauagagaggagauugacggggucaaacuugaaagcacuaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 131199 - RNA, 1701 nt, Artificial Sequence; identical to SEQ ID NO: 127240
  derived and/or modified sequence opt3 from hemagglutinin__InfluenzaA__AFN17451

SEQ ID NO: 131200 - RNA, 1701 nt, Artificial Sequence; identical to SEQ ID NO: 125527
  derived and/or modified sequence opt3 from hemagglutinin__InfluenzaA__AFN17467

SEQ ID NO: 131201 - RNA, 1701 nt, Artificial Sequence; identical to SEQ ID NO: 124685
  derived and/or modified sequence opt3 from hemagglutinin__InfluenzaA__AFN17477

SEQ ID NO: 131202 - RNA, 1701 nt, Artificial Sequence; identical to SEQ ID NO: 125546
  derived and/or modified sequence opt3 from hemagglutinin__InfluenzaA__AFN17487

SEQ ID NO: 131203 - RNA, 1701 nt, Artificial Sequence; identical to SEQ ID NO: 124685
  derived and/or modified sequence opt3 from hemagglutinin__InfluenzaA__AFN17497

SEQ ID NO: 131204 - RNA, 1701 nt, Artificial Sequence; identical to SEQ ID NO: 124685
  derived and/or modified sequence opt3 from hemagglutinin__InfluenzaA__AFN17507

SEQ ID NO: 131205 - RNA, 1701 nt, Artificial Sequence; identical to SEQ ID NO: 125527
  derived and/or modified sequence opt3 from hemagglutinin__InfluenzaA__AFN17517

SEQ ID NO: 131206 - RNA, 1701 nt, Artificial Sequence; identical to SEQ ID NO: 125546
  derived and/or modified sequence opt3 from hemagglutinin__InfluenzaA__AFN17527

SEQ ID NO: 131207 - RNA, 1701 nt, Artificial Sequence; identical to SEQ ID NO: 124685
  derived and/or modified sequence opt3 from hemagglutinin__InfluenzaA__AFN17537

SEQ ID NO: 131208 - RNA, 1701 nt, Artificial Sequence; identical to SEQ ID NO: 124927
  derived and/or modified sequence opt3 from hemagglutinin__InfluenzaA__AFN17547

SEQ ID NO: 131209 - RNA, 1701 nt, Artificial Sequence; identical to SEQ ID NO: 126216
  derived and/or modified sequence opt3 from hemagglutinin__InfluenzaA__AFN17557

SEQ ID NO: 131210 - RNA, 1701 nt, Artificial Sequence; identical to SEQ ID NO: 125527
  derived and/or modified sequence opt3 from hemagglutinin__InfluenzaA__AFN17567

SEQ ID NO: 131211 - RNA, 1701 nt, Artificial Sequence; identical to SEQ ID NO: 124927
  derived and/or modified sequence opt3 from hemagglutinin__InfluenzaA__AFN17574

SEQ ID NO: 131212 - RNA, 1701 nt, Artificial Sequence; identical to SEQ ID NO: 124685
  derived and/or modified sequence opt3 from hemagglutinin__InfluenzaA__AFN17580

SEQ ID NO: 131213 - RNA, 1701 nt, Artificial Sequence; identical to SEQ ID NO: 124685
  derived and/or modified sequence opt3 from hemagglutinin__InfluenzaA__AFN17586

SEQ ID NO: 131214 - RNA, 1701 nt, Artificial Sequence; identical to SEQ ID NO: 125546
  derived and/or modified sequence opt3 from hemagglutinin__InfluenzaA__AFN17595

SEQ ID NO: 131215 - RNA, 1701 nt, Artificial Sequence; identical to SEQ ID NO: 124685
  derived and/or modified sequence opt3 from hemagglutinin__InfluenzaA__AFN17605

SEQ ID NO: 131216 - RNA, 1701 nt, Artificial Sequence; identical to SEQ ID NO: 124685
  derived and/or modified sequence opt3 from hemagglutinin__InfluenzaA__AFN17615

SEQ ID NO: 131217 - RNA, 1701 nt, Artificial Sequence; identical to SEQ ID NO: 124685
  derived and/or modified sequence opt3 from hemagglutinin__InfluenzaA__AFN17625

SEQ ID NO: 131218 - RNA, 1701 nt, Artificial Sequence; identical to SEQ ID NO: 124685
  derived and/or modified sequence opt3 from hemagglutinin__InfluenzaA__AFN17635

SEQ ID NO: 131219 - RNA, 1701 nt, Artificial Sequence
  derived and/or modified sequence opt3 from hemagglutinin__InfluenzaA__AFN17645
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgggucgagauuuuuccgaagacaagcuccuggcccaaucacgauucaaacaagggugugaccgccgcuuguccucaugcaggggccaaaaguuucuauaagaaucugaucuggcucguaaagaagggaaacagcuacccaaaauuaucuaaguccuauauaaaugacaagggcaaagaaguucuggugcuuuggggcauccaccaccccucaacgagcgcugaucaacagaguuuguaccagaacgccgacgcguacgucuuuguggggacuucucgcuauuccaagaaauucaagccugagauugcaauccgaccaaaagugcgugaucaggagggaagaaugaauuacuauuggacccuggucgaacccggugacaagauuacauuugaggccacuggcaaccuaguugugccuagguacgcuuucgccauggaacggaacgcagggagcggaaucauaauuucggauaccccaguacaugacugcaauacaaccugucaaacgccgaaaggcgcuaucaacacuucucuccccuuucagaauauucacccuaucacaaucgguaagugcccaaaguaugugaaauccaccaagcugcgccuugccacugggcugagaaacguccccucaauucagaguaggggauuguucggcgcgauagccggcuuuaucgaagggggauggacagguaugguggacggcugguacggguaucaucaccagaaugaacaaggaagcggcuacgcagcugaucucaaauccacccagaacgccauugacgagaucacgaauaagguuaacucugugauagagaaaaugaauacccaguucacagcugucgguaaggaauuuaaccaccuggagaagcggauugaaaauuuaaacaaaaagguggaugacggguuccuggauaucuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuucgaguuuuaucacaagugcgacaauacauguauggaaagugucaaaaacggcacuuacgauuauccuaaguacuccgaggaagccaaacugaauagagaggagauugacggggugaaacuugaaagcaccaggaucuaucaaauucuggcuauauacucuacagucgcgucaaguuuggugcucguugugagccugggagcaaucuccuucuggaugugcucuaacgguucguuacagugccggauuuguaucuga

SEQ ID NO: 131220 - RNA, 1701 nt, Artificial Sequence; identical to SEQ ID NO: 125546
  derived and/or modified sequence opt3 from hemagglutinin__InfluenzaA__AFN17655

SEQ ID NO: 131221 - RNA, 1701 nt, Artificial Sequence; identical to SEQ ID NO: 125546
  derived and/or modified sequence opt3 from hemagglutinin__InfluenzaA__AFN17665

SEQ ID NO: 131222 - RNA, 1701 nt, Artificial Sequence
  derived and/or modified sequence opt3 from hemagglutinin__InfluenzaA__AFN17675
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucugaauccuauaucaaugacaagggcaaggaggugcugguacuuuggggcauucaccaccccucaacgagcgcugaucaacagaguuuguaccagaacgccgacgcguacguuuucguggggacuucucgcuauuccaaaaaguuuaaaccugagaucgcaauucgaccaaagguccgugaucaggaaggaagaaugaauuacuauuggacccugguggagcccggugacaaaaucacauucgaagccacuggcaaccuaguggucccuagguacgcuuuugccauggagcggaacgcagggagcggaauaauuaucucggauaccccaguucaugacugcaauacaaccugucaaacgccgaagggcgcuauuaacacuucucuccccuuccagaauauccacccuaucacaauugguaaaugcccaaaguaugugaaguccaccaaacugcgccuugccacugggcugagaaacguacccucaauacagaguaggggauuguuuggcgcgaucgccggcuucauugaagggggauggacagguaugguggacggcugguacggguaucaucaccagaaugagcaaggaagcggcuacgcagcugaucucaaguccacccagaacgccaucgacgagauaacgaauaaagucaacucugugauugaaaagaugaauacccaguuuacagcuguugguaaagaguucaaccaccuggaaaagcggaucgagaauuuaaacaagaaaguggaugacggguuccuggauaucuggacuuacaaugccgaacuccuuguccuguuggagaacgagcgcacccuagacuaucaugauagcaaugugaagaaccuguacgaaaaaguacgaucacagcucaagaacaaugcaaaagagauuggcaacggauguuuugaguucuaucacaagugcgacaauacauguauggagaguguuaagaacggcacuuacgauuauccuaaauacuccgaagaggccaagcugaauagagaggaaaucgacggggugaaacuugagagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 131223 - RNA, 1701 nt, Artificial Sequence
  derived and/or modified sequence opt3 from hemagglutinin__InfluenzaA__AFN17685
augaaggccauccuggugguccuccuuuacaccuucgcuacagcaaacgccgacacucugugcauuggcuaucacgcgaauaacagcacggauaccguugacacaauauuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaagaacucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccagggacaagaucacauucgaggccacugguaaccuaguggucccucgguacgcuuuugccauggaacgcaacgcaggcagcgggauaauuaucucggauaccccaguucaugacugcaauacaaccugucaaacgccgaaaggagcuauuaacacuucucuccccuuccagaauauccacccuaucacaauuggcaagugcccaaaguaugugaaauccaccaagcugagacuugccacuggucugaggaacguacccucaauacagagucggggguuguuuggagcgaucgccggcuucauugagggcggguggacaggaaugguggacgguugguacggcuaucaucaccagaaugaacaagggagcggauacgcagcugaucucaaauccacccagaacgccaucgacgagauaacgaauaaggucaacucugugauugagaaaaugaauacccaguuuacagcuguuggcaaggaguucaaccaccuggagaagcgcaucgaaaauuuaaacaaaaagguggaugacgguuuccuggauaucuggacuuacaaugccgagcuccuuguccuguuggaaaacgagcgaacccuagacuaucaugauagcaaugugaaaaaccuguacgagaagguaagaucacagcucaaaaacaaugcaaaggaaauugggaacggcuguuuugaguucuaucacaagugcgacaauacauguauggaaaguguuaaaaacggaacuuacgauuauccuaaguacuccgaggaagccaaacugaauagggaggagaucgacggcgugaaacuugaaagcacccggauuuaucaaauacuggcuaucuacucuacagucgcgucaaguuuggugcucgucgugagccugggggcaauuuccuuuuggaugugcucuaacggaucguuacagugccguaucuguaucuga

SEQ ID NO: 131224 - RNA, 1701 nt, Artificial Sequence; identical to SEQ ID NO: 124685
  derived and/or modified sequence opt3 from hemagglutinin__InfluenzaA__AFN17695

SEQ ID NO: 131225 - RNA, 1701 nt, Artificial Sequence; identical to SEQ ID NO: 124685
  derived and/or modified sequence opt3 from hemagglutinin__InfluenzaA__AFN17705

SEQ ID NO: 131226 - RNA, 1701 nt, Artificial Sequence; identical to SEQ ID NO: 125314
  derived and/or modified sequence opt3 from hemagglutinin__InfluenzaA__AFN17715

SEQ ID NO: 131227 - RNA, 1701 nt, Artificial Sequence
  derived and/or modified sequence opt3 from hemagglutinin__InfluenzaA__AFN17725
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccacaggugcgugaucaagagggaagaaugaauuacuauuggacccugguggaacccggugacaaaauuacauucgaggccacuggcaaccuagucguuccuagguacgcuuuugccauggaacggaacgcagggagcggaaucauaauuucggauaccccagugcaugacugcaauacaaccugucagacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccaaaaugaacagggaagcggcuacgcagcugaucucaaguccacccagaacgccauugacgagaucacgaauaaagugaacucuguuauagagaagaugaauacccaguuuacagcuguggguaaagaguucaaccaccuggaaaagcggauugaaaauuuaaacaagaaagucgaugacggguuccuggauaucuggacuuacaaugccgagcuccuugugcuguuggaaaacgagcgcacccuagacuaucaugauagcaauguaaagaaccuguacgagaaaguucgaucacaacucaagaacaaugcaaaagaaaucggcaacggauguuuugaguucuaucacaagugcgacaauacauguauggaaagugugaagaacggcacuuacgauuauccuaaauacuccgaggaagccaagcugaauagagaggagauugacggggucaaacuugaaagcaccaggaucuaucagauucuggcuauauacucuacaguggcgucaaguuugguccucgugguuagccugggagcaaucuccuuuuggaugugcucuaacgguucguuacagugccggauuuguaucuga

SEQ ID NO: 131228 - RNA, 1701 nt, Artificial Sequence; identical to SEQ ID NO: 124685
  derived and/or modified sequence opt3 from hemagglutinin__InfluenzaA__AFN17735

SEQ ID NO: 131229 - RNA, 1701 nt, Artificial Sequence; identical to SEQ ID NO: 124685
  derived and/or modified sequence opt3 from hemagglutinin__InfluenzaA__AFN17742

SEQ ID NO: 131230 - RNA, 1701 nt, Artificial Sequence; identical to SEQ ID NO: 124685
  derived and/or modified sequence opt3 from hemagglutinin__InfluenzaA__AFN17748

SEQ ID NO: 131231 - RNA, 1701 nt, Artificial Sequence; identical to SEQ ID NO: 124685
  derived and/or modified sequence opt3 from hemagglutinin__InfluenzaA__AFN17757

SEQ ID NO: 131232 - RNA, 1701 nt, Artificial Sequence; identical to SEQ ID NO: 125314
  derived and/or modified sequence opt3 from hemagglutinin__InfluenzaA__AFN17767

SEQ ID NO: 131233 - RNA, 1701 nt, Artificial Sequence; identical to SEQ ID NO: 129695
  derived and/or modified sequence opt3 from hemagglutinin__InfluenzaA__AFN17774

SEQ ID NO: 131234 - RNA, 1701 nt, Artificial Sequence; identical to SEQ ID NO: 124685
  derived and/or modified sequence opt3 from hemagglutinin__InfluenzaA__AFN17783

SEQ ID NO: 131235 - RNA, 1701 nt, Artificial Sequence; identical to SEQ ID NO: 125314
  derived and/or modified sequence opt3 from hemagglutinin__InfluenzaA__AFN17793

SEQ ID NO: 131236 - RNA, 1701 nt, Artificial Sequence; identical to SEQ ID NO: 124685
  derived and/or modified sequence opt3 from hemagglutinin__InfluenzaA__AFN17803

SEQ ID NO: 131237 - RNA, 1701 nt, Artificial Sequence; identical to SEQ ID NO: 124685
  derived and/or modified sequence opt3 from hemagglutinin__InfluenzaA__AFN17813

SEQ ID NO: 131238 - RNA, 1701 nt, Artificial Sequence
  derived and/or modified sequence opt3 from hemagglutinin__InfluenzaA__AFN17823
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucugaauccuauauaaaugacaagggcaaggagguacugguucuuuggggcauccaccaccccucaacgagcgcugaucaacagaguuuguaccagaacgccgacgcguacguguucgucgggacuucucgcuauuccaaaaaguuuaaaccugagauugcaauccgaccaaaggugcgugaucaggaaggaagaaugaauuacuauuggacccugguggagcccggugacaaaauuacauucgaagccacuggcaaccuagucguuccuagguacgcuuuugccauggagcggaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugcgccuugccacugggcugagaaacgugcccucaauucagaguaggggauuguuuggcgcgauagccggcuucaucgaagggggauggacagguauggucgacggcugguacggguaucaucaccagaaugagcaaggaagcggcuacgcagcugaucucaaguccacccagaacgccauugacgagaucacgaauaaagugaacucuguuauagaaaagaugaauacccaguuuacagcuguggguaaagaguucaaccaccuggaaaagcggauugagaauuuaaacaagaaagucgaugacggguuccuggauaucuggacuuacaaugccgaacuccuugugcuguuggagaacgagcgcacccuagacuaucaugauagcaauguaaagaaccuguacgaaaaaguucgaucacagcucaagaacaaugcaaaagagaucggcaacggauguuuugaguucuaucacaagugcgacaauacauguauggagagugugaagaacggcacuuacgauuauccuaaauacuccgaagaggccaagcugaauagagaggaaauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 131239 - RNA, 1701 nt, Artificial Sequence
  derived and/or modified sequence opt3 from hemagglutinin__InfluenzaA__AFN17833
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccuaaugcaggggccaaaaguuuuuauaagaaccugaucuggcucgugaaaaagggaaauagcuacccaaaauuaucuaaguccuauauaaacgacaagggcaaagaaguacugguucuuuggggcauccaucaccccucaacgagcgcugaucaacagaguuuguaccagaaugccgacgcguacguguucgucgggacuucucgcuauuccaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcagggagcggaaucauaauuucggauaccccagugcacgacugcaacacaaccugucaaacgccgaaaggcgcuaucaauacuucucuccccuuccagaacauucauccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaccaucagaacgaacaaggaagcggcuacgcagcugaucucaaauccacccagaaugccauugacgagaucacgaacaagguaaauucuguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucacgauagcaacgugaaaaaccuguacgagaagguucgaucacagcucaaaaauaacgcaaaggaaaucggcaauggauguuuugaguucuaucauaagugcgacaacacauguauggaaagugugaaaaauggcacuuacgauuauccuaaguacuccgaggaagccaaacugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 131240 - RNA, 1701 nt, Artificial Sequence; identical to SEQ ID NO: 129194
  derived and/or modified sequence opt3 from hemagglutinin__InfluenzaA__AFN17843

SEQ ID NO: 131241 - RNA, 1701 nt, Artificial Sequence; identical to SEQ ID NO: 124685
  derived and/or modified sequence opt3 from hemagglutinin__InfluenzaA__AFN17853

SEQ ID NO: 131242 - RNA, 1701 nt, Artificial Sequence; identical to SEQ ID NO: 124927
  derived and/or modified sequence opt3 from hemagglutinin__InfluenzaA__AFN17863

SEQ ID NO: 131243 - RNA, 1701 nt, Artificial Sequence
  derived and/or modified sequence opt3 from hemagglutinin__InfluenzaA__AFN17873
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaggaaguuggagcuacauuguugagaccuccucuucggacaacggcacuugcuauccaggugauuuuaucgacuacgaagaacucagggagcagcugucaagcgugaguuccuucgaacgguuugagauuuucccgaagacaucuagcuggcccaaucacgaucugaacaagggggucaccgccgcuuguccucaugcaggagccaaauccuuuuauaagaaucucaucugguuagugaaaaagggcaacucauacccaaaacugaguaagagcuauauaaaugacaagggcaaagaaguacuuguuuugugggggauccaccaccccucuacguccgcugaucaacagucacuguaccagaacgccgacgcguacguguucgucggaacuagccgcuauaguaagaaauuuaagccugagauugcaauccgaccaaaagugcgugaucaggaggguagaaugaauuacuauuggacccuaguggaacccggcgacaagauuacauucgaggccacugggaaccucgucguuccuagguacgcuuuugccauggaacggaacgcaggaucuggcaucauaauuuccgauaccccagugcaugacugcaauacaaccugucaaacgccgaaaggugcuaucaacacuagccugcccuuccagaauauucacccuaucacaaucgggaagugcccaaaguauguaaaaucgaccaaacuucgccuggccacuggauugagaaacgugcccucuauucaguccaggggccucuuuggcgcgauagccggguucaucgagggagguuggacaggcauggucgacgggugguacggauaucaucaccagaaugaacaaggcucagguuacgcagcugaucugaaaaguacccagaacgccauugacgagaucacgaauaaggugaacagcguuauagagaaaaugaauacccaguuuacagcuguggggaaggaguucaaccacuuagagaagcggauugaaaaucugaacaaaaaggucgaugacggcuuccucgauaucuggacuuacaaugccgagcuucugguguugcuagaaaacgagcgcacccuggacuaucaugauuccaauguaaagaaccucuacgagaagguucgaucucagcugaaaaacaaugcaaaggaaaucggaaacggcuguuuugaguucuaucacaagugcgacaauacauguauggaaagcgugaaaaacgggacuuacgauuauccuaaguacucagaggaagccaaacuuaauagagaggagauugacggagucaagcuggaaaguaccaggaucuaucaaauuuuggcuauauacuccacaguggcgagcucucucguccuggugguuucauuaggugcaaucaguuuuuggaugugcagcaacggcucccugcagugccggauuuguaucuga

SEQ ID NO: 131244 - RNA, 1701 nt, Artificial Sequence
  derived and/or modified sequence opt3 from hemagglutinin__InfluenzaA__AFN17883
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgcucaaaggcgcuaucaacacuucucugccguuccagaauauucaccccaucacaaucgguaagugcccuaaguauguaaaauccaccaaacuucgccuggccacuggguugagaaacgugccaucaauucagaguaggggacucuuuggcgcgauagccggcuucaucgaagggggauggacagguauggucgacggcugguacggguaucaucaccagaaugaacaaggaagcggcuacgcagcugaucugaaauccacccagaacgccauugacgagaucacgaauaaggugaacucuguuauagagaaaaugaauacccaguuuacagcuguggguaaggaguucaaccacuuagaaaagcggauugaaaaucugaacaaaaaggucgaugacggguuccucgauaucuggacuuacaaugccgagcuucugguguugcuagaaaacgagcgcacccuggacuaucaugauagcaauguaaagaaccucuacgagaagguucgaucacagcugaaaaacaaugcaaaggaaaucggcaacggauguuuugaguucuaucacaagugcgacaauacauguauggaaagugugaaaaacggcacuuacgauuaucccaaguacuccgaggaagccaaacuuaauagagaggagauugacggggucaagcuggaaagcaccaggaucuaucaaauuuuggcuauauacucuacaguggcgucaagucucguccuggugguuagcuuaggagcaaucuccuuuuggaugugcucuaacgguucgcugcagugccggauuuguaucuga

SEQ ID NO: 131245 - RNA, 1701 nt, Artificial Sequence; identical to SEQ ID NO: 124685
  derived and/or modified sequence opt3 from hemagglutinin__InfluenzaA__AFN17893

SEQ ID NO: 131246 - RNA, 1701 nt, Artificial Sequence
  derived and/or modified sequence opt3 from hemagglutinin__InfluenzaA__AFN17903
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgaaucaaacaagggugucaccgccgcuuguccucaugcaggggccaaaaguuuuuauaagaaucugaucuggcucgugaaaaagggaaacagcuacccaaaauuaucuaaguccuauguaaaugauaagggcaaagagguucuggugcuuuggggcauacaccaccccucaacgagcgcugaccaacagaguuuguaccagaacgccgaugcguacgucuucguggggacuucucgcuauuccaagaaauuuaagccugagaucgcaauucgaccaaaagugcgugaccaggaaggaagaaugaauuacuauuggacccuggucgagcccggugauaagaucacauucgaagccacuggcaaccuaguugugccuagguacgcuuuugccauggagcggaacgcagggagcggaauuaucauaucggacaccccaguacaugauugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugagcaaggaagcggcuacgcagcugaccucaaauccacccagaacgccaucgaugagauuacgaauaagguuaacucugugaucgaaaagaugaauacccaguuuacagcugucgguaaggaguucaaccaccuggaaaagcggauagagaauuuaaacaaaaagguggacgauggguuccuggacauuuggacuuacaaugccgaacuccuuguacuguuggagaacgagcgcacccuagauuaucaugacagcaauguuaaaaaccuguacgaaaaggugcgaucacagcucaaaaacaaugcaaaggagaucggcaacggauguuuugaguucuaucacaagugcgauaauacauguauggagagugucaaaaacggcacuuacgacuauccuaaguacuccgaagaggccaaacugaauagagaggaaaucgauggggugaaacuugagagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 131247 - RNA, 1701 nt, Artificial Sequence; identical to SEQ ID NO: 125038
  derived and/or modified sequence opt3 from hemagglutinin__InfluenzaA__AFN17919

SEQ ID NO: 131248 - RNA, 1701 nt, Artificial Sequence; identical to SEQ ID NO: 124927
  derived and/or modified sequence opt3 from hemagglutinin__InfluenzaA__AFN17929

SEQ ID NO: 131249 - RNA, 1701 nt, Artificial Sequence; identical to SEQ ID NO: 130943
  derived and/or modified sequence opt3 from hemagglutinin__InfluenzaA__AFN17939

SEQ ID NO: 131250 - RNA, 1701 nt, Artificial Sequence; identical to SEQ ID NO: 125546
  derived and/or modified sequence opt3 from hemagglutinin__InfluenzaA__AFN17949

SEQ ID NO: 131251 - RNA, 1701 nt, Artificial Sequence
  derived and/or modified sequence opt3 from hemagglutinin__InfluenzaA__AFN17959
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauguaaaugacaagggcaaagaaguucuggugcuuuggggcauacaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagaacgccaucgacgagauuacgaauaagguuaacucugugaucgagaaaaugaauacccaguuuacagcugucgguaaggaguucaaccaccuggaaaagcggauagaaaauuuaaacaaaaagguggaugacggguuccuggauauuuggacuuacaaugccgagcuccuuguacuguuggaaaacgagcgcacccuagacuaucaugauagcaauguuaaaaaccuguacgagaaggugcgaucacagcucaaaaacaaugcaaaggaaaucggcaacggauguuuugaguucuaucacaagugcgacaauacauguauggaaagugucaaaaacggcacuuacgauuauccuaaguacuccgaggaagccaaacugaauagagaggagaucgacggggugaaacuugaaagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 131252 - RNA, 1701 nt, Artificial Sequence; identical to SEQ ID NO: 126367
  derived and/or modified sequence opt3 from hemagglutinin__InfluenzaA__AFN17969

SEQ ID NO: 131253 - RNA, 1701 nt, Artificial Sequence; identical to SEQ ID NO: 125546
  derived and/or modified sequence opt3 from hemagglutinin__InfluenzaA__AFN17979

SEQ ID NO: 131254 - RNA, 1701 nt, Artificial Sequence
  derived and/or modified sequence opt3 from hemagglutinin__InfluenzaA__AFN17989
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagguaaaaugaauacccaguuuacagcuguggggaaggaguucaaccaccuggaaaagcggauugagaauuuaaacaaaaaggucgaugacggcuuccuggauaucuggacuuacaaugccgaacuccuugugcuguuggagaacgaacgcacccuagacuaucaugauagcaauguaaagaaccuguacgagaagguucgaucacagcucaaaaacaaugcaaaggagaucggaaacggcuguuuugaguucuaucacaagugcgacaauacauguauggaaagugugaaaaacgggacuuacgauuauccuaaguacuccgaagaggccaaacugaauagagaagagauugacggagucaaacuugagagcaccaggaucuaucaaauucuggcuauauacucuacaguggcgucaaguuugguccucgugguuagccugggugcaaucuccuuuuggaugugcucuaacggcucguuacagugccggauuuguaucuga

SEQ ID NO: 131255 - RNA, 1701 nt, Artificial Sequence; identical to SEQ ID NO: 124685
  derived and/or modified sequence opt3 from hemagglutinin__InfluenzaA__AFN17999

SEQ ID NO: 131256 - RNA, 1701 nt, Artificial Sequence
  derived and/or modified sequence opt3 from hemagglutinin__InfluenzaA__AFN18019
augaaggccauccuggugguccuccuuuacaccuucgcuacagcaaaagccgacacucugugcauuggcuaucacgcgaacaauagcacggauaccguugacacaguguuggagaagaacguaacugugacccauuccgucaauuuacuggaagauaaacacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauguucccgaagacaagcuccuggcccaaccacgauucaaauaaaggugucaccgccgcuuguccucaugcaggggccaagaguuuuuauaaaaaccugauuuggcucgugaagaaaggaaauagcuacccaaaguuaucuaaguccuauaucaacgacaaaggcaaggaaguacugguucuuuggggcauacaccaccccucaacgagcgcugaucaacagaguuuguaccagaaugccgacgcguacguguucgucgggacuucucgcuauuccaaaaaguuuaaaccugagaucgcaauucgaccaaaggugcgugaucaggagggaagaaugaacuacuauuggacccugguggaacccggugacaaaaucacauucgaggccacuggcaaucuagucguuccuagguacgcuuuugccauggaacggaacgcagggagcggaauuaucauaucggauaccccagugcaugacugcaacacaaccugucaaacgccgaagggcgcuauuaauacuucucuccccuuccagaacauccacccuauuacaaucgguaagugcccaaaauauguaaaguccaccaaacugcgccuugccacugggcugagaaaugugcccucaauccagaguaggggauuguuuggcgcgauugccggcuucauagaagggggauggacagguauggucgacggcugguacggguaucaucaccagaacgaacaaggaagcggcuacgcagcugaucucaaguccacccagaaugccaucgacgagauuacgaacaaaguuaauucugugaucgagaagaugaacacccaguuuacagcuguggguaaggaguucaaucaccuggaaaaacggauagaaaacuuaaauaagaaagucgaugacggguuccuggauauuuggacuuacaacgccgagcuccuugugcuguuggaaaaugagcgcacccuagacuaucaugauagcaacguaaagaaucuguacgagaaaguucgaucacagcucaagaacaacgcaaaggaaaucggcaauggauguuuugaguucuaucacaaaugcgacaacacauguauggaaagugugaagaauggcacuuacgauuauccuaaauacuccgaggaagccaagcugaacagagaggagaucgacggggucaaacuugaaagcaccaggauuuaucaaauccuggcuauuuacucuacaguggcgucaaguuugguccucgugguuagccugggagcaauauccuuuuggaugugcucuaaugguucguuacagugccggaucuguauuuga

SEQ ID NO: 131257 - RNA, 1701 nt, Artificial Sequence; identical to SEQ ID NO: 125546
  derived and/or modified sequence opt3 from hemagglutinin__InfluenzaA__AFN18039

SEQ ID NO: 131258 - RNA, 1701 nt, Artificial Sequence; identical to SEQ ID NO: 124685
  derived and/or modified sequence opt3 from hemagglutinin__InfluenzaA__AFN18049

SEQ ID NO: 131259 - RNA, 1701 nt, Artificial Sequence
  derived and/or modified sequence opt3 from hemagglutinin__InfluenzaA__AFN18059
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaucacagcucaaaaacaaugcaaaggaaaucggcaacggauguuuugaguucuaucacaagugcgacaaugccuguauggaaagugugaaaaacggcacauacgauuauccuaaguacuccgaggaagcuaaacugaauagagaggagauugacggggucaaacuugaaagcacuaggaucuaucaaauucuggcgauauacucuaccguggcaucaaguuugguccucgugguuagccugggagccaucuccuuuuggaugugcucuaacgguucguuacagugccggauuuguaucuga

SEQ ID NO: 131260 - RNA, 1701 nt, Artificial Sequence; identical to SEQ ID NO: 124685
  derived and/or modified sequence opt3 from hemagglutinin__InfluenzaA__AFN18078

SEQ ID NO: 131261 - RNA, 1701 nt, Artificial Sequence
  derived and/or modified sequence opt3 from hemagglutinin__InfluenzaA__AFN18088
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggugcggaacgccgggagcggaaucauaauuucggauacaccaguacaugacugcaauaccacgugucaaacuccgaaaggcgcaaucaacacaucucuccccuuccagaauauucacccuaucaccaucgguaagugcccaaaguaugugaaauccacuaagcugcgccuugcuacagggcugagaaacguccccucaauucagaguaggggauuguuuggcgccauagcgggcuucaucgaagggggauggaccgguaugguggacggcugguacggguaucaucaccagaaugagcaaggaagcggcuacgccgcagaucucaaauccacgcagaacgcuauugacgaaaucaccaauaagguuaacucugugauagagaaaaugaauacacaguuuacugccgucgguaaggaguucaaccaccuggaaaagcggauugagaauuuaaacaaaaagguggaugacggguuccuggauaucuggaccuacaaugcugaacuccuuguacuguuggagaacgaacgcacacuagacuaucaugauagcaauguuaaaaaccuguacgagaaggugcgaucacagcucaaaaacaaugccaaggagaucggcaacggauguuuugaguucuaucacaagugcgacaauacuuguauggagagugucaaaaacggcaccuacgauuauccuaaguacuccgaagaggcaaaacugaauagagaagagauugacggggugaaacuugagagcacaaggaucuaucaaauucuggccauauacucuaccgucgcuucaaguuuggugcucguugugagccugggagcgaucuccuuuuggaugugcucuaacgguucguuacagugccggauuuguaucuga

SEQ ID NO: 131262 - RNA, 1701 nt, Artificial Sequence
  derived and/or modified sequence opt3 from hemagglutinin__InfluenzaA__AFN18098
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcaauuuuauugauuacgaggagcucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccaaaauuaucuaaguccuauaucaacgauaagggcaaagaagugcugguacuuuggggcauucaccaccccucaacgagcgcugaccaacagaguuuguaccagaaugccgaugcguacguuuucguggggacuucucgcuauuccaagaaauuuaagccugagaucgcaauucgaccaaaaguccgugaccaggagggaagaaugaacuacuauuggacccugguggaacccggugauaagaucacauucgaggccacuggcaaccuaguggucccuagguacgcuuuugccguugaacggaaugcagggagcggaauaauuaucucggacaccccagugcaugauugcaacacaaccugucaaacgccgaaaggcgcuauuaauacuucucuccccuuccagaacauccacccuaucacaauugguaagugcccaaaguauguaaaauccaccaagcugcgccuugccacugggcugagaaaugugcccucaauacagaguaggggauuguuuggcgcgaucgccggcuucauugaagggggauggacagguauggucgacggcugguacggguaucaucaccagaacgaacaaggaagcggcuacgcagcugaccucaaauccacccagaaugccaucgaugagauaacgaacaagguaaauucuguuauugagaaaaugaacacccaguuuacagcuguggguaaggaguucaaucaccuggaaaagcggaucgaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaauuggcaauggauguuuugaguucuaucacaagugcgauaacacauguauggaaagugugaaaaauggcacuuacgacuauccuaaguacuccgaggaagccaaacugaacagagaggagaucgauggggucaaacuugaaagcaccaggauuuaucaaauacuggcuaucuacucuacaguggcgucaaguuugguccucgugguuagccugggagcaauuuccuuuuggaugugcucuaaugguucguuacagugccggaucuguaucuga

SEQ ID NO: 131263 - RNA, 1701 nt, Artificial Sequence
  derived and/or modified sequence opt3 from hemagglutinin__InfluenzaA__AFN18105
augaaggccauccugauugugcuccuuuacaccuucgcuacagcaaacgccgacacucugugcauaggcuaucacgcgaauaacagcacggauaccgucgacacaguuuuggagaagaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaacugucaaaccccgaaaggcgcuauuaauacgucucuccccuuccagaacauccacccuaucacuauugguaagugcccaaaguaugugaaauccacaaagcugcgccuugccaccgggcugagaaauguacccucaauacagaguaggggauuguuuggcgcgaucgccggcuucauugaagggggauggacugguaugguggacggcugguacggguaucaucaccagaacgaacaaggaagcggcuacgcagcugaucucaaauccacacagaaugccaucgacgagauaaccaacaaggucaauucugugauugagaaaaugaacacgcaguuuaccgcuguugguaaggaguucaaucaccuggaaaagcggaucgaaaacuuaaauaaaaagguggaugacggguuccuggauaucuggacauacaacgccgagcuccuuguccuguuggaaaaugagcgcacucuagacuaucaugauagcaacgugaaaaaccuguacgagaagguacgaucacagcucaaaaauaacgcaaaggaaauuggcaauggauguuuugaguucuaucacaagugcgacaacaccuguauggaaaguguuaaaaauggcacauacgauuauccuaaguacuccgaggaagccaaacugaacagagaggagaucgacggggugaaacuugaaagcacuaggauuuaucaaauacuggcuaucuacucuaccgucgcgucaaguuuggugcucgucgugagccugggagcaauuuccuuuuggaugugcucuaaugguucguuacagugccggaucuguaucuga

SEQ ID NO: 131264 - RNA, 1701 nt, Artificial Sequence; identical to SEQ ID NO: 124927
  derived and/or modified sequence opt3 from hemagglutinin__InfluenzaA__AFN18107

SEQ ID NO: 131265 - RNA, 1701 nt, Artificial Sequence; identical to SEQ ID NO: 131259
  derived and/or modified sequence opt3 from hemagglutinin__InfluenzaA__AFN18117

SEQ ID NO: 131266 - RNA, 1701 nt, Artificial Sequence; identical to SEQ ID NO: 124685
  derived and/or modified sequence opt3 from hemagglutinin__InfluenzaA__AFN18119

SEQ ID NO: 131267 - RNA, 1701 nt, Artificial Sequence
  derived and/or modified sequence opt3 from hemagglutinin__InfluenzaA__AFN18121
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggcccgcaguuuuuauaaaaaucugaucuggcucgugaagaaaggaaacagcuacccaaaguuaucuaaauccuauauaaaugacaagggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggugcgcaacgcagggagcggaaucauaauuucggauaccccaguacaugacugcaauacaaccugucaaacgccgaagggcgcuaucaacacuucucuccccuuccagaauauucacccuaucacaaucgguaaaugcccaaaguaugugaaguccaccaaacugagacuugccacugggcugaggaacguccccucaauucagagucggggauuguuuggcgcgauagccggcuucaucgaagggggauggacagguaugguggacggcugguacggguaucaucaccagaaugagcaaggaagcggcuacgcagcugaucucaaguccacccagaacgccauugacgaaaucacgaauaaaguuaacucugugauagagaagaugaauacccaguuuacagcugucgguaaagaguucaaccaccuggaaaagcgcauugagaauuuaaacaagaaaguggaugacggguuccuggauaucuggacuuacaaugccgaacuccuuguacuguuggagaacgaacgaacccuagacuaucaugauagcaauguuaagaaccuguacgagaaagugagaucacagcucaagaacaaugcaaaagagaucggcaacggauguuuugaguucuaucacaagugcgacaauacauguauggagagugucaagaacggcacuuacgauuauccuaaauacuccgaagaggccaagcugaauagggaagagauugacggggugaaacuugagagcacccggaucuaucaaauucuggcuauauacucuacagucgcgucaaguuuggugcucguugugagccugggagcaaucuccuuuuggaugugcucuaacgguucguuacagugccguauuuguaucuga

SEQ ID NO: 131268 - RNA, 1701 nt, Artificial Sequence; identical to SEQ ID NO: 131259
  derived and/or modified sequence opt3 from hemagglutinin__InfluenzaA__AFN18133

SEQ ID NO: 131269 - RNA, 1701 nt, Artificial Sequence; identical to SEQ ID NO: 130943
  derived and/or modified sequence opt3 from hemagglutinin__InfluenzaA__AFN18135

SEQ ID NO: 131270 - RNA, 1701 nt, Artificial Sequence; identical to SEQ ID NO: 125527
  derived and/or modified sequence opt3 from hemagglutinin__InfluenzaA__AFN18137

SEQ ID NO: 131271 - RNA, 1701 nt, Artificial Sequence
  derived and/or modified sequence opt3 from hemagglutinin__InfluenzaA__AFN18139
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagggguuguaccagaacgccgacgcguacguguucgucggaaguucucgcuauuccaaaaaguuuaaaccugagauugcaauccgaccaaaggugcgugaucaggaagguagaaugaauuacuauuggacucugguggagcccggcgacaaaauuaccuucgaagccacagggaaccuagucguuccuagguacgcuuuugccauggagcggaacgcaggaagcggcaucauaauuucggauacuccagugcaugacugcaauaccacaugucaaaccccgaagggugcuaucaacacgucucuccccuuccacaauauucauccuaucacuaucgggaaaugcccaaaguauguaaaguccacaaaacugcgccuugccaccggacugagaaacgugcccucaauucagaguaggggcuuguuuggcgcgauagccggguucaucgaaggagguuggacuggcauggucgacgggugguacggauaucaccaccagaaugagcagggcagcgguuacgcagcugaucucaaguccacacaaaacgccauugacgagaucaccaauaaagugaacucuguuauagaaaagaugaauacgcaguuuaccgcuguggggaaagaguucaaccaucuggaaaagcggauugagaauuuaaacaagaaagucgaugacggcuuccuggauaucuggacauacaaugccgaacuccuugugcuguuggagaacgagcgcacucuagacuaucacgauagcaauguaaagaaccuguacgaaaaaguucgaucacagcucaagaacaaugcaaaagagaucggaaacggcuguuuugaguucuaucauaagugcgacaauaccuguauggaaagugugaagaacgggacauacgauuauccuaaauacuccgaagaggccaagcugaauagagaggaaauugacggagucaaacuugagagcacuaggaucuaucagauucuggcuauauacucuaccguggcgucaaguuugguccucgugguuagccugggugcaaucuccuuuuggaugugcucuaacggcucguuacaaugccggauuuguaucuga

SEQ ID NO: 131272 - RNA, 1701 nt, Artificial Sequence; identical to SEQ ID NO: 131267
  derived and/or modified sequence opt3 from hemagglutinin__InfluenzaA__AFN18141

SEQ ID NO: 131273 - RNA, 1701 nt, Artificial Sequence; identical to SEQ ID NO: 125546
  derived and/or modified sequence opt3 from hemagglutinin__InfluenzaA__AFN18148

SEQ ID NO: 131274 - RNA, 1701 nt, Artificial Sequence; identical to SEQ ID NO: 125849
  derived and/or modified sequence opt3 from hemagglutinin__InfluenzaA__AFN18155

SEQ ID NO: 131275 - RNA, 1701 nt, Artificial Sequence
  derived and/or modified sequence opt3 from hemagglutinin__InfluenzaA__AFN18157
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucaggaaacggcacuugcuauccaggugacuuuaucgauuacgaagaacucagggagcagcugagcaguguguccucuuucgaacgguuugagauuuucccgaagacaagcuccuggcccaaucacgacucaaacaagggggucaccgccgcuuguccucaugcaggagccaaaaguuuuuauaagaaucugaucuggcucgugaaaaagggcaacagcuacccaaaauuaucuaaguccuauauaaaugauaagggcaaagaaguacugguucuuugggggauccaccaccccucaacgagcgcugaccaacagaguuuguaccagaacgccgaugcguacgcauucgugggaacuucucgcuauuccaagaaauuuaagccugagauugccauccgaccaaaaguccgugaccaggaggguagaaugaauuacuauuggacccugguggaacccggcgauaagauuacauucgaggcuacugggaaccuaguggucccuagguacgccuuugcaauggaacggaacgcuggaagcggcaucauaauuucggacaccccaguucaugauugcaauacaaccugucaaacgccgaaaggugccaucaacacuucucuccccuuccagaauauucacccuaucacaaucgggaagugcccaaaguaugugaaauccaccaagcugcgccuugcgacuggacugagaaacguacccucaauucagaguaggggcuuguuuggcgccauagcaggguucaucgagggagguuggacaggcaugguggacgggugguacggauaucaucaccagaaugaacaaggcagcgguuacgcugccgaccucaaauccacccagaacgcuauugaugagaucacgaauaaggucaacucugugauagagaaaaugaauacccaguuuacagccguugggaaggaguucaaccaccuggagaagcggauugaaaauuuaaacaaaaagguggacgauggcuuccuggacaucuggacuuacaaugcagagcuccuuguccuguuggaaaacgagcgcacccuagauuaucaugacagcaaugugaaaaaccuguacgagaagguacgaucacagcucaaaaacaaugccaaggaaaucggaaacggcuguuuugaguucuaucacaagugcgauaauacauguauggaaaguguuaaaaacgggacuuacgacuauccuaaguacuccgaggaagcuaaacugaauagagaggagauugauggagugaaacuugaaagcaccaggaucuaucaaauucuggcgauauacucuacagucgcaucaaguuuggugcucgucgugagccugggugccaucuccuuuuggaugugcucuaacggcucguuacagugccggauuuguaucuga

SEQ ID NO: 131276 - RNA, 1701 nt, Artificial Sequence
  derived and/or modified sequence opt3 from hemagglutinin__InfluenzaA__AFN18159
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcagggaguaagagcuuuuauaaaaaucugaucuggcucgugaagaaaggaaacucuuacccaaaguuauccaaaucauauauaaaugacaagggcaaggagguacugguucuuuggggcauccaccaccccagcacgagugccgaucaacagucuuuguaccagaacgcugacgccuacguguucgucggguccagccgcuauucgaaaaaguuuaaaccugagauugcgauccgaccaaaggugcgugaucaggaaggaagaaugaauuacuauuggacucugguggagcccggugacaaaauuaccuucgaagcaacaggcaaccuagucguuccuagguacgccuuugcuauggagcggaacgccgggucuggaaucauaauuuccgauacuccagugcaugacugcaauaccacaugucaaaccccgaagggcgcaaucaacacgucacuccccuuccacaauauucauccuaucacuaucgguaaaugcccaaaguauguaaagaguacaaaacugcgccuugcuaccgggcugagaaacgugcccagcauucaguccaggggauuguuuggcgccauagcgggcuucaucgaagggggauggacugguauggucgacggcugguacggguaucaccaccagaaugagcagggaucuggcuacgccgcagaucucaagagcacacaaaacgcuauugacgagaucaccaauaaagugaacucaguuauagaaaagaugaauacgcaguuuaccgccguggguaaagaguucaaccaucuggaaaagcggauugagaauuuaaacaagaaagucgaugacggguuccuggauaucuggacauacaaugcugaacuccuugugcuguuggagaacgagcgcacucuagacuaucacgauaguaauguaaagaaccuguacgaaaaaguucgaaaccagcucaagaauaacgccaaagagaucggcaauggauguuuugaguucuaucauaagugcgacaacaccuguauggaauccgugaagaauggcacauacgauuauccuaaauacagcgaagaggcaaagcugaacagagaggaaauugacggggucaaacuugagucuacuaggaucuaucagauucuggccauauacucaaccguggcuaguagcuugguccucgugguuucccugggagcgaucucuuuuuggaugugcucgaaugguagcuuacaaugccggauuuguaucuga

SEQ ID NO: 131277 - RNA, 1701 nt, Artificial Sequence
  derived and/or modified sequence opt3 from hemagglutinin__InfluenzaA__AFN18164
augaaggccauccuggugguccuccuuuacaccuucgcuacaacuaacgcagacacgcugugcauuggcuaucacgccaauaacagcaccgauacaguugacacuguguuggagaaaaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcgccgaucaacagaguuuguaccagaacgcugacgccuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuaaucgucccuagguacgccuuugcuauggaacggaacgccgggagcggaauaauuaucucgaauacaccaguucaugauugcaacaccacgugucaaacuccgaaaggcgcaauuaauacaucucuccccuuccagaacauccacccuaucaccauugguaagugcccaaaguaugugaaauccacuaagcugcgccuugcuacagggcugagaaauguacccucaauacagaguaggggauuguuuggcgccaucgcgggcuucauugaagggggauggaccgguaugguggacggcugguacggguaucaucaccagaacgaacaaggaagcggcuacgccgcagaccucaaauccacgcagaaugcuaucgauaagauaaccaacaaagucaauucugugauugagaagaugaacacacaguuuacugccguugguaaggagcugaaucacuuagaaaaacggaucgagaaccugaauaagaaaguggacgauggguuccucgacaucuggaccuacaacgcugaacuucuggucuugcuagagaaugaacgcacacuggauuaucaugacagcaacgugaagaaccucuacgagaaaguacgaucacagcugaagaauaacgccaaggagauuggcaauggauguuucgaauuuuaucacaaaugcgauaacacuuguauggagaguguuaagaauggcaccuacgacuauccuaaauacuccgaagaggcaaaacuuaacagagaagagaucgauggggugaagcuggagagcacaaggauuuaucaaauauuggccgucuacucuaccguggcuucaagucucguccuggugguuagcuuaggagcgaucuccuucuggaugugcucuaaugguucgcugcagugccggauuuguaucuga

SEQ ID NO: 131278 - RNA, 1701 nt, Artificial Sequence
  derived and/or modified sequence opt3 from hemagglutinin__InfluenzaA__AFN18171
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacucugggaaacuauguaagcucagaggaguggcuccccugcaucuugguaaaugcaauauagccggcuggauccuggggaacccugagugugaaucauugaguacagcaagcuccuggucuuacauuguugagaccucgucaagcgacaauggaaagugcuauccaggcgauuuuaucgacuacgaggagcucagggagcagcugaguuccgugucuagcuucgaacgguuugagauuuucccgaagacuuccucauggcccaaccacgauaguaauaaaggugucacagccgcuuguccucaugcaggggccaagagcuuuuauaaaaaccugaucuggcucgugaagaaaggaaauucuuacccaaaguuauccaagucauauauaaacgacaaaggcaaggaaguacugguucuuuggggcauccaccaccccagcaccagugcugaucaacagucuuuguaccagaaugccgacgcguacguguucgucgggacguccaaauauagcaagaaauuuaagccugagauugcaauccgcccaaaagugcgagaucaggagggacguaugaacuacuauuggacucugguggaacccggugacaagauuaccuucgaggccacaggcaaucuagucguuccuagauacgcuuuugccauggaaaggaacgcagggucgggaaucauaauuucugauacuccagugaaggacugcaacaccacaugucaaaccccgaaaggcgcuaucaauacgucccuccccuuccagaacauucauccuaucacuaucgguaagugcccaaaauauguaaagucaacaaaacugcggcuugccaccgggcugcgcaaugugcccaguauucagagcagaggauuguuuggcgcgauagccggcuucaucgaagggggauggacugguauggucgacggcugguacggguaucaccaucagaacgaacaaggauccggcuacgcagcugaucucaagucuacacagaaugccauugacgagaucaccaacaaggugaauagcguuauagagaaaaugaacacgcaguuuaccgcuguggguaaggaauuuaaucaccuggagaaaaggauugaaaacuuaaauaagaaagucgaugacggguuccuggauaucuggacauacaacgccgagcuccuugugcuguuggaaaaugagcggacucuagacuaucacgauucaaacguaaagaaucuguacgagaagguucgcagucagcucaaaaacaacgcaaaggaaaucggcaauggauguuucgaguucuaucauaaaugcgacaacaccuguauggaauccgugaagaauggcacauacgauuauccuaaauacagcgaggaagccaagcugaaccgagaggagauugacggggucaaacuugaaucuacuagaaucuaucaaauucuggcuauauacucaaccguggcgaguagcuugguccucgugguuucccugggagcaaucucuuuuuggaugugcucgaaugguagcuuacagugcaggauuuguaucuga

SEQ ID NO: 131279 - RNA, 1701 nt, Artificial Sequence
  derived and/or modified sequence opt3 from hemagglutinin__InfluenzaA__AFN18176
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuacucgucccuagguacgcuuuugccauggaacggaacgcagggagcggaaucauaauuucggauaccccaguucaugacugcaauacaaccugucaaacgccgaaaggcgcuaucaacacuucucugcccuuccagaauauucacccuaucacaaucgguaagugcccaaaguaugugaaauccaccaaacuucgccuggccacuggguugagaaacauucccucaauacagaguaggggacucuuuggcgcgaucgccggcuucauugaagggggauggacagguaugguagacggcugguacggguaucaucaccagaaugaacaaggaagcggcuacgcagcugaucugaaauccacccagaacgccaucgacgagauaacgaauaaggugaacucugucauugagaaaaugaauacccaguuuacagcuguggguaaggaguucaaccacuuagaaaagcggaucgaaaaucugaacaaaaagguugaugacggguuccucgauaucuggacuuacaaugccgagcuucugguguugcuagaaaacgagcgcacccuggacuaucaugauagcaaugucaaaaaccucuacgagaaggugcgaucacagcugaaaaacaaugcaaaggaaauuggcaacggauguuuugaguucuaucacaagugcgacaauacauguauggaaaguguaaagaacggcacuuacgauuauccuaaguacuccgaggaagccaaacuuaauagagaggagaucgacgggguuaagcuggaaagcaccaggauuuaucaaauauuggcuaucuacucuacaguggcgucaagucucguccugguggucagcuuaggagcaauuuccuuuuggaugugcucuaacgguucgcugcagugccggaucuguaucuga

SEQ ID NO: 131280 - RNA, 1701 nt, Artificial Sequence
  derived and/or modified sequence opt3 from hemagglutinin__InfluenzaA__AFN18183
augaaggccauccuggugguccuccuuuacaccuucgcuacagcaaacgccgacacucugugcauuggcuaucacgcgaauaacagcacggauaccguugacacaauauuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaauggugccuagguacgcuuuugccauggaacggaacgcagggagcggaauaauuaucucggauaccccaguccaugacugcaauacaaccugucaaacgccgaaaggcgcuauuaacacuucucuccccuuccagaauauccacccuaucacaauugguaagugcccaaaguauguuaaauccaccaagcugcgccuugccacugggcugagaaacgugcccucaauacagaguaggggauuguuuggcgcgaucgccggcuucauugaagggggauggacagguaugguagacggcugguacggguaucaucaccagaaugaacaaggaagcggcuacgcagcugaucucaaauccacccagaacgccaucgacgagauaacgaauaaggugaacucugucauugagaaaaugaauacccaguuuacagcuguggguaaggaguucaaccaccuggaaaagcggaucgaaaauuuaaacaaaaagguugaugacggguuccuggauaucuggacuuacaaugccgagcuccuugugcuguuggaaaacgagcgcacccuagacuaucaugauagcaaugucaaaaaccuguacgagaaggugcgaucacagcucaaaaacaaugcaaaggaaauuggcaacggauguuuugaguucuaucacaagugcgacaauacauguauggaaaguguaaagaacggcacuuacgauuauccuaaguacuccgaggaagccaaacugaauagagaggagaucgacgggguuaaacuugaaagcaccaggauuuaucaaauacuggcuaucuacucuacaguggcgucaaguuugguccucguggucagccugggagcaauuuccuuuuggaugugcucuaacgguucguuacagugccggaucuguaucuga

SEQ ID NO: 131281 - RNA, 1701 nt, Artificial Sequence; identical to SEQ ID NO: 126237
  derived and/or modified sequence opt3 from hemagglutinin__InfluenzaA__AFN18195

SEQ ID NO: 131282 - RNA, 1701 nt, Artificial Sequence; identical to SEQ ID NO: 124685
  derived and/or modified sequence opt3 from hemagglutinin__InfluenzaA__AFN18200

SEQ ID NO: 131283 - RNA, 1701 nt, Artificial Sequence
  derived and/or modified sequence opt3 from hemagglutinin__InfluenzaA__AFN18207
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagagccugaucuggcucgugaaaaagggaaauucuuacccaaaauuauccaagucauauauaaacgacaagggccgcgaaguacugguucuuuggggcauccaccaccccagcacgagugcugaucaacagucuuuguaccagaaugccgacgcguacguguucgucgggacuucccgauauagcaaaaaguuuaaaccugagauugcaauccguccaaaggugagagaucaggagggaaggaugaacuacuauuggacccugguggaacccggugacaaaauuacauucgaggccacuggcaaucuagucguuccucgguacgcuuuugccauggaacgcaacgcagggucgggaaucauaauuucugauaccccagugcaugacugcaacacaaccugucaaacgccgaagggcgcuaucaauacuucccuccccuuccagaacauucacccuaucacaaucgguaaaugcccaaaguauguaaagucaaccaaacugagacuugccacugggcugaggaaugugcccaguauucagagccggggauuguuuggcgcgauagccggcuucaucgaagggggauggacagguauggucgacggcugguacggguaucaucaccagaacgaacaaggauccggcuacgcagcugaucucaagucuacccagaaugccauugacgagaucacgaacaaagugaauagcguuauagagaagaugaacacccaguuuacagcuguggguaaagaguucaaucaccuggaaaagcgcauugaaaacuuaaauaagaaagucgaugacggguuccuggauaucuggacuuacaacgccgagcuccuugugcuguuggaaaaugagcgaacccuagacuaucaugauucaaacguaaagaaucuguacgagaaaguuagaagucagcucaagaacaacgcaaaagaaaucggcaauggauguuuugaguucuaucacaagugcgacaacacauguauggaauccgugaagaauggcacuuacgauuauccuaaauacagcgaggaagccaagcugaacagggaggagauugacggggucaaacuugaaucuacccggaucuaucaaauucuggcuauauacucaacaguggcgaguagcuugguccucgugguuucccugggagcaaucucuuuuuggaugugcucgaaugguagcuuacagugccguauuuguaucuga

SEQ ID NO: 131284 - RNA, 1701 nt, Artificial Sequence
  derived and/or modified sequence opt3 from hemagglutinin__InfluenzaA__AFN18214
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauuaauuacgaagaguugagggagcagcucagcaguguguccucuuucgaacgguuugagaucuucccgaagacaagcuccuggcccaaccacgacucaaauaagggugucaccgccgcuuguccucaugcaggggccaaaaguuuuuauaagaaccugauauggcuggugaaaaagggaaauagcuacccaaaacucucuaaguccuauaucaacgauaagggcaaagaaguauuaguucuguggggcauucaccaccccucaacgagcgcugaccaacagagucuuuaccagaaugccgaugcguacguguucgucgggucuucccgcuauagcaagaaauuuaagccugagaucgcaauucgaccaaaagugcgugaccaggagggaagaaugaacuacuauuggacuuugguggaacccggugauaagaucaccuucgaggccacaggcaaccuggucguuccuagguacgcuuuugccauggaacggaaugcagggucgggaauaauuaucucugacacuccagugcaugauugcaacaccacaugucaaaccccgaaaggcgcuauuaauacgucccuacccuuccagaacauccacccuaucacuauugguaagugcccaaaguauguaaaaucaacaaagcuccgccuggccaccgggcuuagaaaugugcccaguauacagagcaggggacuguuuggcgcgaucgccggcuucauugaagggggauggacugguauggucgacggcugguacggguaucaucaccagaacgaacaaggauccggcuacgcagcugacuugaaaucuacacagaaugccaucgaugagauaaccaacaaggugaauagcguuauugagaaaaugaacacgcaguuuaccgcuguggguaaggaguucaaucaccucgagaagcggaucgaaaaccugaauaaaaaggucgacgauggguucuuagacaucuggacauacaacgccgagcugcucgugcuucuggaaaaugagcgcacuuuggauuaucaugacucaaacguuaaaaaccuauacgagaagguacgaagucagcugaaaaauaacgcaaaggaagugggcaauggauguuuugaguucuaucacaagugcgauaacaccuguauggaauccgucaaaaauggcacauacgacuauccuaaguacagcgaggaagccaaacucaacagagaggagauugauggggugaagcuggaaucuacuaggaucuaucaaauucuugcuauauacucaaccgcggcaaguagccuggucuuggugguuucccucggagccaucucuuuuuggaugugcucgaaugguagccugcagugccggauuuguaucuga

SEQ ID NO: 131285 - RNA, 1701 nt, Artificial Sequence; identical to SEQ ID NO: 127240
  derived and/or modified sequence opt3 from hemagglutinin__InfluenzaA__AFN18224

SEQ ID NO: 131286 - RNA, 1701 nt, Artificial Sequence; identical to SEQ ID NO: 126237
  derived and/or modified sequence opt3 from hemagglutinin__InfluenzaA__AFN18231

SEQ ID NO: 131287 - RNA, 1701 nt, Artificial Sequence
  derived and/or modified sequence opt3 from hemagglutinin__InfluenzaA__AFN18233
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucucgaaaguuuaaaccagagauugcaauccgucccaaggugagagaucaggagggaaggaugaauuacuauuggacucugguggaaccuggugacaaaauuacauucgaggccacuggcaaccuagucguuccacgguacgcuuuugccauggaacgcaacgcaggguccggaaucauaauuagcgauaccccggugcaugacugcaauacaaccugucaaacgcccaagggcgcuaucaacacuucgcucccuuuccagaauauucacccaaucacaaucgguaaaugccccaaguauguaaagucuaccaaacugagacuugccacugggcugaggaacgugccuuccauucagucacggggauuguuuggcgcgauagccggcuucaucgaagggggauggacagguauggucgacggcugguacggguaucaucaccagaaugaacaaggaaguggcuacgcagcugaucucaagagcacccagaacgccauugacgagaucacgaauaaagugaacuccguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauucuaauguaaagaaacuguacgagaagguuagaagccagcucaaaaacaacgcaaaggaaaucggcaauggauguuuugaguucuaucacaagugcgacaacacauguauggaaucagugaaaaauggcacuuacgauuauccaaaguacagugaggaagccaaacugaacagggaggagauugacggggucaaacuugaauccacccggaucuaucaaauucuggcuauauacagcacaguggcgucuucauugguccucgugguuagucugggagcaaucagcuuuuggaugugcuccaaugguucuuuacagugccguauuuguaucuga

SEQ ID NO: 131288 - RNA, 1701 nt, Artificial Sequence
  derived and/or modified sequence opt3 from hemagglutinin__InfluenzaA__AFN18243
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaaggucgaugacggguuccuggauaucuggaccuacaaugcugagcuccuugugcuguuggaaaacgagcgcacacuagacuaucaugauagcaauguaaagaaccuguacgagaagguucgaucacagcucaaaaacaaugccaaggaaaucggcaacggauguuuugaguucuaucacaagugcgacaauacuuguauggaaagugugaaaaacggcaccuacgauuauccuaaguacuccgaggaagcaaaacugaauagagaggagauugacggggucaaacuugaaagcacaaggaucuaucaaauucuggccauauacucuaccguggcuucaaguuugguccucgugguuagccugggagcgaucuccuuuuggaugugcucuaacgguucguuacagugccggauuuguaucuga

SEQ ID NO: 131289 - RNA, 1701 nt, Artificial Sequence; identical to SEQ ID NO: 130774
  derived and/or modified sequence opt3 from hemagglutinin__InfluenzaA__AFN18245

SEQ ID NO: 131290 - RNA, 1701 nt, Artificial Sequence; identical to SEQ ID NO: 127240
  derived and/or modified sequence opt3 from hemagglutinin__InfluenzaA__AFN18255

SEQ ID NO: 131291 - RNA, 1701 nt, Artificial Sequence; identical to SEQ ID NO: 131288
  derived and/or modified sequence opt3 from hemagglutinin__InfluenzaA__AFN18260

SEQ ID NO: 131292 - RNA, 1701 nt, Artificial Sequence; identical to SEQ ID NO: 131288
  derived and/or modified sequence opt3 from hemagglutinin__InfluenzaA__AFN18267

SEQ ID NO: 131293 - RNA, 1701 nt, Artificial Sequence
  derived and/or modified sequence opt3 from hemagglutinin__InfluenzaA__AFN18269
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaaaaguuugagauuuucccgaagacaagcuccuggcccaaucacgauucaaacaaaggugucaccgccgcuuguccucaugcaggggccaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgcugaucaacagaguuuguaccagaacgccgacgcguacguguucgucgggacuucucgguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaagucgaugacggguuccuggauaucuggacuuacaaugccgagcuccuugugcuguuggaaaacgagcggacccuagacuaucaugauagcaauguaaagaaccuguacgagaaaguucgcucacagcucaagaacaaugcaaaggaaaucggcaacggauguuucgaguucuaucacaaaugcgacaauacauguauggaaagugugaagaacggcacuuacgauuauccuaaauacuccgaggaagccaagcugaaucgagaggagauugacggggucaaacuugaaagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 131294 - RNA, 1701 nt, Artificial Sequence; identical to SEQ ID NO: 125849
  derived and/or modified sequence opt3 from hemagglutinin__InfluenzaA__AFN18271

SEQ ID NO: 131295 - RNA, 1701 nt, Artificial Sequence; identical to SEQ ID NO: 126237
  derived and/or modified sequence opt3 from hemagglutinin__InfluenzaA__AFN18273

SEQ ID NO: 131296 - RNA, 1701 nt, Artificial Sequence; identical to SEQ ID NO: 125849
  derived and/or modified sequence opt3 from hemagglutinin__InfluenzaA__AFN18280

SEQ ID NO: 131297 - RNA, 1701 nt, Artificial Sequence; identical to SEQ ID NO: 125483
  derived and/or modified sequence opt3 from hemagglutinin__InfluenzaA__AFN18303

SEQ ID NO: 131298 - RNA, 1701 nt, Artificial Sequence
  derived and/or modified sequence opt3 from hemagglutinin__InfluenzaA__AFN18305
augaaggccauccuggugguccuccuuuacaccuucgcuacagcaaacgccgacacucugugcauuggcuaucacgcgaauaacagcacggauaccguugacacaguguuggagaaaaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgauucaaacaagggugugaccgcugcauguccucaugccggggcuaaaaguuuuuauaagaaucugaucuggcucgucaaaaagggaaacagcuacccaaaauuaucuaaguccuauauaaaugacaagggcaaagaagugcugguacuuuggggcauccaccaccccucaacgagcgccgaucaacagaguuuguaccagaacgcggacgcauacguuuucguggggacuucucgcuauuccaagaaauuuaagccugagauugccauccgaccaaaaguccgugaucaggagggaagaaugaauuacuauuggacccugguggaacccggugacaagauuacauucgaggcuacuggcaaccuaguggucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacaagaucacgaauaaagucaacucugugauagagaagaugaauacccaguuuacagccguugguaaggaguucaaccaccuggggaaacggauugaaaauuuaaacaagaaaguggaugacggcuuccuggauaucuggacuuacaaugcagagcuccuuguccuguuggaaaacgagcgcacccuagacuaucaugauagcaaugugaagaaccuguacgaaaaaguacgaucacagcucaagaacaaugccaaggagaucggaaacggcuguuuugaguucuaucacaaaugcgacaauacauguauggaaaguguuaagaacgggacuuacgauuauccuaaauacuccgaggaagcuaagcugaauagagaggaaauugacggagugaaacuugagagcaccaggaucuaucaaauucuggcgauauacucuacagucgcaucaaguuuggugcucgucgugagccugggugccaucuccuuuuggaugugcucuaacggcucguuacagugccggauuuguaucuga

SEQ ID NO: 131299 - RNA, 1701 nt, Artificial Sequence
  derived and/or modified sequence opt3 from hemagglutinin__InfluenzaA__AFN18307
augaaggccauccuggugguccuccuuuacaccuucgcugcagccaacgcggacacacugugcauuggcuaucacgcuaauaacagcacugauacgguugacaccguguuggagaaaaauguaacagugacucauuccgucaacuuacuggaagauaagcacaaugggaaacuauguaagcucagaggaguggcaccccugcaucuugguaaaugcaacauagccggcuggauccuggggaauccugagugugaaucuuugucaaccgccaguagcugguccuacauuguugagacaucuucgucagacaacggaaccugcuauccaggcgauuuuaucgacuacgaggagcucagggagcagcugagcaguguguccucuuucgaacgguuugagauuuucccgaagacuagcuccuggcccaaucacgauucaaacaagggugucacagcugcauguccucaugccggggcuaaaaguuuuuauaagaaucugaucuggcucgugaaaaagggaaacagcuacccaaaauuaucuaaguccuauauaaaugacaagggcaaagaaguacugguucuuuggggcauccaccaccccucaaccagcgccgaucaacagaguuuguaccagaacgcggacgcauacguguucgucgggacgucucgcuauuccaagaaauuuaagccugagauugccauccgaccaaaagugcgugaucaggagggaagaaugaauuacuauuggacucugguggaacccggugacaagauuaccuucgaggcuacaggcaaccuagucguuccuagguacgccuuugcaauggaacggaacacugggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacaagaucacgaauaaagugaacucuguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauagcaauguaaagaaccuguacgagaaaguucgaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagagaagagauugacggggucaaacuugagagcaccaggaucuaucaaauucuggcuauauacucuacaguggcgucaaguuugguccucgugguuagccugggagcaaucuccuuuuggaugugcucuaacgguucguuacagugccggauuuguaucuga

SEQ ID NO: 131300 - RNA, 1701 nt, Artificial Sequence
  derived and/or modified sequence opt3 from hemagglutinin__InfluenzaA__AFN18312
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaggguaucaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuucucuccccuuccagaauauccacccuaucacaauugguaagugcccaaaguaugugaaauccaccaagcugcgccuugccacugggcugagaaacguacccucaauacagaguaggggauuguuuggcgcgaucgccggcuucauugaagggggauggacagguaugguggacggcugguacggguaucaucaccagaaugaacaaggaagcggcuacgcagcugaucucaaauccacccagaacgccaucgacaagauaacgaauaaagucaacucugugauugagaagaugaauacccaguuuacagcuguugguaaggaguucaaccaccuggaaaaacggaucgagaauuuaaacaagaaaguggaugacggguuccuggauaucuggacuuacaaugccgaacuccuuguccuguuggagaacgaacgcacccuagacuaucaugauagcaaugugaagaaccuguacgagaaaguacgaucacagcucaagaacaaugcaaaggagauuggcaacggauguuuugaguucuaucacaaaugcgacaauacauguauggaaaguguuaagaacggcacuuacgauuauccuaaauacuccgaagaggccaagcugaauagagaagagaucgacggggugaaacuugagagcaccaggauuuaucaaauacuggcuaucuacucuacagucgcgucaaguuuggugcucgucauuagccugggagcaaucuccuuuuggaugugcucuaacgguucguuacagugccggaucuguauuuga

SEQ ID NO: 131301 - RNA, 1701 nt, Artificial Sequence; identical to SEQ ID NO: 127050
  derived and/or modified sequence opt3 from hemagglutinin__InfluenzaA__AFN18319

SEQ ID NO: 131302 - RNA, 1701 nt, Artificial Sequence; identical to SEQ ID NO: 129147
  derived and/or modified sequence opt3 from hemagglutinin__InfluenzaA__AFN18324

SEQ ID NO: 131303 - RNA, 1701 nt, Artificial Sequence; identical to SEQ ID NO: 125038
  derived and/or modified sequence opt3 from hemagglutinin__InfluenzaA__AFN18334

SEQ ID NO: 131304 - RNA, 1701 nt, Artificial Sequence; identical to SEQ ID NO: 126801
  derived and/or modified sequence opt3 from hemagglutinin__InfluenzaA__AFN18344

SEQ ID NO: 131305 - RNA, 1701 nt, Artificial Sequence; identical to SEQ ID NO: 124685
  derived and/or modified sequence opt3 from hemagglutinin__InfluenzaA__AFN18354

SEQ ID NO: 131306 - RNA, 1701 nt, Artificial Sequence
  derived and/or modified sequence opt3 from hemagglutinin__InfluenzaA__AFN18364
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgaucugaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgucagcugaucaacagagccuguaccagaacgccgacgcguacguguucgucgggaccagucgcuauucuaagaaauuuaagccugagauugcaauccgaccaaaagugcgugaucaggagggaagaaugaauuacuauuggacucuaguggaacccggugacaagauuacauucgaggccacuggcaaccucgucguuccuagguacgcuuuugccauggaacggaacgcaggguccggaaucauaauuagcgauaccccagugcaugacugcaauacaaccugucaaacgccgaaaggcgcuaucaacacuucgcugcccuuccagaauauucacccuaucacaaucgguaagugcccaaaguauguaaaaucuaccaagcugcgccuugccacuggguugagaaacgugcccuccauucagucaaggggacucuuuggcgcgauagccggcuucaucgaagggggauggacagguauggucgacggcugguacggguaucaucaccagaaugaacaaggaaguggcuacgcagcugaucugaaaagcacccagaacgccauugacgagaucacgaauaaggugaacuccguuauagagaaaaugaauacccaguuuacagcuguggguaaggaguucaaccacuuagaaaagcggauugaaaaucugaacaaaaagaucgaugacggguuccucgauaucuggacuuacaaugccgagcuucuggucuugcuagaaaacgagcgcacccuggacuaucaugauucuaaugugaaaaaccucuacgagaagguacgaagccagcugaaaaacaaugcaaaggaaauuggcaacggauguuuugaguucuaucacaagugcgacaauacauguauggaaucaguuaaaaacggcacuuacgauuauccuaaguacagugaggaagccaaacuuaauagagaggagaucgacggggugaagcuggaauccaccaggauuuaucaaauauuggcuaucuacagcacagucgcgucuucacucgugcuggucgugaguuuaggagcaauuagcuuuuggaugugcuccaacgguucucugcagugccggaucuguaucuga

SEQ ID NO: 131307 - RNA, 1701 nt, Artificial Sequence; identical to SEQ ID NO: 124685
  derived and/or modified sequence opt3 from hemagglutinin__InfluenzaA__AFN18374

SEQ ID NO: 131308 - RNA, 1701 nt, Artificial Sequence
  derived and/or modified sequence opt3 from hemagglutinin__InfluenzaA__AFN18381
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgagaucaggagggacguaugaauuacuauuggacccuggugaaacccggugacaagauuacauucgaagccacuggcaaccuagucguuccuagauacgcuuuugccauggagaggaacgcagggagcggaaucauaauuucggauaccccagugcaagacugcaauacaaccugucagacgccgaagggcgcuaucaacacuucucuccccuuccagaauauucauccuaucacaaucgguaaaugcccaaaguauguaaaauccaccaagcugcggcuugccacugggcugcgcaacgugcccucaauucagaguagaggauuguuuggcgcgauagccggcuucaucgaagggggauggacagguauggucgacggcugguacggguaucaccaucaaaaugagcagggaagcggcuacgcagcugaucucaaauccacccagaacgccauugacgaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucacgauagcaauguaaagaaccuguacgagaagguucgcucacaacucaagaacaaugcaaaagagaucggcaacggauguuuugaguucuaucauaagugcgacaauacauguauggagagugugaaaaacggcacuuacgauuauccuaaguacuccgaagaggccaaacugaaucgagaagagauugacggggucaaacuugagagcaccagaaucuaucagauucuggcuauauacucuacaguggcgucaaguuugguccucgugguuagccugggagcaaucuccuuuuggaugugcucuaacgguucguuacagugcaggauuuguaucuga

SEQ ID NO: 131309 - RNA, 1701 nt, Artificial Sequence
  derived and/or modified sequence opt3 from hemagglutinin__InfluenzaA__AFN18390
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagauccgaucacagcucaaaaacaaugcaaaggaaauuggcaacggauguuuugaguucuaucacaagugcgacaauacauguauggaaaguguuaaaaacggcacuuacgauuauccuaaguacuccgaggaagccaaacugaauagagaggagaucgacggggugaaacuugaaagcaccaggauuuaucaaauacuggcuaucuacucuacagucgcgucaaguuuggugcucgucgugagccugggagcaauuuccuuuuggaugugcucuaacgguucguuacagugccggaucuguaucuga

SEQ ID NO: 131310 - RNA, 1701 nt, Artificial Sequence
  derived and/or modified sequence opt3 from hemagglutinin__InfluenzaA__AFN18400
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugacaccccugcaucuugguaaaugcaacauagcuggcuggauccuggggaauccugagugugaaucuuugucaaaggccaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaaaggugucaccgcagccuguccucaugcuggggcaaagaguuuuuauaaaaaucugaucuggcucgugaagaaaggaaacagcuacccaaaguuaucuaaguccuauauaaaugacaaaggcaaggaaguacugguucuuuggggcauccaccaccccucaacgagcgccgaucaacagaguuuguaccagaacgcugacgccuacguguucgucgggacuucucgcuauuccaaaaaguuuaaaccugagauugcgauccgaccaaaggugcgugaucaggagggaagaaugaauuacuauuggacccugguggaacccggugacaaaauuacauucgaggcaacuggcaaccuagucguuccuagguacgccuuugcuauggaacggaacguggggagcggaaucauaauuucggauaccccaguacaugacugcaauacaaccugucaaacgccgaagggcgccaucaacacuucucuccccuuccagaauauucacccuaucacaaucgguaagugcccaaaauaugugaaguccaccaaacugcgccuugcaacugggcugagaaacguccccucaauucagaguaggggauuguuuggcgcuauagccggcuucaucgaagggggauggacagguaugguggacggcugguacggguaucaucaccagaaugaacaaggaagcggcuacgcggccgaucucaaguccacccagaacgcaauugacgagaucacgaauaaaguuaacucugugauagagaagaugaauacccaguuuacagcugucgguaaggaguucaaccaccuggaaaaacggauugaaaauuuaaacaagaaaguggaugacggguuccuggauaucuggacuuacaaugccgagcuccuuguacuguuggaaaacgagcgcacccuagacuaucaugauagcaauguuaagaaccuguacgagaaagugcgaucacagcucaagaacaaugcuaaggaaaucggcaacggauguuuugaguucuaucacaaaugcgacaauacauguauggaaagugucaagaacggcacuuacgauuauccuaaauacuccgaggaagccaagcugaauagagaggagauugacggggugaaacuugaaagcaccaggaucuaucaaauucuggcaauauacucuacagucgccucaaguuuggugcucguugugagccugggagcuaucuccuuuuggaugugcucuaacgguucguuacagugccggauuuguaucuga

SEQ ID NO: 131311 - RNA, 1701 nt, Artificial Sequence; identical to SEQ ID NO: 124776
  derived and/or modified sequence opt3 from hemagglutinin__InfluenzaA__AFN18410

SEQ ID NO: 131312 - RNA, 1701 nt, Artificial Sequence; identical to SEQ ID NO: 124685
  derived and/or modified sequence opt3 from hemagglutinin__InfluenzaA__AFN18420

SEQ ID NO: 131313 - RNA, 1701 nt, Artificial Sequence
  derived and/or modified sequence opt3 from hemagglutinin__InfluenzaA__AFN18430
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaaaauaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggugcggaaugcagggagcggaaucauaauuucggacaccccaguacaugauugcaacacaaccugucaaacgccgaaaggcgcuaucaauacuucucuccccuuccagaacauucacccuaucacaaucgguaagugcccaaaguaugugaaauccaccaagcugcgccuugccacugggcugagaaauguccccucaauucagaguaggggauuguuuggcgcgauagccggcuucaucgaagggggauggacagguaugguggacggcugguacggguaucaucaccagaacgagcaaggaagcggcuacgcagcugaccucaaauccacccagaaugccauugaugaaaucacgaacaagguuaauucugugauagagaaaaugaacacccaguuuacagcugucgguaaggaguucaaucaccuggaaaagcggauugagaacuuaaauaaaaagguggacgauggguuccuggacaucuggacuuacaacgccgaacuccuuguacuguuggagaaugaacgcacccuagauuaucaugacagcaacguuaaaaaccuguacgagaaggugcgaucacagcucaaaaauaacgcaaaggagaucggcaauggauguuuugaguucuaucacaagugcgauaacacauguauggagagugucaaaaauggcacuuacgacuauccuaaguacuccgaagaggccaaacugaacagagaagagauugauggggugaaacuugagagcaccaggaucuaucaaauucuggcuauauacucuacagucgcgucaaguuuggugcucguugugagccugggagcaaucuccuuuuggaugugcucuaaugguucguuacagugccggauuuguaucuga

SEQ ID NO: 131314 - RNA, 1701 nt, Artificial Sequence; identical to SEQ ID NO: 124685
  derived and/or modified sequence opt3 from hemagglutinin__InfluenzaA__AFN18440

SEQ ID NO: 131315 - RNA, 1701 nt, Artificial Sequence; identical to SEQ ID NO: 124685
  derived and/or modified sequence opt3 from hemagglutinin__InfluenzaA__AFN18450

SEQ ID NO: 131316 - RNA, 1701 nt, Artificial Sequence; identical to SEQ ID NO: 127240
  derived and/or modified sequence opt3 from hemagglutinin__InfluenzaA__AFN18460

SEQ ID NO: 131317 - RNA, 1701 nt, Artificial Sequence; identical to SEQ ID NO: 125546
  derived and/or modified sequence opt3 from hemagglutinin__InfluenzaA__AFN18470

SEQ ID NO: 131318 - RNA, 1701 nt, Artificial Sequence; identical to SEQ ID NO: 124776
  derived and/or modified sequence opt3 from hemagglutinin__InfluenzaA__AFN18480

SEQ ID NO: 131319 - RNA, 1701 nt, Artificial Sequence; identical to SEQ ID NO: 125546
  derived and/or modified sequence opt3 from hemagglutinin__InfluenzaA__AFN18490

SEQ ID NO: 131320 - RNA, 1701 nt, Artificial Sequence; identical to SEQ ID NO: 124685
  derived and/or modified sequence opt3 from hemagglutinin__InfluenzaA__AFN18497

SEQ ID NO: 131321 - RNA, 1701 nt, Artificial Sequence; identical to SEQ ID NO: 124685
  derived and/or modified sequence opt3 from hemagglutinin__InfluenzaA__AFN18512

SEQ ID NO: 131322 - RNA, 1701 nt, Artificial Sequence
  derived and/or modified sequence opt3 from hemagglutinin__InfluenzaA__AFN18519
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaaggaaaacagcuacccaaaauuaucuaaguccuauauaaaugacaagggaaaagagguacugguucuuuggggcauccaccaccccucaacgagcgcugaucaacagaguuuguaccagaacgccgacgcguacguguucgucggcacuucucgcuauuccaagaaauuuaagccugagauugcaauccgaccaaaagugcgugaucaggaagggagaaugaauuacuauuggacccugguggagcccggagacaagauuacauucgaagccacugguaaccuagucguuccuagguacgcuuuugccauggagcggaacgcaggcagcgggaucauaauuucggauaccccagugcaugacugcaauacaaccugucaaacgccgaaaggagcuaucaacacuucucuccccuuccagaauauucacccuaucacaaucggcaagugcccaaaguauguaaaauccaccaagcugcgccuugccacuggucugagaaacgugcccucaauucagaguaggggguuguuuggagcgauagccggcuucaucgaaggcggguggacaggaauggucgacgguugguacggcuaucaucaccagaaugagcaagggagcggauacgcagcugaucucaaauccacccagaacgccauugacgagaucacgaauaaggugaacucuguuauagaaaagaugaauacccaguuuacagcugugggcaaggaguucaaccaccuggaaaagcggauugagaauuuaaacaaaaaggucgaugacgguuuccuggauaucuggacuuacaaugccgaacuccuugugcuguuggagaacgagcgcacccuagacuaucaugauagcaauguuaaaaaccuguacgaaaagguacgaucacagcucaaaaacaaugcaaaggagaucgggaacggcuguuuugaguucuaucacaagugcgacaauacauguauggagagugugaaaaacggaacuuacgauuauccuaaguacuccgaagaggccaaacugaauagagaggaaauugacggcgucaaacuugagagcaccaggaucuaucaaauucuggcuauauacucuacaguggcgucaaguuugguccucgugguuagccugggggcaaucuccuuuuggaugugcucuaacggaucguuacagugccggauuuguaucuga

SEQ ID NO: 131323 - RNA, 1701 nt, Artificial Sequence
  derived and/or modified sequence opt3 from hemagglutinin__InfluenzaA__AFN18521
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggugcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacgaaaucacgaauaagguuaacucugugauagagaaaaugaauacccaguuuacagcugucgguaaggaguucaaccaccuggaaaagcggauugagaauuuaaacaaaaagguggaugacggguuccuggauaucuggacuuacaaugccgaacuccuuguacuguuggagaacgaacgcacccuagacuaucaugauagcaauguuaaaaaccuguacgagaaggugcgaucacagcucaaaaacaaugcaaaggagaucggcaacggauguuuugaguucuaucacaagugcgacaauacauguauggagagugucaaaaacggcacuuacgauuauccuaaguacuccggggaagccaaacugaauagagaggaaauugacggagugaaacuugagagcaccaggaucuaucaaauucuggcuauauacucuacagucgcgucaaguuuggugcucguugugagccugggugcaaucuccuuuuggaugugcucuaacggcucguuacagugccggauuuguaucuga

SEQ ID NO: 131324 - RNA, 1701 nt, Artificial Sequence; identical to SEQ ID NO: 124685
  derived and/or modified sequence opt3 from hemagglutinin__InfluenzaA__AFN18528

SEQ ID NO: 131325 - RNA, 1701 nt, Artificial Sequence; identical to SEQ ID NO: 124685
  derived and/or modified sequence opt3 from hemagglutinin__InfluenzaA__AFN18531

SEQ ID NO: 131326 - RNA, 1701 nt, Artificial Sequence; identical to SEQ ID NO: 127282
  derived and/or modified sequence opt3 from hemagglutinin__InfluenzaA__AFN18543

SEQ ID NO: 131327 - RNA, 1701 nt, Artificial Sequence; identical to SEQ ID NO: 129567
  derived and/or modified sequence opt3 from hemagglutinin__InfluenzaA__AFN18545

SEQ ID NO: 131328 - RNA, 1701 nt, Artificial Sequence; identical to SEQ ID NO: 125546
  derived and/or modified sequence opt3 from hemagglutinin__InfluenzaA__AFN18550

SEQ ID NO: 131329 - RNA, 1701 nt, Artificial Sequence
  derived and/or modified sequence opt3 from hemagglutinin__InfluenzaA__AFN18557
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagcucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacgagaucacgaauaaggucaacucugugauagagaaaaugaauacccaguuuacagccguugguaaggaguucaaccaccuggaaaagcggauugaaaauuuaaacaaaaagguggaugacggguuccuggauaucuggacuuacaaugcagagcuccuuguccuguuggaaaacgagcgcacccuagacuaucaugauagcaaugugaaaaaccuguacgagaagguacgaucacagcucaaaaacaaugccaaggaaaucggcaacggauguuuugaguucuaucacaagugcgacaauacauguauggaaaguguuaaaaacggcacuuacgauuauccuaaguacuccgaggaagcuaaacugaauagagaggagauugacggggugaaacuugaaagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 131330 - RNA, 1701 nt, Artificial Sequence
  derived and/or modified sequence opt3 from hemagglutinin__InfluenzaA__AFN18559
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaacuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaaggugaauaguguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 131331 - RNA, 1701 nt, Artificial Sequence; identical to SEQ ID NO: 125551
  derived and/or modified sequence opt3 from hemagglutinin__InfluenzaA__AFN18561

SEQ ID NO: 131332 - RNA, 1701 nt, Artificial Sequence; identical to SEQ ID NO: 125787
  derived and/or modified sequence opt3 from hemagglutinin__InfluenzaA__AFN18563

SEQ ID NO: 131333 - RNA, 1701 nt, Artificial Sequence
  derived and/or modified sequence opt3 from hemagglutinin__InfluenzaA__AFN18565
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggugcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagaacgccauugacgaaaucacgaauaagguuaacucugugauagagaaaaugaauacccaguuuacagcugucgguaaggaguucaaccaccuggaaaagcggauggagaauuuaaacaaaaagguggaugacggguuccuggauauuuggacuuacaaugccgaacuccuuguacuguuggagaacgaacgcacccuagacuaucaugauagcaauguuaaaaaccuguacgagaaggugcgaucacagcucaaaaacaaugcaaaggagaucggcaacggauguuuugaguucuaucacaagugcgacaauacauguauggagagugucaaaaacggcacuuacgauuauccuaaguacuccgaagaggccaaacugaauagagaagagaucgacggggugaaacuugagagcaccaggauuuaucaaauccuggcuauuuacucuacagucgcgucaaguuuggugcucguugugagccugggagcaauauccuuuuggaugugcucuaacgguucguuacagugccggaucuguauuuga

SEQ ID NO: 131334 - RNA, 1701 nt, Artificial Sequence
  derived and/or modified sequence opt3 from hemagglutinin__InfluenzaA__AFN18570
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaguuaguagcugguccuacauuguggagaccucuucgucagacaacggaacuugcuauccaggcgauuuuaucgacuacgaggagcucagggagcagcugagcagugucuccucuuucgaacgguuugagauuuucccgaagacaagcuccuggcccaaucacgauucaaacaagggugugaccgcagccuguccucaugcuggggcaaaaaguuuuuauaagaaucugaucuggcucguaaagaagggaaacagcuacccaaaauuaucuaaguccuauauaaaugacaagggcaaagaaguucuggugcuuuggggcauccaccaccccucaacgagcgccgaucaacagaguuuguaccagaacgcugacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacgagaucacgaauaagguuaacucugugauagagaaaaugaauacccaguuuacagccgucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauagcaauguuaaaaaccuguacgagaaggugcgaucacagcucaaaaacaaugccaaggaaaucggcaacggauguuuugaguucuaucacaagugcgacaauacauguauggaaagugucaaaaacggcacuuacgauuauccuaaguacuccgaggaagcaaaacugaauagagaggagauugacggggugaaacuugaaagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 131335 - RNA, 1701 nt, Artificial Sequence; identical to SEQ ID NO: 124685
  derived and/or modified sequence opt3 from hemagglutinin__InfluenzaA__AFN18580

SEQ ID NO: 131336 - RNA, 1701 nt, Artificial Sequence; identical to SEQ ID NO: 124927
  derived and/or modified sequence opt3 from hemagglutinin__InfluenzaA__AFN18590

SEQ ID NO: 131337 - RNA, 1701 nt, Artificial Sequence
  derived and/or modified sequence opt3 from hemagglutinin__InfluenzaA__AFN18600
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaacuuguaccagaaugccgacgcguacguguucgucgggacuucccgcuauucuaagaaauuuaagccugagauugcaauccgaccaaaagugcgugaucaggagggaagaaugaacuacuauuggacccugguggaacccggugacaagauuacauucgaggccacuggcaaccuagucguuccuagguacgcuuuugccauggaacggaaugcaggguccggaaucauaauuagcgauaccccagugcaugacugcaacacaaccugucaaacgccgaaaggcgcuaucaauacuucgcuccccuuccagaacauucacccuaucacaaucgguaagugcccaaaguauguaaaaucuaccaagcugcgccuugccacugggcugagaaaugugcccuccauucagucaaggggauuguuuggcgcgauagccggcuucaucgaagggggauggacagguauggucgacggcugguacggguaucaucaccagaacgaacaaggaaguggcuacgcagcugaucucaaaagcacccagaaugccauugacgagaucacgaacaaggugaauaguguuauagagaaaaugaacacccaguuuacagcuguggguaaggaguucaaucaccuggaaaagcggauugaaaacuuaaauaaaaaggucgaugacggguuccuggauaucuggacuuacaacgccgagcuccuugugcuguuggaaaaugagcgcacccuagacuaucaugauucuaacguaaagaaccuguacgagaagguucgaagccagcucaaaaauaacgcaaaggaaaucggcaauggauguuuugaguucuaucacaagugcgacaacgccuguauggaaucagugaaaaauggcacauacgauuauccuaaguacagugaggaagcuaaacugaacagagaggagauugacggggucaaacuugaauccacuaggaucuaucaaauucuggcgauauacagcaccguggcaucuucauugguccucgugguuagucugggagccaucagcuuuuggaugugcuccaaugguucuuuacagugccggauuuguaucuga

SEQ ID NO: 131338 - RNA, 1701 nt, Artificial Sequence; identical to SEQ ID NO: 124685
  derived and/or modified sequence opt3 from hemagglutinin__InfluenzaA__AFN18610

SEQ ID NO: 131339 - RNA, 1701 nt, Artificial Sequence
  derived and/or modified sequence opt3 from hemagglutinin__InfluenzaA__AFN18617
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggugcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagucugccauugacgaaaucacgaacaagguuaauagcgugauagagaaaaugaacacccaguuuacagcugucgguaaggaguucaaucaccuggaaaagcggauugagaacuuaaauaaaaagguggaugacggguuccuggauaucuggacuuacaacgccgaacuccuuguacuguuggagaaugaacgcacccuagacuaucaugauucaaacguuaaaaaucuguacgagaaggugcgaagucagcucaaaaacaacgcaaaggagaucggcaauggauguuuugaguucuaucacaagugcgacaacacauguauggaguccgucaaaaauggcacuuacgauuauccuaaguacagcgaagaggccaaacugaagagagaagagauugacggggugaaacuugagucuaccaggaucuaucaaauucuggcuauauacucaacagucgcgaguagcuuggugcucguugugucccugggagcaaucucuuuuuggaugugcucgaacgguagcuuacagugccggauuuguaucuga

SEQ ID NO: 131340 - RNA, 1701 nt, Artificial Sequence; identical to SEQ ID NO: 125546
  derived and/or modified sequence opt3 from hemagglutinin__InfluenzaA__AFN18622

SEQ ID NO: 131341 - RNA, 1701 nt, Artificial Sequence; identical to SEQ ID NO: 124685
  derived and/or modified sequence opt3 from hemagglutinin__InfluenzaA__AFN18629

SEQ ID NO: 131342 - RNA, 1701 nt, Artificial Sequence; identical to SEQ ID NO: 124927
  derived and/or modified sequence opt3 from hemagglutinin__InfluenzaA__AFN18634

SEQ ID NO: 131343 - RNA, 1701 nt, Artificial Sequence
  derived and/or modified sequence opt3 from hemagglutinin__InfluenzaA__AFN18644
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggugcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagucugccauugacgaaaucacgaacaagguuaauagcgugauagagaaagucaacacccaguuuacagcuguggguaaggaguucaaucaccuggaaaagcggauugagaacuuaaauaaaaagguagaugacggguuccuggauaucuggacuuacaacgccgaacuccuuguucuguuggagaaugaacgcacccuagacuaucaugauucaaacgugaaaaaucuguacgagaagguccgaagucagcucaaaaacaacgcaaaggagaucggcaauggauguuuugaguucuaucacaagugcgacaacacauguauggaguccgugaaaaauggcacuuacgauuauccuaaguacagcgaagaggccaaacugaacagagaagagauugacggggucaaacuugagucuaccaggaucuaucaaauucuggcuauauacucaacaguggcgaguagcuugguucucgugguaucccugggagcaaucucuuuuuggaugugcucgaaugguagcuuacagugccggauuuguaucuga

SEQ ID NO: 131344 - RNA, 1701 nt, Artificial Sequence; identical to SEQ ID NO: 125546
  derived and/or modified sequence opt3 from hemagglutinin__InfluenzaA__AFN18654

SEQ ID NO: 131345 - RNA, 1701 nt, Artificial Sequence; identical to SEQ ID NO: 124685
  derived and/or modified sequence opt3 from hemagglutinin__InfluenzaA__AFN18664

SEQ ID NO: 131346 - RNA, 1701 nt, Artificial Sequence; identical to SEQ ID NO: 124927
  derived and/or modified sequence opt3 from hemagglutinin__InfluenzaA__AFN18674

SEQ ID NO: 131347 - RNA, 1701 nt, Artificial Sequence; identical to SEQ ID NO: 124685
  derived and/or modified sequence opt3 from hemagglutinin__InfluenzaA__AFN18684

SEQ ID NO: 131348 - RNA, 1701 nt, Artificial Sequence; identical to SEQ ID NO: 125546
  derived and/or modified sequence opt3 from hemagglutinin__InfluenzaA__AFN18694

SEQ ID NO: 131349 - RNA, 1701 nt, Artificial Sequence
  derived and/or modified sequence opt3 from hemagglutinin__InfluenzaA__AFN18704
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggugcggaacgcagggagcggaaucauaauuucggauaccccaguacaugacugcaauacaaccugucaaacgccgaaaggcgcuaucaacacuucucuccccuuccagaauauucacccuaucacaaucgguaagugcccaaaguaugugaaauccaccaagcugcgccuugccacugggcugagaaacguccccucaauucagaguaggggauuguuuggcgcgauagccggcuucaucgaagggggauggacagguaugguggacggcugguacggguaucaucaccagaaugagcaaggaagcggcuacgcagcugaucucaaauccacccagucugccauugacgaaaucacgaacaagguuaauagcgugauagagaaaaugaacacccaguuuacagcugucgguaaggaguucaaucaccuggaaaagcggauugagaacuuaaauaaaaagguggaugacggguuccuggauaucuggacuuacaacgccgaacuccuuguacuguuggagaaugaacgcacccuagacuaucaugauucaaacguuaaaaaucuguacgagaaggugcgaagucagcucaaaaacaacgcaaaggagaucggcaauggauguuuugaguucuaucacaagugcgacaacacauguauggaguccgucaaaaauggcacuuacgauuauccuaaguacagcgaagaggccaaacugaacagagaagagauugacggggugaaacuugagucuaccaggaucuaucaaauucuggcuauauacucaacagucgcgaguagcuuggugcucguugugucccugggagcaaucucuuuuuggaugugcucgaaugguagcuuacagugccggauuuguaucuga

SEQ ID NO: 131350 - RNA, 1701 nt, Artificial Sequence; identical to SEQ ID NO: 126919
  derived and/or modified sequence opt3 from hemagglutinin__InfluenzaA__AFN18714

SEQ ID NO: 131351 - RNA, 1701 nt, Artificial Sequence; identical to SEQ ID NO: 124685
  derived and/or modified sequence opt3 from hemagglutinin__InfluenzaA__AFN18721

SEQ ID NO: 131352 - RNA, 1701 nt, Artificial Sequence; identical to SEQ ID NO: 127351
  derived and/or modified sequence opt3 from hemagglutinin__InfluenzaA__AFN18725

SEQ ID NO: 131353 - RNA, 1701 nt, Artificial Sequence
  derived and/or modified sequence opt3 from hemagglutinin__InfluenzaA__AFN18735
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagacgcugaucuggcucgugaaaaagggaaauagcuacccaaaauuaucuaaguccuauauaaacgacaagggcaaagaaguacugguucuuuggggcauccaccaccccucaacuagcgcugaucaacagaguuuguaccagaaugccgacgcguacguguucgucgggaccucucgcuauuccaagaaauuuaagccugagauugcaauccgaccaaaagugcgugaucaggagggaagaaugaacuacuauuggacacugguggaacccggugacaagauuacuuucgaggccaccggcaaucuagucguuccuagguacgcuuuugccauggaacggaacgcagggagcggaaucauaauuucggauacaccagugcaugacugcaacaccacgugucaaacuccgaaaggcgcuaucaauacaucucuccccuuccagaacauucacccuaucaccaucgguaagugcccaaaguauguaaaauccacuaagcugcgccuugccacagggcugagaaaugugcccucaauucagaguaggggauuguuuggcgcgauagccggcuucaucgaagggggauggaccgguauggucgacggcugguacggguaucaucaccagaacgaacaaggaagcggcuacgcagcugaucucaaauccacgcagaaugccauugacgagaucaccaacaagguaaauucuguuauagagaaaaugaacacacaguuuacugcuguggguaaggaguucaaucaccuggaaaagcggauugaaaacuuaaauaaaaaggucgaugacggguuccuggauaucuggaccuacaacgccgagcuccuugugcuguuggaaaaugagcgcacacuagacuaucaugauagcaacgugaaaaaucuguacgagaagguucgaucacagcucaaaaacaacgcaaaggaaaucggcaauggauguuuugaguucuaucacaagugcgacaacacuuguauggaaagugugaaaaauggcaccuacgauuauccuaaguacuccgaggaagccaaacugaacagagaggagauugacggggucaaacuugaaagcacaaggaucuaucaaauucuggcuauauacucuaccguggcgucaaguuugguccucgugguuagccugggagcaaucuccuuuuggaugugcucuaaugguucguuacagugccggauuuguaucuga

SEQ ID NO: 131354 - RNA, 1701 nt, Artificial Sequence; identical to SEQ ID NO: 124685
  derived and/or modified sequence opt3 from hemagglutinin__InfluenzaA__AFN18742

SEQ ID NO: 131355 - RNA, 1701 nt, Artificial Sequence; identical to SEQ ID NO: 125787
  derived and/or modified sequence opt3 from hemagglutinin__InfluenzaA__AFN18747

SEQ ID NO: 131356 - RNA, 1701 nt, Artificial Sequence
  derived and/or modified sequence opt3 from hemagglutinin__InfluenzaA__AFN18757
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagcugucccuagguacgccuuugcaauggaacggaacgcugggagcggaaucauaauuucggauaccccaguucaugacugcaauacaaccugucaaacgccgaaaggcgccaucaacacuucucuccccuuccagaauauucacccuaucacaaucgguaagugcccaaaguaugugaaauccaccaagcugcgccuugcgacugggcugagaaacguacccucaauucagaguaggggauuguuuggcgccauagcaggcuucaucgaagggggauggacagguaugguggacggcugguacggguaucaucaccagaaugaacaaggaagcggcuacgcugccgaucucaaauccacccagaacgcuauugacgagaucacgaauaaggucaacucugugauagagaaaaugaauacccaguuuacagccguugguaaggaguucaaccaccuggaaaagcggauugaaaauuuaaacaaaaagguggaugacggguuccuggauaucuggacuuacaaugcagagcuccuuguccuguuggaaaacgagcgcacccuagacuaucaugauagcaaugugaaaaaccuguacgagaagguacgaucacagcucaaaaacaaugccaaggaaaucggcaacggauguuuugaguucuaucacaagugcgacaauacauguauggaaaguguuaaaaacggcacuuacgauuauccuaaguacuccgaggaagcuaaacugaauagagaggagauugacggggugaaacuugaaagcaccaggaucuaucaaauucuggcgauauacucuacagucgcaucaaguuuggugcucgucgugagccugggagccaucuccuuuuggaugugcucuaacgguucguuacagugccggauuuguaucuga

SEQ ID NO: 131357 - RNA, 1701 nt, Artificial Sequence; identical to SEQ ID NO: 124685
  derived and/or modified sequence opt3 from hemagglutinin__InfluenzaA__AFN18767

SEQ ID NO: 131358 - RNA, 1701 nt, Artificial Sequence; identical to SEQ ID NO: 131349
  derived and/or modified sequence opt3 from hemagglutinin__InfluenzaA__AFN18774

SEQ ID NO: 131359 - RNA, 1701 nt, Artificial Sequence; identical to SEQ ID NO: 124685
  derived and/or modified sequence opt3 from hemagglutinin__InfluenzaA__AFN18776

SEQ ID NO: 131360 - RNA, 1701 nt, Artificial Sequence; identical to SEQ ID NO: 125551
  derived and/or modified sequence opt3 from hemagglutinin__InfluenzaA__AFN18778

SEQ ID NO: 131361 - RNA, 1701 nt, Artificial Sequence; identical to SEQ ID NO: 124685
  derived and/or modified sequence opt3 from hemagglutinin__InfluenzaA__AFN18784

SEQ ID NO: 131362 - RNA, 1701 nt, Artificial Sequence; identical to SEQ ID NO: 125551
  derived and/or modified sequence opt3 from hemagglutinin__InfluenzaA__AFN18789

SEQ ID NO: 131363 - RNA, 1701 nt, Artificial Sequence; identical to SEQ ID NO: 124685
  derived and/or modified sequence opt3 from hemagglutinin__InfluenzaA__AFN18799

SEQ ID NO: 131364 - RNA, 1701 nt, Artificial Sequence; identical to SEQ ID NO: 124685
  derived and/or modified sequence opt3 from hemagglutinin__InfluenzaA__AFN18809

SEQ ID NO: 131365 - RNA, 1701 nt, Artificial Sequence; identical to SEQ ID NO: 125787
  derived and/or modified sequence opt3 from hemagglutinin__InfluenzaA__AFN18816

SEQ ID NO: 131366 - RNA, 1701 nt, Artificial Sequence; identical to SEQ ID NO: 124685
  derived and/or modified sequence opt3 from hemagglutinin__InfluenzaA__AFN18818

SEQ ID NO: 131367 - RNA, 1701 nt, Artificial Sequence
  derived and/or modified sequence opt3 from hemagglutinin__InfluenzaA__AFN18820
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaacugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauuuucccgaaaacaagcuccuggcccaaccacgauucaaauaagggugucaccgccgcuuguccucaugcaggggccaagaguuuuuauaaaaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 131368 - RNA, 1701 nt, Artificial Sequence; identical to SEQ ID NO: 124685
  derived and/or modified sequence opt3 from hemagglutinin__InfluenzaA__AFN18822

SEQ ID NO: 131369 - RNA, 1701 nt, Artificial Sequence
  derived and/or modified sequence opt3 from hemagglutinin__InfluenzaA__AFN18824
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguacgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagaggagauugacggggucaggcuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 131370 - RNA, 1701 nt, Artificial Sequence; identical to SEQ ID NO: 131293
  derived and/or modified sequence opt3 from hemagglutinin__InfluenzaA__AFN18826

SEQ ID NO: 131371 - RNA, 1701 nt, Artificial Sequence
  derived and/or modified sequence opt3 from hemagglutinin__InfluenzaA__AFN18828
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccauuaagcugcgccuugccaccgggcugagaaacgugcccucaauacagaguaggggauuguuuggcgcgaucgccggcuucauugaagggggauggacugguauggucgacggcugguacggguaucaucaccagaaugaacaaggaagcggcuacgcagcugaucucaaauccacacagaacgccaucgacgagauaaccaauaaggugaacucuguuauugagaaaaugaauacgcaguuuaccgcuguggguaaggaguucaaccaccuggaaaagcggaucgaaaauuuaaacaaaaaggucgaugacggguuccuggauaucuggacauacaaugccgagcuccuugugcuguuggaaaacgagcgcacucuagacuaucaugauagcaauguaaagaaccuguacgagaagguucgaucacagcucaaaaacaaugcaaaggaaauuggcaacggauguuuugaguucuaucacaagugcgacaauaccuguauggaaagugugaaaaacggcacauacgauuauccuaaguacuccgaggaagccaaacugaauagagaggagaucgacggggucaaacuugaaagcacuaggauuuaucaaauacuggcuaucuacucuaccguggcgucaaguuugguccucgugguuagccugggagcaauuuccuuuuggaugugcucuaacgguucguuacagugccggaucuguaucuga

SEQ ID NO: 131372 - RNA, 1701 nt, Artificial Sequence; identical to SEQ ID NO: 131356
  derived and/or modified sequence opt3 from hemagglutinin__InfluenzaA__AFN18830

SEQ ID NO: 131373 - RNA, 1701 nt, Artificial Sequence; identical to SEQ ID NO: 124685
  derived and/or modified sequence opt3 from hemagglutinin__InfluenzaA__AFN18832

SEQ ID NO: 131374 - RNA, 1701 nt, Artificial Sequence; identical to SEQ ID NO: 125551
  derived and/or modified sequence opt3 from hemagglutinin__InfluenzaA__AFN18834

SEQ ID NO: 131375 - RNA, 1701 nt, Artificial Sequence
  derived and/or modified sequence opt3 from hemagglutinin__InfluenzaA__AFN18849
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacguggacgccuacgucuucguggggacuucucgcuauuccaagaaauuuaagccugagauugcgauccgaccaaaagugcgugaucaggagggaagaaugaauuacuauuggacccuggucgaacccggugacaagauuacauucgaggcaacuggcaaccuaguugugccuagguacgccuuugcuauggaacggaacgccgggagcggaaucauaauuucggauaccccaguacaugacugcaauacaaccugucaaacgccgaaaggcgcaaucaacacuucucuccccuuccagaauauucacccuaucacaaucgguaagugcccaaaguaugugaaauccaccaagcugcgccuugcuacugggcugagaaacguccccucaauucagaguaggggauuguuuggcgccauagcgggcuucaucgaagggggauggacagguaugguggacggcugguacggguaucaucaccagaaugaacaaggaagcggcuacgccgcagaucucaaauccacccagaacgcuauugacgagaucacgaauaagguuaacucugugauagagaaaaugaauacccaguuuacagccgucgguaaggaguucaaccaccuggaaaagcggauugaaaauuuaaacaaaaagguggaugacggguuccuggauaucuggacuuacaaugcugagcuccuuguacuguuggaaaacgagcgcacccuagacuaucaugauagcaauguuaaaaaccuguacgagaaggugcgaucacagcucaaaaacaaugccaaggaaaucggcaacggauguuuugaguucuaucacaagugcgacaauacauguauggaaagugucaaaaacggcacuuacgauuauccuaaguacuccgaggaagcaaaacugaauagagaggagauugacggggugaaacuugaaagcaccaggaucuaucaaauucuggccauauacucuacagucgcuucaaguuuggugcucguugugagccugggagcgaucuccuuuuggaugugcucuaacgguucguuacagugccggauuuguaucuga

SEQ ID NO: 131376 - RNA, 1701 nt, Artificial Sequence
  derived and/or modified sequence opt3 from hemagglutinin__InfluenzaA__AFN18856
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaaaauaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaccuagucguuccuagguacgcuuuugccauggaacggaaugcagggagcggaaucauaauuucggacaccccagugcaugauugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 131377 - RNA, 1701 nt, Artificial Sequence; identical to SEQ ID NO: 125546
  derived and/or modified sequence opt3 from hemagglutinin__InfluenzaA__AFN18858

SEQ ID NO: 131378 - RNA, 1701 nt, Artificial Sequence
  derived and/or modified sequence opt3 from hemagglutinin__InfluenzaA__AFN18860
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcgugaucaggagggaagaauggacuacuauuggacccugguggaaccaggugauaagauuacauucgaggccacuggcaaucuagucguucccagguacgcuuuugccauggaacggaacgcagggucgggaaucauaauuucugacaccccugugcaugacugcaacacaaccugucaaacgccaaaaggcgcuaucaauacuucccucccguuccagaacauucaccccaucacaaucgguaagugcccuaaguauguaaaaucaaccaagcugcgccuugccacugggcugagaaaugugccaaguauucagagcaggggauuguuuggcgcgauagccggcuucaucgaagggggauggacagguauggucgauggcugguacggguaucaucaccagaacgaacaaggauccggcuacgcagcugaccucaaaucuacccagaaugccauugaugagaucacgaacaaggugaauagcguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacucaaacguuaaaaaucuguacgagaagguacgaagucagcucaaaaacaacgcaaaggaaaucggcaauggauguuuugaguucuaucacaagugcgauaacacauguauggaauccgugaaaaauggcacuuacgacuaucccaaguacagcgaggaagccaaacugaacagagaggagauugauggggucaaacuugaaucuaccaggaucuaucaaauucuggcuauauacucaacaguggcgaguagcuugguccucgugguuucccugggagcaaucucuuuuuggaugugcucgaaugguagcuuacagugccggauuuguaucuga

SEQ ID NO: 131379 - RNA, 1701 nt, Artificial Sequence
  derived and/or modified sequence opt3 from hemagglutinin__InfluenzaA__AFN18865
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccucugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacaagaucacgaauaaagugaacagcguuauagagaagaugaauacccaguuuacagcuguggguaaggaguucaaccaccuggaaaaacggauugagaauuuaaacaagaaagucgaugacggguuccuggauaucuggacuuacaaugccgaacuccuugugcuguuggagaacgaacgcacccuagacuaucaugauucaaauguaaagaaccuguacgagaaaguucgaagucagcucaagaacaaugcaaaggagaucggcaacggauguuuugaguucuaucacaaaugcgacaauacauguauggaauccgugaagaacggcacuuacgauuaucccaaauacagcgaagaggccaagcugaauagagaagagauugacggggucaaacuugagucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 131380 - RNA, 1701 nt, Artificial Sequence
  derived and/or modified sequence opt3 from hemagglutinin__InfluenzaA__AFN18875
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugcccaacagaguuuguaccagaacgcggaugcauacguguucgucgggucuucccgcuauagcaaaaaguuuaaaccugagauugccauccgaccaaaggugcgugaccaggaaggaagaaugaauuacuauuggacucugguggagcccggugauaaaauuaccuucgaagcuacaggcaaccuagucguuccuagguacgccuuugcaauggagcggaacgcugggucgggaaucauaauuucugacacuccagugcaugauugcaauaccacaugucaaaccccgaagggcgccaucaacacgucccuccccuuccacaauauucauccuaucacuaucgguaaaugcccaaaguauguaaagucaacaaaacugcgccuugcgaccgggcugagaaacgugcccaguauucagagcaggggauuguuuggcgccauagcaggcuucaucgaagggggauggacugguauggucgacggcugguacggguaucaccaccagaaugagcagggauccggcuacgcugccgaccucaagucuacacaaaacgcuauugaugagaucaccaauaaagugaacagcguuauagaaaagaugaauacgcaguuuaccgccguggguaaagaguucaaccaucuggaaaagcggauugagaauuuaaacaagaaagucgacgauggguuccuggacaucuggacauacaaugcagaacuccuugugcuguuggagaacgagcgcacucuagauuaucacgacucaaauguaaagaaccuguacgaaaaaguucgaagucagcucaagaacaaugccaaagagaucggcaacggauguuuugaguucuaucauaagugcgauaauaccuguauggaauccgugaagaacggcacauacgacuauccuaaauacagcgaagaggcuaagcugaauagagaggaaauugauggggucaaacuugagucuacuaggaucuaucagauucuggcgauauacucaaccguggcaaguagcuugguccucgugguuucccugggagccaucucuuuuuggaugugcucgaacgguagcuuacaaugccggauuuguaucuga

SEQ ID NO: 131381 - RNA, 1701 nt, Artificial Sequence
  derived and/or modified sequence opt3 from hemagglutinin__InfluenzaA__AFN18885
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccgugaacuuacuggaagauaagcacaaugggaaacuauguaagcucagaggagucgcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauugacuacgaggagcucagggagcagcugagcaguguuuccucuuucgaacgguuugagaucuucccgaagacaagcuccuggcccaaucacgauucaaacaagggugugaccgccgcuuguccucaugcaggggccaaaaguuuuuauaagaaucugauauggcucgucaaaaagggaaacagcuacccaaaauuaucuaaguccuauaucaaugacaagggcaaagaagugcugguacuuuggggcauucaccaccccucaacgagcgcugaucaacagaguuuguaccagaacgccgacgcguacguuuucguggggacuucucgcuauuccaagaaauuuaagccugagaucgcaauucgaccaaaaguccgugaucaggagggaagaaugaauuacuauuggacccugguggaacccggugacaagaucacauucgaggccacuggcaaccuaguggucccuagguacgcuuuugccauggaacggaacgcagggagcggaauaauuaucucggauaccccaguucaugacugcaauacaaccugucaaacgccgaaaggcgcuauuaacacuaaucuccccuuccagaacauccacccuaucacaauugguaagugcccaaaguaugugaaaucuaccaagcugcgccuugccacugggcugagaaauguacccuccacacagucaaggggauuguuuggcgcgauagccggcuucaucgaagggggauggaccgguaugguggacggcugguacggguaucaucaccagaacgaacaaggaaguggcuacgcagcugaucucaaaagcacgcagaaugccauugacgagaucaccaacaaggucaauuccgugauagagaaaaugaacacacaguuuacugcuguugguaaggaguucaaucaccuggaaaagcggauugaaaacuuaaauaaaaagguggaugacggguuccuggauaucuggaccuacaacgccgagcuccuuguccuguuggaaaaugagcgcacacuagacuaucaugauucuaacgugaaaaaccuguacgagaagguacgaagccagcucaaaaauaacgcaaaggaaaucggcaauggauguuuugaguucuaucacaagugcgacaacacuuguauggaaucaguuaaaaauggcaccuacgauuauccuaaguacagugaggaagccaaacugaacagagaggagauugacggggugaaacuugaauccacaaggaucuaucaaauucuggcuauauacagcaccgucgcgucuucauuggugcucgucgugagucugggagcaaucagcuuuuggaugugcuccaaugguucuuuacagugcaagauuuguaucuga

SEQ ID NO: 131382 - RNA, 1701 nt, Artificial Sequence; identical to SEQ ID NO: 124685
  derived and/or modified sequence opt3 from hemagglutinin__InfluenzaA__AFN18892

SEQ ID NO: 131383 - RNA, 1701 nt, Artificial Sequence; identical to SEQ ID NO: 124927
  derived and/or modified sequence opt3 from hemagglutinin__InfluenzaA__AFN18894

SEQ ID NO: 131384 - RNA, 1701 nt, Artificial Sequence; identical to SEQ ID NO: 131349
  derived and/or modified sequence opt3 from hemagglutinin__InfluenzaA__AFN18903

SEQ ID NO: 131385 - RNA, 1701 nt, Artificial Sequence; identical to SEQ ID NO: 125787
  derived and/or modified sequence opt3 from hemagglutinin__InfluenzaA__AFN18910

SEQ ID NO: 131386 - RNA, 1701 nt, Artificial Sequence
  derived and/or modified sequence opt3 from hemagglutinin__InfluenzaA__AFN18912
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugaucaggaaggaagaaugaauuacuauuggacucugguggagcccggugacaaaauuaccuucgaagccacaggcaaccuagucguuccuagguacgcuuuugccauggagcggaacgcagggucgggaaucauaauuucugauacuuccgugcaugacugcaauaccacaugucaaaccccaaagggcgcuaucaacacgucacucccguuccacaauauucaucccaucacuaucgguaaaugcccuaaguauguaaagaguacaaaacugcgccuugccaccgggcugagaaacgugccaagcauucaguccaggggauuguuuggcgcgauagccggcuucaucgaagggggauggacugguauggucgacggcugguacggguaucaccaccagaaugagcagggaucuggcuacgcagcugaucucaagagcacacaaaacgccauugacgagaucaccaauaaagugaacucaguuauagaaaagaugaauacgcaguuuaccgcuguggguaaagaguucaaccaucuggaaaagcggauugagaauuuaaacaagaaagucgaugacggguuccuggauaucuggacauacaaugccgaacuccuugugcuguuggagaacgagcgcacucuagacuaucacgauaguaauguaaagaaccuguacgaaaaaguucgaucccagcucaagaacaaugcaaaagagaucggcaacggauguuuugaguucuaucauaagugcgacaauaccuguauggaaagcgugaagaacggcacauacgauuaucccaaauacucugaagaggccaagcugaauagagaggaaauugacggggucaaacuugagucaacuaggaucuaucagauucuggcuauauacaguaccguggcgagcuccuugguccucgugguuucucugggagcaaucucguuuuggaugugcagcaacgguuccuuacaaugccggauuuguaucuga

SEQ ID NO: 131387 - RNA, 1701 nt, Artificial Sequence; identical to SEQ ID NO: 125787
  derived and/or modified sequence opt3 from hemagglutinin__InfluenzaA__AFN18917

SEQ ID NO: 131388 - RNA, 1701 nt, Artificial Sequence; identical to SEQ ID NO: 124685
  derived and/or modified sequence opt3 from hemagglutinin__InfluenzaA__AFN18927

SEQ ID NO: 131389 - RNA, 1701 nt, Artificial Sequence; identical to SEQ ID NO: 127351
  derived and/or modified sequence opt3 from hemagglutinin__InfluenzaA__AFN18937

SEQ ID NO: 131390 - RNA, 1701 nt, Artificial Sequence
  derived and/or modified sequence opt3 from hemagglutinin__InfluenzaA__AFN18952
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacauauuagaagauaagcacaauagaaaacuguguaagcuaagggguguggcuccccuccaucugggaaaaugcaacaucgccgguuggauucuuggcaauccugagugugaaucucugucaacagcaaguagcugguccuacaucguugagaccucuucgucagacaacgggacuugcuauccaggagauuuuauugacuacgaagaguugcgggagcagcucagcaguguguccucuuucgaacgcuuugagaucuucccgaagacaagcuccuggcccaaucacgauucaaacaagggcgucaccgccgcuuguccucaugcaggggccaaaaguuuuuauaagaaucugauauggcuggugaaaaaggggaacagcuacccaaaacucucuaaguccuauaucaaugacaagggaaaagaaguauuaguucuguggggcauucaccaccccucaacgagcgcugaucaacagagucuuuaccagaacgccgacgcguacguguucgucggcacuucucgauauuccaagaaauuuaagccugagaucgcaauucguccaaaagugagagaucaggaggggaggaugaauuacuauuggaccuugguggaacccggagacaagaucacauucgaggccacugguaaccuggucguuccucgguacgcuuuugccauggaacgcaacgcaggcagcgggauaauuaucucggauaccccagugcaugacugcaauacaaccugucaaacgccgaaaggagcuauuaacacuucucuacccuuccagaauauccacccuaucacaauuggcaagugcccaaaguauguaaaauccaccaagcucagacuggccacuggucuuaggaacgugcccucaauacagagucgggggcuguuuggagcgaucgccggcuucauugagggcggguggacaggaauggucgacgguugguacggcuaucaucaccagaaugaacaagggagcggauacgcagcugauuugaaauccacccagaacgccaucgacgagauaacgaauaaggugaacucuguuauugagaaaaugaauacccaguuuacagcugugggcaaggaguucaaccaccucgaaaagcgcaucgaaaaucugaacaaaaaggucgaugacgguuucuuagauaucuggacuuacaaugccgagcugcucgugcuucuggaaaacgagcgaaccuuggacuaucaugauagcaauguuaaaaaccuauacgagaagguaagaucacagcugaaaaacaaugcaaaggaaauugggaacggcuguuuugaguucuaucacaagugcgacaauacauguauggaaagugugaaaaacggaacuuacgauuauccuaaguacuccgaggaagccaaacucaauagggagaagaucgacggcgucaaacuggagagcacccggauuuaucaaauacuugcuaucuacucuacaguggcgucaagucuggucuuggugguuagccucggggcaauuuccuuuuggaugugcucuaacggaucgcugcagugccguaucuguaucuga

SEQ ID NO: 131391 - RNA, 1701 nt, Artificial Sequence
  derived and/or modified sequence opt3 from hemagglutinin__InfluenzaA__AFN18957
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaaucacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucgacuacgaggagcucagggagcagcugagcaguguguccucuuucgaacgguuugagauuuucccgaaaacaagcuccuggcccaaccacgauucaaauaagggugucaccgccgcuuguccucaugcaggggccaagaguuuuuauaaaaaccugaucuggcucgugaagaaaggaaauagcuacccaaaguuaucuaaauccuauauaaacgacaagggcaaggaaguacugguucuuuggggcauccaccaccccucaacgagcgcugaucaacagaguuuguaccagaaugccgacgcguacguguucgucgggacuucucgcuauuccaaaaaguuuaaaccugagauugcaauccgaccaaaggugcgugaucaggagggaagaaugaacuacuauuggacccugguggaacccggugacaaaauuacauucgaggccacuggcaaccuagucguuccuagguacgcuuuugccauggaacggaaugcagggagcggaaucauaauuucggauaccccagugcaugacugcaacacaaccugucaaacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgacggcugguacggguaucaucaccagaacgaacaaggaagcggcuacgcagcugaucucaaguccacccagaaugccauugacgagaucacgaacaaaguuaauucugugauagagaagaugaacacccaguuuacagcuguggguaaagaguucaaucaccuggaaaagcggauugaaaacuuaaauaagaaagucgaugacggguuccuggauaucuggacuuacaacgccgagcuccuugugcuguuggaaaaugagcgcacccuagacuaucaugauagcaacguaaagaaccuguacgagaaaguucgaucacagcucaagaauaacgcaaaagaaaucggcaauggauguuuugaguucuaucacaagugcgacaacacauguauggaaagugugaagaauggcacuuacgauuauccuaaauacuccgaggaagccaagcugaacagagaggagauugacggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 131392 - RNA, 1701 nt, Artificial Sequence; identical to SEQ ID NO: 130774
  derived and/or modified sequence opt3 from hemagglutinin__InfluenzaA__AFN18964

SEQ ID NO: 131393 - RNA, 1701 nt, Artificial Sequence
  derived and/or modified sequence opt3 from hemagglutinin__InfluenzaA__AFN18974
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguauguccucuuucgaacgguuugagauuuucccgaagacaagcuccuggcccaaucacgauccuaacaagggugugaccgccgcuuguccacaugcaggggccaaaucauuuuauaagaaucugaucuggcucgucaaaaagggaaacaguuaccccaaauuaagcaagucuuauauaaaugacaagggcaaaaaggugcugguacuuuggggcauccaccacccuuccacgucagcugaucaacagagcuuguaccagaacgccgacgcguacguuuucguggggaccagucgcuauucuaaaaaguuuaaaccagaaauugcaauccgacccaagguccgugaucaggagggaagaaugaauuacuauuggacucugguggagccuggugacaaaauuacauucgaagccacuggcaaccuaguggucccaagguacgcuuuugccauggagcggaacgcaggguccggaaucauaauuagcgauaccccgguucaugacugcaauacaaccugucaaacgcccaagggcgcuaucaacacuucgcucccuuuccagaauauucacccaaucacaaucgguaagugccccaaauaugugaagucuaccaaacugcgccuugccacugggcugagaaacguaccuuccauucagucaaggggauuguuuggcgcgauagccggcuucaucgaagggggauggacagguaugguggacggcugguacggguaucaucaccagaaugagcaaggaaguggcuacgcagcugaucucaagagcacccagaacgccauugacgaaaucacgaauaaagucaacuccgugauagagaagaugaauacccaguuuacagcuguugguaaggaguucaaccaccuggaaaaacggauugagaauuuaaacaagaaaguggaugacggguuccuggauaucuggacuuacaaugccgaacuccuuguccuguuggagaacgaacgcacccuagacuaucaugauucuaaugugaagaaccuguacgagaaaguacgaagccagcucaagaacaaugcaaaggagaucggcaacggauguuuugaguucuaucacaaaugcgacaauacauguauggagucaguuaagaacggcacuuacgauuauccaaaauacagugacgaagccaagcugaauagagaggaaauugauggggugaaacuugaguccaccaggaucuaucaaauucuggcuauauacagcacagucgcgucuucauuggugcucgucgugagucugggagcaaucagcuuuuggaugugcuccaacgguucuuuacagugccggauuuguaucuga

SEQ ID NO: 131394 - RNA, 1701 nt, Artificial Sequence; identical to SEQ ID NO: 126237
  derived and/or modified sequence opt3 from hemagglutinin__InfluenzaA__AFN18979

SEQ ID NO: 131395 - RNA, 1701 nt, Artificial Sequence
  derived and/or modified sequence opt3 from hemagglutinin__InfluenzaA__AFN18982
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauugacuacgaggagcucagggagcagcugagcaguguguccucuuucgaacgguuugagaucuucccgaagacuaauagcuggcccaaccacgauuccaauaagggugucacagccgcuuguccucaugcaggggccaaaucauuuuauaagaaccugauauggcucgugaaaaagggaaauaguuacccaaaauuaagcaagucuuauaucaacgacaagggcaaagaaguacugguucuuuggggcauucaccaccccuccaccucagcugaucaacagagcuuguaccagaaugccgacgcguacguguucgucgggacgagucgcuauucuaagaaauuuaagccugagaucgcaauucgaccaaaagugcgugaucaggagggaagaaugaacuacuauuggacucugguggaacccggugacaagaucaccuucgaggccacaggcaaccuagucguuccuagguacgcuuuugccauggaacggaaugcaggguccggaauaauuaucagcgauacuccagugcaugacugcaacaccacaugucaaaccccgaaaggcgcuauuaauacgucgcuccccuuccagaacauccacccuaucacuauugguaagugcccaaaguauguaaaaucuacaaagcugcgccuugccaccgggcugagaaaugugcccuccauacagucaaggggauuguuuggcgcgaucgccggcuucauugaagggggauggacugguauggucgacggcugguacggguaucaucaccagaacgaacaaggaaguggcuacgcagcugaucucaaaagcacacagcacgccaucgacgagauaaccaauaaggugaacuccguuauugagaaaaugaauacgcaguuuaccgcuguggguaaggaguucaaccaucuggaaaagcggaucgaaaauuuaaacaaaaaggucgaugacggguuccuggauaucuggacauacaaugccgagcuccuugugcuguuggaaaacgagcgcacucuagacuaucacgauucuaauguaaagaaccuguacgagaagguucgaagccagcucaaaaacaaugcaaaggaaauuggcaacggauguuuugaguucuaucauaagugcgacaauaccuguauggaaucagugaaaaacggcacauacgauuauccuaaguacagugaggaagccaaacugaauagagaggagaucaacggggucaaacuugaauccacuaggauuuaucaaauacuggcuaucuacagcaccguggcgucuucauugguccucgugguuagucugggagcaauuagcuuuuggaugugcuccaaugguucuuuacagugccggaucuguaucuga

SEQ ID NO: 131396 - RNA, 1701 nt, Artificial Sequence; identical to SEQ ID NO: 131288
  derived and/or modified sequence opt3 from hemagglutinin__InfluenzaA__AFN18984

SEQ ID NO: 131397 - RNA, 1701 nt, Artificial Sequence; identical to SEQ ID NO: 124685
  derived and/or modified sequence opt3 from hemagglutinin__InfluenzaA__AFN18986

SEQ ID NO: 131398 - RNA, 1701 nt, Artificial Sequence; identical to SEQ ID NO: 124685
  derived and/or modified sequence opt3 from hemagglutinin__InfluenzaA__AFN18988

SEQ ID NO: 131399 - RNA, 1701 nt, Artificial Sequence; identical to SEQ ID NO: 125849
  derived and/or modified sequence opt3 from hemagglutinin__InfluenzaA__AFN18993

SEQ ID NO: 131400 - RNA, 1701 nt, Artificial Sequence; identical to SEQ ID NO: 125849
  derived and/or modified sequence opt3 from hemagglutinin__InfluenzaA__AFN18999

SEQ ID NO: 131401 - RNA, 1701 nt, Artificial Sequence; identical to SEQ ID NO: 125483
  derived and/or modified sequence opt3 from hemagglutinin__InfluenzaA__AFN19006

SEQ ID NO: 131402 - RNA, 1701 nt, Artificial Sequence; identical to SEQ ID NO: 124685
  derived and/or modified sequence opt3 from hemagglutinin__InfluenzaA__AFN19026

SEQ ID NO: 131403 - RNA, 1701 nt, Artificial Sequence; identical to SEQ ID NO: 125825
  derived and/or modified sequence opt3 from hemagglutinin__InfluenzaA__AFN19036

SEQ ID NO: 131404 - RNA, 1701 nt, Artificial Sequence; identical to SEQ ID NO: 124685
  derived and/or modified sequence opt3 from hemagglutinin__InfluenzaA__AFN19043

SEQ ID NO: 131405 - RNA, 1701 nt, Artificial Sequence; identical to SEQ ID NO: 124685
  derived and/or modified sequence opt3 from hemagglutinin__InfluenzaA__AFN19053

SEQ ID NO: 131406 - RNA, 1701 nt, Artificial Sequence; identical to SEQ ID NO: 124685
  derived and/or modified sequence opt3 from hemagglutinin__InfluenzaA__AFN19063

SEQ ID NO: 131407 - RNA, 1701 nt, Artificial Sequence; identical to SEQ ID NO: 124685
  derived and/or modified sequence opt3 from hemagglutinin__InfluenzaA__AFN19070

SEQ ID NO: 131408 - RNA, 1701 nt, Artificial Sequence
  derived and/or modified sequence opt3 from hemagglutinin__InfluenzaA__AFN19076
augaaggccauccuggugguccuccuuuacaccuucgcuacagcaaacgccgacacucugugcauuggcuaucacgcgaauaacagcacggauaccguugacacaguguuggagaaggauguaacugugacccauuccgucaauuuacuggaagacaagcacaacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucucgcuauuccaagaaauuuaagccugagauugcaauccgaccaaaagugcgugaccaggagggaagaaugaacuacuauuggacccugguggaacccggugauaagauuacauucgaggccacuggcaaucuagucguuccuagguacgcuuuugccauggaacggaacgcagggagcggaaucauaauuucggacaccccagugcaugacugcaacacaaccugucaaacgccgaaaggcgcuaucaauacuucucuccccuuccagaacauucacccuaucacaaucgguaagugcccaaaguauguaaaauccaccaagcugcgccuugccacugggcugagaaaugugcccucaauucagaguaggggauuguuuggcgcgauagccggcuucaucgaagggggauggacagguauggucgauggcugguacggguaucaucaccagaacgaacaaggaagcggcuacgcagcugaccucaaauccacccagaaugccauugaugagaucacgaacaagguaaauucuguuauagagaaaaugaacacccaguuuacagcuguggguaaggaguucaaucaccuggaaaagcggauugaaaacuuaaauaaaaaggucgacgauggguuccuggacaucuggacuuacaacgccgagcuccuugugcuguuggaaaaugagcgcacccuagauuaucaugacagcaacgugaaaaaucuguacgagaagguucgaucacagcucaaaaacaacgcaaaggaaaucggcaauggauguuuugaguucuaucacaagugcgauaacacauguauggaaagugugaaaaauggcacuuacgacuauccuaaguacuccgaggaagccaaacugaacagagaggagauugauggggucaaacuugaaagcaccaggaucuaucaaauucuggcuauauacucuacaguggcgucaaguuugguccucgugguuagccugggagcaaucuccuuuuggaugugcucuaaugguucguuacagugccggauuuguaucuga

SEQ ID NO: 131409 - RNA, 1701 nt, Artificial Sequence; identical to SEQ ID NO: 124685
  derived and/or modified sequence opt3 from hemagglutinin__InfluenzaA__AFN19082

SEQ ID NO: 131410 - RNA, 1701 nt, Artificial Sequence; identical to SEQ ID NO: 124685
  derived and/or modified sequence opt3 from hemagglutinin__InfluenzaA__AFN19088

SEQ ID NO: 131411 - RNA, 1701 nt, Artificial Sequence; identical to SEQ ID NO: 124685
  derived and/or modified sequence opt3 from hemagglutinin__InfluenzaA__AFN19097

SEQ ID NO: 131412 - RNA, 1701 nt, Artificial Sequence; identical to SEQ ID NO: 124685
  derived and/or modified sequence opt3 from hemagglutinin__InfluenzaA__AFN19104

SEQ ID NO: 131413 - RNA, 1701 nt, Artificial Sequence; identical to SEQ ID NO: 124685
  derived and/or modified sequence opt3 from hemagglutinin__InfluenzaA__AFN19113

SEQ ID NO: 131414 - RNA, 1701 nt, Artificial Sequence; identical to SEQ ID NO: 124685
  derived and/or modified sequence opt3 from hemagglutinin__InfluenzaA__AFN19119

SEQ ID NO: 131415 - RNA, 1701 nt, Artificial Sequence; identical to SEQ ID NO: 127196
  derived and/or modified sequence opt3 from hemagglutinin__InfluenzaA__AFN19125

SEQ ID NO: 131416 - RNA, 1701 nt, Artificial Sequence; identical to SEQ ID NO: 124685
  derived and/or modified sequence opt3 from hemagglutinin__InfluenzaA__AFN19134

SEQ ID NO: 131417 - RNA, 1701 nt, Artificial Sequence; identical to SEQ ID NO: 124685
  derived and/or modified sequence opt3 from hemagglutinin__InfluenzaA__AFN19144

SEQ ID NO: 131418 - RNA, 1701 nt, Artificial Sequence; identical to SEQ ID NO: 127240
  derived and/or modified sequence opt3 from hemagglutinin__InfluenzaA__AFN19154

SEQ ID NO: 131419 - RNA, 1701 nt, Artificial Sequence; identical to SEQ ID NO: 124685
  derived and/or modified sequence opt3 from hemagglutinin__InfluenzaA__AFN19164

SEQ ID NO: 131420 - RNA, 1701 nt, Artificial Sequence; identical to SEQ ID NO: 124685
  derived and/or modified sequence opt3 from hemagglutinin__InfluenzaA__AFN19174

SEQ ID NO: 131421 - RNA, 1701 nt, Artificial Sequence; identical to SEQ ID NO: 124685
  derived and/or modified sequence opt3 from hemagglutinin__InfluenzaA__AFN19184

SEQ ID NO: 131422 - RNA, 1701 nt, Artificial Sequence; identical to SEQ ID NO: 124685
  derived and/or modified sequence opt3 from hemagglutinin__InfluenzaA__AFN19194

SEQ ID NO: 131423 - RNA, 1701 nt, Artificial Sequence; identical to SEQ ID NO: 124685
  derived and/or modified sequence opt3 from hemagglutinin__InfluenzaA__AFN19203

SEQ ID NO: 131424 - RNA, 1701 nt, Artificial Sequence; identical to SEQ ID NO: 124685
  derived and/or modified sequence opt3 from hemagglutinin__InfluenzaA__AFN19213

SEQ ID NO: 131425 - RNA, 1701 nt, Artificial Sequence; identical to SEQ ID NO: 124685
  derived and/or modified sequence opt3 from hemagglutinin__InfluenzaA__AFN19223

SEQ ID NO: 131426 - RNA, 1701 nt, Artificial Sequence; identical to SEQ ID NO: 124685
  derived and/or modified sequence opt3 from hemagglutinin__InfluenzaA__AFN19233

SEQ ID NO: 131427 - RNA, 1701 nt, Artificial Sequence
  derived and/or modified sequence opt3 from hemagglutinin__InfluenzaA__AFN19243
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucuaaguauuccaaaaaguuuaaaccugagauugcaauccgcccaaaggugcgagaucaggagggacguaugaauuacuauuggacccugguggaacccggugacaaaauuacauucgaggccacuggcaaccuagucguuccuagauacgcuuuugccauggaaaggaacgcagggagcggaaucauaauuucggauaccccagugcaagacugcaauacaaccugucagacgccgaagggcgcuaucaacacuucucuccccuuccagaauauucauccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaccaucaaaaugaacagggaagcggcuacgcagcugaucucaaguccacccagaacgccauugacgagaucacgaauaaagugaacucuguuauagagaagaugaauacccaguuuacagcuguggguaaggaauuuaaccaccuggagaaaaggauugaaaauuuaaacaagaaagucgaugacggguuccuggauaucuggacuuacaaugccgagcuccuugugcuguuggaaaacgagcggacccuagacuaucacgauagcaauguaaagaaccuguacgagaaaguucgcucacaacucaagaacaaugcaaaggaaaucggcaacggauguuucgaguucuaucauaaaugcgacaauacauguauggaaagugugaagaacggcacuuacgauuauccuaaauacuccgaggaagccaagcugaaucgagaggagauugacggggucaaacuugaaagcaccagaaucuaucagauucuggcuauauacucuacaguggcgucaaguuugguccucgugguuagccugggagcaaucuccuuuuggaugugcucuaacgguucguuacagugcaggauuuguaucuga

SEQ ID NO: 131428 - RNA, 1701 nt, Artificial Sequence; identical to SEQ ID NO: 126801
  derived and/or modified sequence opt3 from hemagglutinin__InfluenzaA__AFN19250

SEQ ID NO: 131429 - RNA, 1701 nt, Artificial Sequence; identical to SEQ ID NO: 124685
  derived and/or modified sequence opt3 from hemagglutinin__InfluenzaA__AFN19259

SEQ ID NO: 131430 - RNA, 1701 nt, Artificial Sequence; identical to SEQ ID NO: 124685
  derived and/or modified sequence opt3 from hemagglutinin__InfluenzaA__AFN19269

SEQ ID NO: 131431 - RNA, 1701 nt, Artificial Sequence; identical to SEQ ID NO: 124685
  derived and/or modified sequence opt3 from hemagglutinin__InfluenzaA__AFN19279

SEQ ID NO: 131432 - RNA, 1701 nt, Artificial Sequence; identical to SEQ ID NO: 125546
  derived and/or modified sequence opt3 from hemagglutinin__InfluenzaA__AFN19286

SEQ ID NO: 131433 - RNA, 1701 nt, Artificial Sequence; identical to SEQ ID NO: 124685
  derived and/or modified sequence opt3 from hemagglutinin__InfluenzaA__AFN19295

SEQ ID NO: 131434 - RNA, 1701 nt, Artificial Sequence; identical to SEQ ID NO: 124685
  derived and/or modified sequence opt3 from hemagglutinin__InfluenzaA__AFN19305

SEQ ID NO: 131435 - RNA, 1701 nt, Artificial Sequence; identical to SEQ ID NO: 125551
  derived and/or modified sequence opt3 from hemagglutinin__InfluenzaA__AFN19315

SEQ ID NO: 131436 - RNA, 1701 nt, Artificial Sequence; identical to SEQ ID NO: 124685
  derived and/or modified sequence opt3 from hemagglutinin__InfluenzaA__AFN19325

SEQ ID NO: 131437 - RNA, 1701 nt, Artificial Sequence; identical to SEQ ID NO: 124685
  derived and/or modified sequence opt3 from hemagglutinin__InfluenzaA__AFN19335

SEQ ID NO: 131438 - RNA, 1701 nt, Artificial Sequence; identical to SEQ ID NO: 124685
  derived and/or modified sequence opt3 from hemagglutinin__InfluenzaA__AFN19344

SEQ ID NO: 131439 - RNA, 1701 nt, Artificial Sequence
  derived and/or modified sequence opt3 from hemagglutinin__InfluenzaA__AFN19351
augaagaccaucauugcccugagcuacauacucugccuuguguucgcucagaaacugcccggcaacgacaauuccauggcaacauuguguuuagggcaccaugccgucccuaacggaacuaucguuaagacgauuaccaaugaucaaaucgaggugacaaacgcgacugaacugguacaaaauucuucaauuggugagaucugcgacaguccacaccagauacuagauggcgaaaacuguacccucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacacuggaauuuaauaacgagaguuucaauuggaccgguguuacucagaacgggacauccucugcuugcauucggcgcagcaauaacuccuuuuucucacgacugaauuggcucacccauuuaaacuuuaaguauccagcacugaacgugacgaugcccaauaacgagcaguucgacaaguuguacaucuggggaguccaccauccuggcacugauaaagaccagauuuuucuuuaugcccaaaguagcggccguaucaccgugucuacaaagagaucccagcaggcuguaauaccaaauauugggucaaggccccggauccgcaacauuccuagcagaaucaguaucuacuggacuauuguuaaaccaggagauauacugcuaaucaauucuaccgguaaccucauugccccgaggggcuacuucaagauccgguccgggaaaagcucgauaaugcgcucugacgcgcccauuggaaaguguaauuccgaaugcaucacaccuaacggcucaaucccaaaugacaagcccuuucagaacgugaaucgaauuaccuauggugcauguccuagauacgucaaacaaaguacgcugaaacuugccacugggaugaggaacgugccagagaagcagacacggggaaucuucggcgcuauugccggcuuuauagaaaaugggugggagggaaugguggaugguugguauggcuuccgucaccagaacagcgaggggcgcggacaagcagcugaccugaaguccacccaggccgcgaucgaucagauuaauggcaaauugaacagacucaucgguaagacuaacgaaaaauuccaccagaucgagaaggaauuuucugaggucgaagggaggauucaagaccuggagaaguacguugaggauacaaaaauagacuuauggagcuauaaugccgaacugcucguggcacuugagaaccagcauaccaucgaucugacggacucagaaaugaauaaguuguucgagaaaaccaagaaacagcuacgggaaaacgcugaggauaugggcaauggaugcuuuaagauuuaccacaagugugacaacgccugcaucggcaguauucgaaaugggacauaugaucaugacguauaccgcgacgaggcucugaacaauagauuccagaucaaaggaguggaacucaaguccgguuacaaagauuggauacuguggaucagcuuugccauuucuugcuuccuucugugugucgcauugcucggcuuuaucaugugggccugccaaaaggggaacgugagguguaauauuugcaucuga

SEQ ID NO: 131440 - RNA, 1701 nt, Artificial Sequence; identical to SEQ ID NO: 131090
  derived and/or modified sequence opt3 from hemagglutinin__InfluenzaA__AFN19355

SEQ ID NO: 131441 - RNA, 1701 nt, Artificial Sequence; identical to SEQ ID NO: 131090
  derived and/or modified sequence opt3 from hemagglutinin__InfluenzaA__AFN19357

SEQ ID NO: 131442 - RNA, 1701 nt, Artificial Sequence; identical to SEQ ID NO: 131090
  derived and/or modified sequence opt3 from hemagglutinin__InfluenzaA__AFN19361

SEQ ID NO: 131443 - RNA, 1701 nt, Artificial Sequence
  derived and/or modified sequence opt3 from hemagglutinin__InfluenzaA__AFN19363
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagauuucuucaacaggugagaucugcgacaguccacaccagauacuagauggcgaaaauuguacccucaucgacgcucugcuuggggauccgcagugcgacggauuucaaaacaaaaagugggaucuguucguggagagaagcaaagccuauuccaauuguuaccccuaugacgucccugauuacgcaucuuugaggucgcucguggccucaagcggcacucuggaauuuaacaaugagaguuucaacuggacagguguuacccagaaugggacguccucugcuugcauucggcgcagcaacuccucauuuuucagucgacugaauuggcucacucauuuaaacuuuaaguauccagcacugaaugugaccaugcccaacaacgagcaguucgacaaguuguacaucuggggaguccaccauccuggcacagauaaagaccagauuuuucuuuaugcccaaagcucuggccguaucacuguguccaccaagagaucacagcaggcuguaauaccaaauauugggagcaggccccggauccgcaacauuccuaguagaaucucuaucuacuggacaauuguuaaaccaggagauauacugcuaaucaauuccaccgguaaccucauugccccgaggggcuacuucaagauccggagcgggaaaucgucuauaaugcgcuccgacgcgcccauuggaaaguguaauucagaaugcaucacgccuaacggcaguaucccaaaugacaagcccuuucagaacgugaaucgaauuacuuauggugcauguccuagauacgucaaacaaagcacacugaaacuugccaccgggaugaggaacgugccagagaagcagacucggggaaucuucggcgcuauugccggcuuuauagaaaaugggugggagggaaugguggaugguugguauggcuuccgucaccagaacuccgaggggcgcggacaagcagcugaccugaagucuacacaggccgcgaucgaucagauuaauggcaaauugaacagacucaucgguaagaccaaugaaaaauuccaccagaucgagaaggaauuuagcgaggucgaagggaggauucaagaccuggagaaguacguugaggauacgaaaauagacuuauggucauauaacgccgaacugcucguggcacuugagaaccagcauaccaucgaucugacagacagugaaaugaauaaguuguucgagaaaacuaagaaacagcuacgggaaaacgcugaggauaugggcaauggaugcuuuaagauuuaccacaagugugacaacgccugcaucggcuccauucgaaaugggaccuauaaccaugauguauaccgcgacgaggcucugaauaacagauuccagaucaaaggaguggaacucaagagcgguuacaaagacuggauacuguggaucucuuuugccauuucaugcuuccuucugugugucgcauugcucggcuuuaucaugugggccugccaaaaggggaauauuagguguaacaucugcauauga

SEQ ID NO: 131444 - RNA, 1701 nt, Artificial Sequence; identical to SEQ ID NO: 128998
  derived and/or modified sequence opt3 from hemagglutinin__InfluenzaA__AFN19365

SEQ ID NO: 131445 - RNA, 1701 nt, Artificial Sequence
  derived and/or modified sequence opt3 from hemagglutinin__InfluenzaA__AFN19367
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugugaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaggucacucguugccagcaguggaacucuggaauuuaacaaugaguccuucaacuggacaggcgugacccagaaugguacgucuagcgcuugcauccggcgcuccaacucaaguuucuuuagccgacugaauuggcucacucauuuaaacuuuaaguauccagcacugaaugucaccaugcccaacaacgagcaguucgacaagcuguacauuuggggagugcaccauccugggacagauaaagaccagaucuuuuuguaugcccaaucuuccggccguauuacuguaucaaccaagagaagccagcaggcuguuaucccaaauauaggcaguaggccccggauucgcaacaucccuucuagaauuuccaucuacuggacaaucgugaaaccaggggauauucugcuaauaaauagcaccggaaaccucaucgccccgagggguuacuucaagauucagucgggcaaaucuuccaucaugcggucagacgcgcccauagggaaguguaauagugaaugcauuacgccuaacggaagcaucccaaaugacaagcccuuucaaaacgucaaucgcaucacuuauggcgcauguccucgauacgugaaacaguccacacugaaacuugccaccgguaugagaaacgugccagagaagcagacuagggggauuuucggagcuaucgccggcuuuauugaaaauggcugggaggggauggucgauggaugguaugguuuccggcaccaaaacucugagggccgugggcaggcagcugaccuuaagagcacacaggccgcgauagaucagaucaauggaaaauugaaccgccucauuggcaagaccaaugaaaaauuccaccaaaucgagaaggaauuuucagagguugaagguagaauccaggaccuggagaaguacguggaggauacgaaaauugacuuauggaguuauaacgccgaacugcucguagcacuugagaaccagcauaccauagaucugacagacuccgaaaugaauaaguuguucgagaaaacuaagaaacagcuaagggaaaacgcugaggauauggggaauggcugcuuuaagaucuaccacaagugugacaacgccugcauuggaagcauccggaauggcaccuauaaccaugauguguaccgagacgaggcucugaauaaccgcuuccaaauuaaaggggucgaacucaagucuggauacaaagacuggauccuguggauaucauuugccaucaguugcuuccuucuguguguggcauugcucgguuuuauuaugugggccugccagaagggcaauaucagauguaacauuugcaucuga

SEQ ID NO: 131446 - RNA, 1701 nt, Artificial Sequence
  derived and/or modified sequence opt3 from hemagglutinin__InfluenzaA__AFN19369
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugugaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaggucacucguugccagcaguggaacucuggaauuuaacaaugaguccuucaacuggacaggcgugacccagaaugguacgucuagcgcuugcauccggcgcuccaacucaaguuucuuuagccgacugaauuggcucacucauuuaaacuuuaaguauccagcacugaaugucaccaugcccaacaacgagcaguucgacaagcuguacauuuggggagugcaccauccugggacagauaaagaccagaucuuuuuguaugcccaaucuuccggccguauuacuguaucaaccaagagaagccagcaggcuguuaucccaaauauaggcaguaggccccggauucgcaacaucccuucuagaauuuccaucuacuggacaaucgugaaaccaggggauauucugcuaauaaauagcaccggaaaccucaucgccccgagggguuacuucaagauucggucgggcaaaucuuccaucaugcgcucagacgcgcccauagggaaguguaauagugaaugcauuacgccuaacggaagcaucccaaaugacaagcccuuucagaacgucaaucgaaucacuuauggcgcauguccuagauacgugaaacaauccacacugaaacuugccaccgguaugaggaacgugccagagaagcagacucgggggauuuucggagcuaucgccggcuuuauugaaaauggcugggaggggauggucgauggaugguaugguuuccgucaccagaacucugagggccgcgggcaagcagcugaccuuaagagcacacaggccgcgauagaucagaucaauggaaaauugaacagacucauuggcaagaccaaugaaaaauuccaccagaucgagaaggaauuuucagagguugaagguaggauccaagaccuggagaaguacguggaggauacgaaaauugacuuauggaguuauaacgccgaacugcucguagcacuugagaaccagcauaccauagaucugacagacuccgaaaugaauaaguuguucgagaaaacuaagaaacagcuacgggaaaacgcugaggauauggggaauggcugcuuuaagaucuaccacaagugugacaacgccugcauuggaagcauccgaaauggcaccuauaaccaugauguguaccgcgacgaggcucugaauaacagauuccagauuaaaggggucgaacucaagucuggauacaaagacuggauccuguggauaucauuugccaucaguugcuuccuucuguguguggcauugcucgguuuuauuaugugggccugccaaaagggcaauaucagguguaacauuugcaucuga

SEQ ID NO: 131447 - RNA, 1701 nt, Artificial Sequence
  derived and/or modified sequence opt3 from hemagglutinin__InfluenzaA__AFN19373
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauaacuccuuuuucucacgacugaauuggcucacgcauuuaaacuuuaaguauccagcacugaacgugacuaugcccaauaacgagcaguucgacaaguuguacaucuggggaguccaccauccuggcaccgauaaagaccagauuuuucuuuaugcccaaaguagcggccguaucacagugucuacuaagagaucccagcaggcuguaauaccaaauauugggucaaggccccggauccgcaacauuccuagcagaaucaguaucuacuggaccauuguuaaaccaggagauauacugcuaaucaauucuacagguaaccucauugccccgaggggcuacuucaagauccgguccgggaaaagcucgauaaugcgcucugacgcgcccauuggaaaguguaauuccgaaugcaucaccccuaacggcucaaucccaaaugacaagcccuuucagaacgugaaucgaauuacguauggugcauguccuagauacgucaaacaaaguacucugaaacuugccacagggaugaggaacgugccagagaagcagacccggggaaucuucggcgcuauugccggcuuuauagaaaaugggugggagggaaugguggaugguugguauggcuuccgucaccagaacagcgaggggcgcggacaagcagcugaccugaaguccacucaggccgcgaucgaucagauuaauggcaaauugaacagacucaucgguaagacaaacgaaaaauuccaccagaucgagaaggaauuuucugaggucgaagggaggauucaagaccuggagaaguacguugaggauaccaaaauagacuuauggagcuauaaugccgaacugcucguggcacuugagaaccagcauacgaucgaucugaccgacucagaaaugaauaaguuguucgagaaaacaaagaaacagcuacgggaaaacgcugaggauaugggcaauggaugcuuuaagauuuaccacaagugugacaacgccugcaucggcaguauucgaaaugggacuuaugaucaugacguauaccgcgacgaggcucugaacaauagauuccagaucaaaggaguggaacucaaguccgguuacaaagauuggauacuguggaucagcuuugccauuucuugcuuccuucugugugucgcauugcucggcuuuaucaugugggccugccaaaaggggaacauuagguguaauaucugcauauga

SEQ ID NO: 131448 - RNA, 1701 nt, Artificial Sequence; identical to SEQ ID NO: 131090
  derived and/or modified sequence opt3 from hemagglutinin__InfluenzaA__AFN19375

SEQ ID NO: 131449 - RNA, 1701 nt, Artificial Sequence
  derived and/or modified sequence opt3 from hemagglutinin__InfluenzaA__AFN19377
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugugaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaggucacucguugccagcaguggaacucuggaauuuaacaaugaguccuucaacuggacaggcgugacccagaaugguacgucuagcgcuugcauccggcgcuccaacucaaguuucuuuagccgacugaauuggcucacucauuuaaacuuuaaguauccagcacugaaugucaccaugcccaacaacgagcaguucgacaagcuguacauuuggggagugcaccauccugggacagauaaagaccagaucuuuuuguaugcccaaucuuccggccguauuacuguaucaaccaagagaagccagcaggcuguuaucccaaauauaggcaguaggccccggauucgcaacaucccuucuagaauuuccaucuacuggacaaucgugaaaccaggggauauucugcuaauaaauagcaccggaaaccucaucgccccgagggguuacuucaagauucggucgggcaaaucuuccaucaugcgcucagacgcgcccauagggaaguguaauagugaaugcauuacgccuaacggaagcaucccaaaugacaagcccuuucagaacgucaaucgaaucacuuauggcgcauguccuagauacgugaaacaauccacacugaaacuugccaccgguaugaggaacgugccagagaagcagacucgggggauuuucggagcuaucgccggcuuuauugaaaauggcugggaggggauggucgauggaugguaugguuuccgucaccagaacucugagggccgcgggcaagcagcugaccuuaagagcacacaggccgcgauagaucagaucaauggaaaauugaacagacucauuggcaagaccaaugaaaaauuccaccagaucgagaaggaauuuucagagguugaagguaggauccaagaccuggagaaguacguggaggauacgaaaauugacuuauggaguuauaacgccgaacugcucguagcacuugagaaccagcauaccauagaucugacagacuccgaaaugaauaaguuguucgagaaaacuaagaaacagcuacgggaaaacgcugaggauauggggaauggcugcuuuaagaucuaccacaagugugacaacgccugcauuggaagcauccgaaauggcaccuauaaccaugauguguaccgcgacgaggcucugaauaacagauuccagauuaaaggggucgaacucaagucuggauacaaagacuggauccuguggauaucauuugccaucaguugcuuccuucuguguguggcauugcucgguuuuauuaugugggccugccaaaauggcaacaucagguguaauauuugcaucuga

SEQ ID NO: 131450 - RNA, 1701 nt, Artificial Sequence; identical to SEQ ID NO: 131090
  derived and/or modified sequence opt3 from hemagglutinin__InfluenzaA__AFN19379

SEQ ID NO: 131451 - RNA, 1701 nt, Artificial Sequence; identical to SEQ ID NO: 131447
  derived and/or modified sequence opt3 from hemagglutinin__InfluenzaA__AFN19381

SEQ ID NO: 131452 - RNA, 1701 nt, Artificial Sequence; identical to SEQ ID NO: 131446
  derived and/or modified sequence opt3 from hemagglutinin__InfluenzaA__AFN19383

SEQ ID NO: 131453 - RNA, 1701 nt, Artificial Sequence
  derived and/or modified sequence opt3 from hemagglutinin__InfluenzaA__AFN19385
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugugaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaggucacucguugccagcaguggaacucuggaauuuaacaaugaguccuucaacuggacaggcgugacccagaaugguacgucuagcgcuugcauccggcgcuccaacucaaguuucuuuagccgacugaauuggcucacucauuuaaacuuuaaguauccagcacugaaugucaccaugcccaacaacgagcaguucgacaagcuguacauuuggggagugcaccauccugggacagauaaagaccagaucuuuuuguaugcccaaucuuccggccguauuacuguaucaaccaagagaagccagcaggcuguuaucccaaauauaggcaguaggccccggauucgcaacaucccuucuagaauuuccaucuacuggacaaucgugaaaccaggggauauucugcuaauaaauagcaccggaaaccucaucgccccgagggguuacuucaagauucagucgggcaaaucuuccaucaugcggucagacgcgcccauagggaaguguaauagugaaugcauuacgccuaacggaagcaucccaaaugacaagcccuuucaaaacgucaaucgcaucacuuauggcgcauguccucgauacgugaaacaguccacacugaaacuugccaccgguaugagaaacgugccagagaagcagacuagggggauuuucggagcuaucgccggcuuuauugaaaauggcugggaggggauggucgauggaugguaugguuuccggcaccaaaacucugagggccgugggcaggcagcugaccuuaagagcacacaggccgcgauagaucagaucaauggaaaauugaaccgccucauuggcaagaccaaugaaaaauuccaccaaaucgagaaggaauuuucagagguugaagguagaauccaggaccuggagaaguacguggaggauacgaaaauugacauauggaguuauaacgccgaauuacugguagcacucgagaaccagcauaccaucgaucuuacagacuccgaaaugaauaagcuguucgagaaaacuaagaaacaguugagggaaaacgcugaggauauggggaauggcugcuuuaagauuuaccacaagugugacaacgccugcaucggaagcauucggaauggcaccuauaaccaugauguguaccgagacgaggcucuaaauaaccgcuuccaaaucaaaggggucgaacugaagucuggauacaaagacuggauacucuggaucucauuugccauuaguugcuuccugcuuuguguggcacuguuggguuuuaucaugugggccugccagaagggcaauauuagauguaacaucugcauauga

SEQ ID NO: 131454 - RNA, 1701 nt, Artificial Sequence; identical to SEQ ID NO: 131446
  derived and/or modified sequence opt3 from hemagglutinin__InfluenzaA__AFN19387

SEQ ID NO: 131455 - RNA, 1701 nt, Artificial Sequence; identical to SEQ ID NO: 131090
  derived and/or modified sequence opt3 from hemagglutinin__InfluenzaA__AFN19389

SEQ ID NO: 131456 - RNA, 1701 nt, Artificial Sequence; identical to SEQ ID NO: 131090
  derived and/or modified sequence opt3 from hemagglutinin__InfluenzaA__AFN19391

SEQ ID NO: 131457 - RNA, 1701 nt, Artificial Sequence
  derived and/or modified sequence opt3 from hemagglutinin__InfluenzaA__AFN19393
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaaaaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaacccguggaaucuucggcgcaauugcuggcuuuaucgaaaacgggugggagggaaugauggaugguugguauggcuuccgccaccagaauagcgaggggagaggacaggccgcggaccugaaauccacucaagccgcaauugaucagauaaacggcaaguugaauaggcucaucgguaaaacaaacgaaaaguuccaucagauugagaaagaauuuucugaggucgaagggcggauccaggaccuggagaaguacguugaggauaccaagaucgacuuauggagcuauaacgcugaacugcucguggcccuugagaaucaacacacgauugaucugaccgacucagaaaugaacaaauuguucgagaagacaaagaagcagcuacgagaaaaugcugaggauaugggcaacggaugcuuuaaaauauaccauaagugugacaaugccugcaucggcaguauucgcaacgggacuuaugaucacgacguauacagagacgaggcacuguccaauagguuccagaucaagggaguggaacucaaaagcgguuacaaggauuggauucuguggaucucuuuugccauaucaugcuuccuucugugugucgcuuugcucggcuuuaucaugugggcgugccagaaagggaacauucgguguaauaucugcauuuga

SEQ ID NO: 131458 - RNA, 1701 nt, Artificial Sequence; identical to SEQ ID NO: 131446
  derived and/or modified sequence opt3 from hemagglutinin__InfluenzaA__AFN19397

SEQ ID NO: 131459 - RNA, 1701 nt, Artificial Sequence; identical to SEQ ID NO: 131090
  derived and/or modified sequence opt3 from hemagglutinin__InfluenzaA__AFN19399

SEQ ID NO: 131460 - RNA, 1701 nt, Artificial Sequence; identical to SEQ ID NO: 131446
  derived and/or modified sequence opt3 from hemagglutinin__InfluenzaA__AFN19401

SEQ ID NO: 131461 - RNA, 1701 nt, Artificial Sequence; identical to SEQ ID NO: 131090
  derived and/or modified sequence opt3 from hemagglutinin__InfluenzaA__AFN19403

SEQ ID NO: 131462 - RNA, 1701 nt, Artificial Sequence; identical to SEQ ID NO: 131446
  derived and/or modified sequence opt3 from hemagglutinin__InfluenzaA__AFN19405

SEQ ID NO: 131463 - RNA, 1701 nt, Artificial Sequence
  derived and/or modified sequence opt3 from hemagglutinin__InfluenzaA__AFN19407
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugguccgguguuacucagaacgggacaucuagcgcuugcaugcggcgcuccaauucaaguuucuuuagccgacugaacuggcucacccauuuaaauuuuaaguauccagcacugaacgugacgaugcccaacaaugagcaguucgacaagcuguacauuuggggaguccaccauccuggcacugauaaagaccagaucuuuuuguaugcccaaucuuccggccguauuaccgugucaacaaagagaagccagcaggcuguaaucccaaacauagggaguaggccccggauucgcaauaucccuucuagaauuuccaucuacuggacuaucguuaaaccaggagauauucugcuaauaaacagcaccgguaaucucaucgccccgaggggcuacuucaagauucggucggggaaaucuuccaucaugcgcucagacgcgcccauaggaaaguguaacagugaaugcauuacaccuaauggcagcaucccaaacgacaagcccuuucagaaugugaaccgaaucaccuauggugcauguccuagauacgucaaacaauccacgcugaaacuugccacugggaugaggaaugugccagagaagcagacacggggaauuuucggcgcuaucgccggcuuuauugaaaacgggugggagggaaugguggaugguugguauggcuuccgucaccaaaauucugaggggcgcggacaggcagcugaccuuaagagcacccaggccgcgauagaucagaucaacggcaaauugaauagacucauugguaagacuaacgaaaaauuccaccagaucgagaaggaauuuucagaggucgaagggaggauccaagaccuggagaaguacguugaggauacaaaaauugacuuauggaguuauaacgccgaacugcucguggcacuugagaaucagcauaccauagaucugacggacuccgaaaugaacaaguuguucgagaaaaccaagaaacagcuacgggaaaaugcugaggauaugggcaacggaugcuuuaagaucuaccacaagugugacaaugccugcauuggcagcauccgaaacgggacauaugaucaugacguauaccgcgacgaggcucugaauaacagauuccagauuaaaggaguggaacucaagucugguuacaaagauuggauccuguggauaucauuugccaucaguugcuuccuucugugugucgcauugcucggcuuuauuaugugggccugccaaaaggggaauaucagguguaacauuugcaucuga

SEQ ID NO: 131464 - RNA, 1701 nt, Artificial Sequence
  derived and/or modified sequence opt3 from hemagglutinin__InfluenzaA__AFN19409
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguauuggugagaucugcgacagcccacaccagauacuagauggcgaaaauuguacacucaucgacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacccuggaauuuaacaaugaguccuucaacuggacugguguuacacagaaugggaccucuagcgcuugcauucggcgcuccaacucaaguuucuuuagccgacugaauuggcucacgcauuuaaacuuuaaguauccagcacugaaugugacuaugcccaacaacgagcaguucgacaagcuguacaucuggggaguccaccauccuggcaccgauaaagaccagauuuuucuuuaugcccaaucuuccggccguaucacagugucaacuaagagaagccagcaggcuguaauaccaaauauugggaguaggccccggauccgcaacauuccuucuagaaucuccaucuacuggaccauuguuaaaccaggagauauacugcuaaucaauagcacagguaaccucauugccccgaggggcuacuucaagauccggucggggaaaucuuccauaaugcgcucagacgcgcccauuggaaaguguaauagugaaugcaucaccccuaacggcagcaucccaaaugacaagcccuuucagaacgugaaucgaauuacguauggugcauguccuagauacgucaaacaauccacucugaaguuggccacagggaugaggaacgugccagagaaacagacccggggaaucuucggcgcuauugccggcuuuauagaaaaugggugggagggaaugguggaugguugguauggcuuccgucaccagaacucugaggggcgcggacaagcagcugaccuuaagagcacucaggccgcgaucgaucagauuaauggcaaauugaacagacucaucgguaagacaaaugaaaaauuccaccagaucgagaaggaauuuucagaggucgaagggaggauucaagaccuggagaaguacguugaggauaccaaaauagacuuauggaguuauaacgccgaacugcucguggcacuugagaaccagcauacgaucgaucugaccgacuccgaaaugaauaaguuguucgagaaaacaaagaaacagcuacgggaaaacgcugaggauaugggcaauggaugcuuuaagauuuaccacaagugugacaacgccugcaucggcagcauucgaaaugggacuuauaaccaugauguauaccgcgacgaggcucugaauaacagauuccagaucaaaggaguggaacucaagucugguuacaaagacuggauacuguggaucucauuugccauuaguugcuuccuucugugugucgcauugcucggcuuuaucaugugggccugccaaaaggggaauauuagguguaacaucugcauauga

SEQ ID NO: 131465 - RNA, 1701 nt, Artificial Sequence; identical to SEQ ID NO: 131446
  derived and/or modified sequence opt3 from hemagglutinin__InfluenzaA__AFN19411

SEQ ID NO: 131466 - RNA, 1701 nt, Artificial Sequence; identical to SEQ ID NO: 131090
  derived and/or modified sequence opt3 from hemagglutinin__InfluenzaA__AFN19413

SEQ ID NO: 131467 - RNA, 1701 nt, Artificial Sequence
  derived and/or modified sequence opt3 from hemagglutinin__InfluenzaA__AFN19415
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccgugaugcgcucagacgcgcccaucggaaaguguaauagugaaugcauaacgccuaacggcagcauuccaaaugacaagcccuuucagaacgucaaucgaaucacuuauggugcauguccuagauacgugaaacaauccacacugaaacuugccaccgggaugaggaacgugccagagaagcagacucggggaaucuucggcgcuauugccggcuuuaucgaaaaugggugggagggaauggucgaugguugguauggcuuccgucaccagaacucugaggggcgcggacaagcagcugaccuuaagagcacacaggccgcgauugaucagauaaauggcaaauugaacagacucaucgguaagaccaaugaaaaauuccaccagauugagaaggaauuuucagagguugaagggaggauccaagaccuggagaaguacguggaggauacgaaaaucgacuuauggaguuauaacgccgaacugcucguagcacuugagaaccagcauaccauugaucugacagacuccgaaaugaauaaguuguucgagaaaacuaagaaacagcuacgggaaaacgcugaggauaugggcaauggaugcuuuaagauauaccacaagugugacaacgccugcaucggcagcauucgaaaugggaccuauaaccaugauguguaccgcgacgaggcucugaauaacagauuccagaucaaaggagucgaacucaagucugguuacaaagacuggauucuguggaucucauuugccauaaguugcuuccuucuguguguggcauugcucggcuuuaucaugugggccugccaaaaggggaauauuagguguaacaucugcauuuga

SEQ ID NO: 131468 - RNA, 1701 nt, Artificial Sequence
  derived and/or modified sequence opt3 from hemagglutinin__InfluenzaA__AFN19417
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucaucgccagcaguggcacucuggaauuuaacaaugaguccuucaacuggacaggugugacccagaaugggacgucuagcgcuugcauucggcgcuccaacucaaguuucuuuagccgacugaauuggcucacucauuuaaacuuuaaguauccagcacugaauguuaccaugcccaacaacgagcaguucgacaagcuguacaucuggggagugcaccauccuggcacagauaaagaccagauuuuucuuuaugcccaaucuuccggccguaucacugucucaaccaagagaagccagcaggcugugauaccaaauauugggaguaggccccggauccgcaacauuccuucuagaaucuccaucuacuggacaauuguaaaaccaggagauauacugcuaaucaauagcaccgguaaccucauugccccgaggggcuacuucaagauccggucggggaaaucuuccauaaugcgcucagacgcgcccauuggaaaguguaauagugaaugcaucacgccuaacggcagcaucccaaaugacaagcccuuucagaacguuaaucgaauuacuuauggugcauguccuagauacgugaaacaauccacacugaaguuggccaccgggaugaggaacgucccagagaaacagacucggggaaucuucggcgcuauugccggcuuuauagaaaaugggugggagggaaugguggaugguugguauggcuuccgucaccagaacucugaggggcgcggacaagcagcugaccuuaagagcacacaggccgcgaucgaucagauuaauggcaaauugaacagacucaucgguaagaccaaugaaaaauuccaccagaucgagaaggaauuuucagagguggaagggaggauucaagaccuggagaaguacgucgaggauacgaaaauagacuuauggaguuauaacgccgaacugcucguugcacuugagaaccagcauaccaucgaucugacagacuccgaaaugaauaaguuguucgagaaaacuaagaaacagcuacgggaaaacgcugaggauaugggcaauggaugcuuuaagauuuaccacaagugugacaacgccugcaucggcagcauucgaaaugggaccuauaaccaugauguguaccgcgacgaggcucugaauaacagauuccagaucaaaggaguagaacucaagucugguuacaaagacuggauacuguggaucucauuugccauuaguugcuuccuucuguguguggcauugcucggcuuuaucaugugggccugccaaaaggggaauauuagguguaacaucugcauauga

SEQ ID NO: 131469 - RNA, 1701 nt, Artificial Sequence
  derived and/or modified sequence opt3 from hemagglutinin__InfluenzaA__AFN19423
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucaugacguauacagagacgaggcucugaauaacagguuccagaucaagggaguggaacucaaauccgguuacaaggauuggauacuguggaucagcuuugccauuucuugcuuccuucugugugucgcauugcucggcuuuaucaugugggccugccagaaagggaauauucgguguaacaucugcauauga

SEQ ID NO: 131470 - RNA, 1701 nt, Artificial Sequence; identical to SEQ ID NO: 131446
  derived and/or modified sequence opt3 from hemagglutinin__InfluenzaA__AFN19425

SEQ ID NO: 131471 - RNA, 1701 nt, Artificial Sequence
  derived and/or modified sequence opt3 from hemagglutinin__InfluenzaA__AFN19437
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauuccucauuuuucagucgacugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccaaagcucuggccguauuacaguguccacuaagagaucacagcaggcuguaauaccaaacauugggagcaggccccggauccgcaauauuccuaguagaaucucuaucuacuggaccauuguuaaaccaggagauauacugcuaaucaacuccacagguaaucucauugccccgaggggcuacuuccggauccgcagcgggaagucgucuauaaugcgauccgacgcgcccauuggaaaauguaacucagaaugcaucaccccuaauggcaguaucccaaacgacaagcccuuucagaaugugaacagaauuacguauggugcauguccuagguacgucaagcaaagcacucugaaacuugccacagggaugcggaaugugccagagaagcagacccguggaaucuucggcgcuauugccggcuuuauagaaaacgggugggagggaaugguggaugguugguauggcuuccgccaccaaaauuccgaggggagaggacaggcagcugaccugaaaucuacucaggccgcgaucgaucagauuaacaggaaguugaaucggcucaucggcaaaacaaacgaaaaguuccaccagaucgagaaagaauuuagcgaggucgaaggucgcauucaagaccuggagaaguacguugaggauaccaagauagacuuauggucauauaacgccgaacugcucguggcacuugagaaucagcauacgaucgaucugaccgacagugaaaugaacaaauuguucgagaagacaaagaagcagcuacgagaaaaugcugaggauauggggaacggcugcuuuaaaauuuaccacaagugugacaaugccugcaucggauccauuagaaacggcacuuaugaucauuacguauacagggacgaggcucugaauaaccgguuccagaucaaggggguggaacucaaaagcggauauaaggacuggauacuguggaucucuuuugccauuucaugcuuccuucugugugucgcauugcucgguuuuaucaugugggccugccaaaaaggcaauauucgcuguaacaucugcauauga

SEQ ID NO: 131472 - RNA, 1701 nt, Artificial Sequence
  derived and/or modified sequence opt3 from hemagglutinin__InfluenzaA__AFN19439
augaagaccaucauugcccugagccacauacucugccuuguguucgcucagaaacugcccgagaacgacaauuccacagcaacuuuguguuuaggccaucacgccgucccuaacgggacgaucguuaagaccauuacaaaugaucaaaucgaagugacuaacgcgaccgagcugguacagucuucaaguacaggagaaauuugcgacagcccacaucagauccuagaugguauaaauuguacccucaucgacgcucugcuuggcgauccgcagugcgacggguuucaaaacaaaaagugggaucuguucguggagagauccaaagccuacucuaauuguuaucccuacgacgucccugauuaugcaucguugaggucacucguggccagcaguggaacucuggaauuuaacaaugaguccuucaacuggacaggcguuacccagaaugguacgucuagcgcuugcauucggcgcuccaacucaaguuucuuuagccgacugaauuggcucacucacuuaaacuuuaaguacccagcacugaaugugaccaugcccaacaacgagcaguucgacaaguuguauaucuggggaguccaucacccugggacagauaaagaccagauuuuucuuuacgcccaaccaucuggccguaucacuguguccaccaagagaucacagcaggcuguaauacccaauauuggcagcaggccucggauccgcaacauuccaaguagaaucucuaucuauuggacaauuguuaaaccgggggauauacugcuaaucaauuccaccggaaaccucauugcccccagggguuacuucaagauccggagcggcaaaucgucuauaaugcgcuccgacgcgccuauugggaaguguaauucagaaugcaucacgccaaacggaaguauccccaaugacaagccuuuucagaacgugaaucgaauuacuuacggcgcauguccaagauaugucaaacaaagcacacugaaacuugccaccgguaugaggaacgugcccgagaagcagacucgggggaucuucggagcuauugccggcuuuauagaaaauggcugggaggggaugguggauggaugguacgguuuccgucaccagaacuccgagggccgcgggcaagcagcugaccugaagucuacacaggccgcgaucgaucagauuaauggaaaauugaacagacucaucggcaagaccaaugaaaaauuccaucagaucgagaaggaauuuagcgaggucgaagguaggauucaagaccuggagaaguauguugaggauacgaaaauagacuuauggucauacaacgccgaacugcucguggcacuugagaaccagcacaccaucgaucugacagacagugaaaugaauaaguuguucgagaaaacuaagaaacagcuacgggaaaacgcugaggauauggggaauggcugcuuuaagauuuaucauaagugugacaacgccugcaucggauccauucgaaauggcaccuacaaccacgauguauaucgcgacgaggcucugaauaacagauuccagaucaaagggguggaacucaagagcggauacaaagacuggauacuguggaucucuuuugccauuucaugcuuccuucugugugucgcauugcucgguuuuaucaugugggccugccaaaagggcaauauuagguguaacaucugcauauga

SEQ ID NO: 131473 - RNA, 1701 nt, Artificial Sequence; identical to SEQ ID NO: 131447
  derived and/or modified sequence opt3 from hemagglutinin__InfluenzaA__AFN19443

SEQ ID NO: 131474 - RNA, 1701 nt, Artificial Sequence
  derived and/or modified sequence opt3 from hemagglutinin__InfluenzaA__AFN19445
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaguuguacaucuggggaguccaccauccuggcaccgauaaagaccagauuuuucuuuaugcccagaguagcggcagaaucacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugcggcuugccacagggaugcguaaugugccagagaaacaaacccgcggaaucuucggcgcuauugccggcuuuauagaaaacgggugggagggaaugguggaugguugguauggcuucagacaccagaauagcgaggggaggggacaggcagcugaccugaaguccacucaagccgcgaucgaucagauuaacggcaaauugaaucggcucaucgguaagacaaacgaaaaauuccaccagaucgagaaggaauuuucugaggucgaagggcgcauucaggaccuggagaaguacguugaggauaccaaaauagacuuauggagcuauaacgccgaacugcucguggcacuugagaaucaacauacgaucgaucugaccgacucagaaaugaacaaguuguucgagaaaacaaagaaacagcuacgagaaaaugcugaggauaugggcaacggaugcuuuaagauuuaccacaagugugacaaugccugcaucggcaguauuagaaacgggacuuaugaucaugacguauacagggacgaggcucugaauaaccgguuccagaucaaaggaguggaacucaaguccgguuacaaagauuggauacuguggaucagcuuugccauuucuugcuuccuucugugugucgcauugcucggcuuuaucaugugggccugccagaaggggaauauucgcuguaacaucugcauauga

SEQ ID NO: 131475 - RNA, 1701 nt, Artificial Sequence; identical to SEQ ID NO: 131469
  derived and/or modified sequence opt3 from hemagglutinin__InfluenzaA__AFN19447

SEQ ID NO: 131476 - RNA, 1701 nt, Artificial Sequence
  derived and/or modified sequence opt3 from hemagglutinin__InfluenzaA__AFN19451
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauuccucauuuuucagucgacugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccaaagcucuggccguaucacaguguccacuaagagaucacagcaggcuguaauaccaaacauugggagcaggccccggauccgcaauauuccuaguagaaucucuaucuacuggaccauuguuaaaccaggagauauacugcuaaucaacuccacagguaaucucauugccccgaggggcuacuucaagauccggagcgggaaaucgucuauaaugcgcuccgacgcgcccauuggaaaguguaacucagaaugcaucaccccuaauggcaguaucccaaacgacaagcccuuucagaaugugaaccgaauuacguauggugcauguccuagauacgucaaacaaagcacucugaaacuugccacagggaugaggaaugugccagagaagcagacccggggaaucuucggcgcuauugccggcuuuauagaaaacgggugggagggaaugguggaugguugguauggcuuccgucaccaaaauuccgaggggcgcggacaggcagcugaccugaagucuacucaggccgcgaucgaucagauuaacggcaaauugaauagacucaucgguaagacaaacgaaaaauuccaccagaucgagaaggaauuuagcgaggucgaagggaggauucaagaccuggagaaguacguugaggauaccaaaauagacuuauggucauauaacgccgaacugcucguggcacuugagaaucagcauacgaucgaucugaccgacagugaaaugaacaaguuguucgagaaaacaaagaaacagcuacgggaaaaugcugaggauaugggcaacggaugcuuuaagauuuaccacaagugugacaaugccugcaucggcuccauucgaaacgggacuuaugaucaugacguauaccgcgacgaggcucugaauaacagauuccagaucaauggaguggaacucaaaagcgguuacaaggauuggauacuguggaucucuuuugccauuucaugcuuccuucugugugucgcauugcucggcuuuaucaugugggccugccaaaaagggaacauuagguguaauaucugcauauga

SEQ ID NO: 131477 - RNA, 1701 nt, Artificial Sequence
  derived and/or modified sequence opt3 from hemagglutinin__InfluenzaA__AFN19453
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauuccucauuuuucagucgacugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccaaagcucuggccguaucacaguguccacuaagagaucacagcaggcuguaauaccaaacauugggagcaggccccggauccgcaauauuccuaguagaaucucuaucuacuggaccauuguuaaaccaggagauauacugcuaaucaacuccacagguaaucucauugccccgaggggcuacuucaagauccggagcgggaaaucgucuauaaugcgcuccgacgcgcccauuggaaaguguaacucagaaugcaucaccccuaauggcaguaucccaaacgacaagcccuuucagaaugugaaccgaauuacguauggugcauguccuagauacgucaaacaaagcacucugaaacuugccacagggaugaggaaugugccagagaagcagacccggggaaucuucggcgcuauugccggcuuuauagaaaacgggugggagggaaugguggaugguugguauggcuuccgucaccaaaauuccgaggggcgcggacaggcagcugaccugaagucuacucaggccgcgaucgaucagauuaacggcaaauugaauagacucaucgguaagacaaacgaaaaauuccaccagaucgagaaggaauuuagcgaggucgaagggaggauucaagaccuggagaaguacguugaggauaccaaaauagacuuauggucauauaacgccgaacugcucguggcacuugagaaucagcauacgaucgaucugaccgacagugaaaugaacaaguuguucgagaaaacaaagaaacagcuacgggaaaaugcugaggauaugggcaacggaugcuuuaagauuuaccacaagugugacaaugccugcaucggcuccauucgaaacgggacuuaugaucaugacguauaccgcgacgaggcucugaauaacagauuccaggugaaaggagucgaacucaagagcgguuacaaagauuggauccuguggauaucuuuugccaucucaugcuuccuucuguguguggcauugcucggcuuuauuaugugggccugccaaaaggggaauaucagguguaacauuugcaucuga

SEQ ID NO: 131478 - RNA, 1701 nt, Artificial Sequence; identical to SEQ ID NO: 131469
  derived and/or modified sequence opt3 from hemagglutinin__InfluenzaA__AFN19455

SEQ ID NO: 131479 - RNA, 1701 nt, Artificial Sequence; identical to SEQ ID NO: 131090
  derived and/or modified sequence opt3 from hemagglutinin__InfluenzaA__AFN19457

SEQ ID NO: 131480 - RNA, 1701 nt, Artificial Sequence; identical to SEQ ID NO: 131090
  derived and/or modified sequence opt3 from hemagglutinin__InfluenzaA__AFN19459

SEQ ID NO: 131481 - RNA, 1701 nt, Artificial Sequence; identical to SEQ ID NO: 131447
  derived and/or modified sequence opt3 from hemagglutinin__InfluenzaA__AFN19461

SEQ ID NO: 131482 - RNA, 1701 nt, Artificial Sequence
  derived and/or modified sequence opt3 from hemagglutinin__InfluenzaA__AFN19465
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucugacagacuccgaaaugaauaaguuguucgagaaaacuaagaaacagcuacgggaaaacgcugaggauaucggcaauggaugcuuuaagauuuaccacaagugugacaacgccugcaucggcagcauucgaaaugggaccuauaaccaugauguauaccgcgacgaggcucugaauaacagauuccagaucaaaggaguggaacucaagucugguuacaaagacuggauacuguggaucucauuugccauuaguugcuuccuucuguguaucgcauugcucggcuuuauuaugugggccugccaaaaggggaauaucagguguaacauaugcauuuga

SEQ ID NO: 131483 - RNA, 1701 nt, Artificial Sequence; identical to SEQ ID NO: 131469
  derived and/or modified sequence opt3 from hemagglutinin__InfluenzaA__AFN19467

SEQ ID NO: 131484 - RNA, 1701 nt, Artificial Sequence; identical to SEQ ID NO: 131477
  derived and/or modified sequence opt3 from hemagglutinin__InfluenzaA__AFN19469

SEQ ID NO: 131485 - RNA, 1701 nt, Artificial Sequence; identical to SEQ ID NO: 131090
  derived and/or modified sequence opt3 from hemagglutinin__InfluenzaA__AFN19471

SEQ ID NO: 131486 - RNA, 1701 nt, Artificial Sequence
  derived and/or modified sequence opt3 from hemagglutinin__InfluenzaA__AFN19473
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcggcagcccacaccagauccuagacggggaaaauuguacccucauagaugcucugcuuggagacccgcagugcgauggcuuucaaaacaaaaagugggaccuguucguggagagauccaaagccuauucuaauuguuaccccuaugaugucccugacuacgcaucguugaggucacucguggccagcagugguacucuggaauuuaacaaugaguccuucaacuggacagggguuacccagaauggaacgucuagcgcuugcauccggcgcuccaacucaaguuucuuuagccgacugaauuggcucacucauuuaaacuuuaaguauccagcacugaaugugaccaugcccaacaacgagcaguucgauaagcuguacauuuggggcguccaccauccuggcacagacaaagaucagaucuuuuuguaugcccaaucuuccgggcguauuacugugucaaccaagagaagccagcaggcuguaaucccaaauauaggaaguaggccccggauucgcaacaucccuucuagaauuuccaucuacuggacaaucguuaaaccaggugacauucugcuaauaaauagcaccggcaaccucaucgccccgaggggguacuucaagauucggucgggaaaaucuuccaucaugcgcucagaugcgcccauaggcaaguguaauagugaaugcauuacgccuaacgguagcaucccaaaugacaagcccuuucagaacgugaaucgaaucacuuauggggcauguccuagauacgucaaacaauccacacugaaacuugccaccggaaugaggaacgugccagagaagcagacucggggcauuuucggcgcuaucgccggguuuauugaaaauggaugggaggguaugguggacggcugguauggguuccgucaccagaacucugagggacgcggccaagcagcugaucuuaagagcacacaggccgcgauagaccagaucaaugguaaauugaacagacucauugggaagaccaaugaaaaauuccaccagaucgagaaggaauuuucagaggucgaaggcaggauccaagaucuggagaaguacguugaggacacgaaaauugauuuauggaguuauaacgccgaacugcucguggcacuugagaaccagcauaccauagaccugacagauuccgaaaugaauaaguuguucgagaaaacuaagaaacagcuacgggaaaacgcugaggacaugggaaauggcugcuuuaagaucuaccacaagugugauaacgccugcauugggagcauccgaaauggaaccuauaaccaugacguauaccgcgaugaggcucugaauaacagauuccagauuaaagguguggaacucaagucuggcuacaaagacuggauccuguggauaucauuugccaucaguugcuuccuucugugugucgcauugcucggguuuauuaugugggccugccaaaagggaaauaucagguguaacauuugcaucuga

SEQ ID NO: 131487 - RNA, 1701 nt, Artificial Sequence; identical to SEQ ID NO: 131469
  derived and/or modified sequence opt3 from hemagglutinin__InfluenzaA__AFN19475

SEQ ID NO: 131488 - RNA, 1701 nt, Artificial Sequence; identical to SEQ ID NO: 131090
  derived and/or modified sequence opt3 from hemagglutinin__InfluenzaA__AFN19477

SEQ ID NO: 131489 - RNA, 1701 nt, Artificial Sequence
  derived and/or modified sequence opt3 from hemagglutinin__InfluenzaA__AFN19479
augaagaccaucauugcccugagcugcauacucugucuuguguucgcucagaaacugcccggcaacgacaauuccacagcaacuuugugcuuagggcaccaugccgucccuaacggaacgaucguuaagaccauuacaaaugaucaaaucgaggugacuaacgcgaccgaacugguacaaaauucuucaauuggugagaucugugacaguccacaccagauacuagauggcgaaaacugcacacucaucgacgcucugcuuggggauccgcagugugacggauuucagaauaaaaagugggaucuguucguggagagaagcaaagccuacuccaacugcuaucccuacgacgucccugauuaugcaucuuugaggucgcucguggccucaagcggcacccuggaauuuaauaacgagaguuucaauuggacugguguuacacagaacgggaccuccucugcuuguauucggcgcagcaauuccucauuuuucagucgacugaacuggcucacgcauuuaaauuuuaaguacccagcacugaacgugacuaugcccaacaaugagcaguucgacaaguuguauaucuggggaguccaccauccuggcaccgauaaagaccagauuuuucuuuacgcccaaagcucuggccguaucacaguguccacuaagagaucacagcaggcuguaauaccaaacauugggagcaggccccggauccgcaauauuccuaguagaaucucuaucuauuggaccauuguuaaaccaggagauauacugcuaaucaacuccacagguaaucucauugccccgaggggcuacuucaagauccggagcgggaaaucgucuauaaugcgcuccgacgcgcccauuggaaagugcaacucagaauguaucaccccuaauggcaguaucccaaacgacaagcccuuucagaaugugaaccgaauuacguacggugcaugcccuagauaugucaaacaaagcacucugaaacuugccacagggaugaggaaugugccagagaagcagacccggggaaucuucggcgcuauugccggcuuuauagaaaacgggugggagggaaugguggaugguugguacggcuuccgucaccaaaauuccgaggggcgcggacaggcagcugaccugaagucuacucaggccgcgaucgaucagauuaacggcaaauugaauagacucaucgguaagacaaacgaaaaauuccaccagaucgagaaggaauuuagcgaggucgaagggaggauucaagaccuggagaaguauguugaggauaccaaaauagacuuauggucauacaacgccgaacugcucguggcacuugagaaucagcauacgaucgaucugaccgacagugaaaugaacaaguuguucgagaaaacaaagaaacagcuacgggaaaaugcugaggauaugggcaacggauguuuuaagauuuaucacaagugcgacaaugccugcaucggcuccauucgaaacgggacuuacgaucaugacguauaucgcgacgaggcucugaauaacagauuccagaucaaaggaguggaacucaagagcgguuacaaagauuggauacuguggaucucuuuugccauuucauguuuccuucugugcgucgcauugcucggcuuuaucaugugggccugucaaaaggggaauauuaggugcaacaucuguauauga

SEQ ID NO: 131490 - RNA, 1701 nt, Artificial Sequence; identical to SEQ ID NO: 131469
  derived and/or modified sequence opt3 from hemagglutinin__InfluenzaA__AFN19483

SEQ ID NO: 131491 - RNA, 1701 nt, Artificial Sequence; identical to SEQ ID NO: 128871
  derived and/or modified sequence opt3 from hemagglutinin__InfluenzaA__AFN19485

SEQ ID NO: 131492 - RNA, 1701 nt, Artificial Sequence; identical to SEQ ID NO: 131090
  derived and/or modified sequence opt3 from hemagglutinin__InfluenzaA__AFN19487

SEQ ID NO: 131493 - RNA, 1701 nt, Artificial Sequence
  derived and/or modified sequence opt3 from hemagglutinin__InfluenzaA__AFN19491
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucugacagacuccgaaaugaauaaguuguucgagaaaacuaagaaacagcuacgggaaaacgcugaggauaugggcaauggaugcuuuaagaucuaccacaagugugacaacgccugcauuggcagcauccgaaaugggaccuauaaccaugauguauaccgcgacgaggcucugaauaacagauuccagauuaaaggaguggaacucaagucugguuacaaagacuggauccuguggauaucauuugccaucaguugcuuccuucugugugucguguugcucggcuuuauuaugugggcaugccaaaaggggaauaucagguguaacauuugcaucuga

SEQ ID NO: 131494 - RNA, 1701 nt, Artificial Sequence
  derived and/or modified sequence opt3 from hemagglutinin__InfluenzaA__AFN19493
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcagacaguaaucccaaauauagggucaaggccccggguucgcaacauuccuagcagagugaguaucuauuggaccauugucaaaccaggagacauccugcuaaucaauucuacggguaaccucauugccccgaggggcuacuucaagauacgguccgggaaaagcucgaucaugcgcucugaugcgcccauuggaaaguguaauuccgcaugcaucacuccuaacggcucaauaccaaaugacaagcccuuucagaacgugaaucgaauuacauacggugccuguccuagauaugugaaacaaaacacccugaaacuugcuacugggaugaggaaugucccagaaaaacagacacggggaaucuucggcgccaucgcaggcuuuauugagaacgggugggaaggaaugguugacgguugguacggcuuccgucaccagaauagugaggggcgcggacaagcugccgaucuuaagagcacccaggcggccaucgaccagauuaacggcaaauugaacagacucauagguaagacgaaugagaaauuccaucagaucgaaaaggaguuuuccgaaguggaggggaggauucaagaucuggaaaaguauguagaggacaccaaaaucgauuuauggucuuacaacgcagagcugcucguggcucuugaaaaucagcacacaaucgaccugacugauagcgagaugaacaaguuguucgaaaagaccaagaaacagcuacgggagaaugccgaagacaugggcaacggaugcuuuaagauuuaucauaagugugauaaugcuugcauaggcucaauccgaaacgggacauacgaccacgaugucuaucgcgacgaggcccugaauaacagauuccagauuaaaggaguggagcucaagagugguuacaaagacuggauccuguggauuuccuuugcaaucagcugcuuccuucuguguguugccuugcucggcuuuauaaugugggcuugccaaaaggggaauaucagguguaacauuugcaucuga

SEQ ID NO: 131495 - RNA, 1701 nt, Artificial Sequence
  derived and/or modified sequence opt3 from hemagglutinin__InfluenzaA__AFN19495
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaagugcuggugagaucugcgacagcccacaccauauacuggauggcgaaaauuguacacuaaucgacgcccuccugggggauccgcagugcgacggauuucagaacaaaaagugggaucuuuucguggagagauccagggcauauucuaauuguuaccccuaugacgucccugauuacgccucgcugcggucauugguggcuagcaguggcacccucgaauuuaacaaugaguccuucaacuggacugguguuacacaaaaugggaccucuagcgcaugcauucgccgauccaacaauucauuuuucagucgucugaacuggcugacgcaccucaauuuuaaauauccagccuuaaacgugacuaugcccaacaaugagcaguucgacaagcuguacaucuggggaguccaucacccuggcaccgauaaggaccagauuuuucuuuaugcucaggccagcggcagaaucacagugucuacuaaaaggucccaacaggcgguaauaccaaacauugggucacggccccgcguuagaaauaucccuagcaggauuaguaucuacuggaccaucgugaagccaggagauauuuugcugauaaacucuacagguaaucuaaucgcaccgcggggcuacuucaaaauucgcuccgggaaaagcucgaucaugcgaucugacgcccccauaggaaaauguaacuccgaaugcauuaccccuaauggcucaaucccaaacgacaagcccuuucagaaugucaacagaaucacguauggugcuuguccuagguacgugaagcagaguacucucaaacuggccacagggaugcggaaugugccagagaagcaaacccguggaauuuucggcgcaaucgcuggcuuuauugaaaacgggugggagggaaugauggaugguugguauggcuuccgccaccagaauagcgaggggagaggacaggccgcggaccuuaaauccacucaagccgcaauagaucagaucaacggcaagcugaauagguugauugguaaaacaaacgaaaaguuccaucagaucgagaaagaauuuucugaggucgaagggcggauccaggaccucgagaaguacguugaggauaccaagauugaccuguggagcuauaacgcugaauuacugguggcccucgagaaucaacacacgauagaucuuaccgacucagaaaugaacaaacuguucgagaagacaaagaagcaguugcgagaaaaugcugaggauaugggcaacggaugcuuuaaaaucuaccauaagugugacaaugccugcauuggcaguauccgcaacgggacuuaugaucacgacguauacagagacgaggcacuaaauaacagguuccagauuaagggaguggaacugaaauccgguuacaaggauuggauccucuggaucagcuuugccaccucuugcuuccugcuuugugucgcucuguugggcuuuauaaugugggcgugccagaaagggaauauucgguguaacaucugcauuuga

SEQ ID NO: 131496 - RNA, 1701 nt, Artificial Sequence
  derived and/or modified sequence opt3 from hemagglutinin__InfluenzaA__AFN19497
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcaauagcccacaccagauccuagacggugagaacuguacccucauagaugcucugcuuggcgacccgcagugcgauggguuucaaaauaaaaagugggaccuguucguggaaagauccaaagcccauucuaacuguuaucccuacgaugucccugacuaugcaucguugaggucacucguggccagcaguggaacucuggaguuuaauaacgaguccuucaauuggacaggcguuacccagaacgguacgucuagcgcuugcauccggcgcuccaauaacucauuuuucagucgacugaauuggcucacucacuuaaacuuuaaguacccagcacugaacgugaccaugcccaauaacgaacaguucgauaagcuguauauuuggggaguccaucacccugggacagacaaagaucagaucuuuuuguacgcccaagcuagcggccguauuacugugucuaccaagagaucccagcaggccguaaucccaaauauaggcucaaggccccggguucgcaacauuccuagcagagugaguaucuauuggacaauugucaaaccaggggacauccugcuaaucaauucuaccggaaaccucauugcgccgagggguuacuucaagauacgguccggcaaaagcucgaucaugcgcucugaugcacccauugggaaguguaauuccacgugcaucacuccuaacggaucaauaccaaaugacaagcccuuucagaacgugaaucgaauuacauacggcgccuguccuagauaugugaaacaaaacacccugaaacuugcuacugguaugaggaaugucccagagaagcagacacgggggaucuucggagccaucgcaggcuuuauugaaaacggcugggaggggaugguugacggaugguacgguuuccgucaccagaauagugagggccgcgggcaagcugccgaucuuaagagcacccaggcggccaucgaccagauuaacggaaaauugaacagacucauaggcaagacgaaugaaaaauuccaucagaucgagaaggaauuuuccgagguggaagguaggauucaagaucuggagaaguauguagaggacaccaaaaucgauuuauggucuuacaacgcagaacugcucguggcucuugagaaucagcacacaaucgaccugacugauagcgaaaugaacaaguuguucgagaaaaccaagaaacagcuacgggaaaaugccgaggacauggggaacggcugcuuuaagauuuaucauaagugugauaaugcuugcauaggaucaauccgaaacggcacauacgaccacgaugucuaucgcgacgaggcccugaauaacagauuccagauuaaagggguggaacucaagaguggauacaaagacuggauccuguggauuuccuuugcaaucagcugcuuccuucuguguguugccuugcucgguuuuauaaugugggcuugccaaaagggcaauaucagguguaacauuugcaucuga

SEQ ID NO: 131497 - RNA, 1701 nt, Artificial Sequence; identical to SEQ ID NO: 131447
  derived and/or modified sequence opt3 from hemagglutinin__InfluenzaA__AFN19499

SEQ ID NO: 131498 - RNA, 1701 nt, Artificial Sequence; identical to SEQ ID NO: 131446
  derived and/or modified sequence opt3 from hemagglutinin__InfluenzaA__AFN19501

SEQ ID NO: 131499 - RNA, 1701 nt, Artificial Sequence; identical to SEQ ID NO: 128998
  derived and/or modified sequence opt3 from hemagglutinin__InfluenzaA__AFN19503

SEQ ID NO: 131500 - RNA, 1701 nt, Artificial Sequence; identical to SEQ ID NO: 131447
  derived and/or modified sequence opt3 from hemagglutinin__InfluenzaA__AFN19507

SEQ ID NO: 131501 - RNA, 1701 nt, Artificial Sequence; identical to SEQ ID NO: 131446
  derived and/or modified sequence opt3 from hemagglutinin__InfluenzaA__AFN19509

SEQ ID NO: 131502 - RNA, 1701 nt, Artificial Sequence; identical to SEQ ID NO: 131447
  derived and/or modified sequence opt3 from hemagglutinin__InfluenzaA__AFN19513

SEQ ID NO: 131503 - RNA, 1701 nt, Artificial Sequence; identical to SEQ ID NO: 131446
  derived and/or modified sequence opt3 from hemagglutinin__InfluenzaA__AFN19515

SEQ ID NO: 131504 - RNA, 1701 nt, Artificial Sequence; identical to SEQ ID NO: 131447
  derived and/or modified sequence opt3 from hemagglutinin__InfluenzaA__AFN19517

SEQ ID NO: 131505 - RNA, 1701 nt, Artificial Sequence; identical to SEQ ID NO: 131447
  derived and/or modified sequence opt3 from hemagglutinin__InfluenzaA__AFN19519

SEQ ID NO: 131506 - RNA, 1701 nt, Artificial Sequence; identical to SEQ ID NO: 131090
  derived and/or modified sequence opt3 from hemagglutinin__InfluenzaA__AFN19521

SEQ ID NO: 131507 - RNA, 1701 nt, Artificial Sequence; identical to SEQ ID NO: 131446
  derived and/or modified sequence opt3 from hemagglutinin__InfluenzaA__AFN19523

SEQ ID NO: 131508 - RNA, 1701 nt, Artificial Sequence
  derived and/or modified sequence opt3 from hemagglutinin__InfluenzaA__AFN19527
augaagaccaucauugcccugagcuacacacucugccuuguguucgcucagaaacugcccggcaacgacaauuccacugcaacguuguguuuagggcaccaugccgucccuaacggaaccauaguuaagacaaucacuaaugaucaaauugaggugaccaacgcgacagaacugguacaaaauucuucaaucggugagauuugcgacaguccacaccagauccuagauggcgaaaacuguacccucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauuccucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaaagcucuggccguauuacuguguccaccaagagaucacagcaggcuguaaucccaaacauagggagcaggccccggauucgcaauaucccuaguagaauuucuaucuacuggacaaucguuaaaccaggagauauucugcuaauaaacuccaccgguaaucucaucgccccgaggggcuacuucaagauucggagcgggaaaucgucuaucaugcgcuccgacgcgcccauaggaaaguguaacucagaaugcauuacgccuaauggcaguaucccaaacgacaagcccuuucagaaugugaaccgaaucacuuauggugcauguccuagauacgucaaacaaagcacacugaaacuugccaccgggaugaggaaugugccagagaagcagacucggggaauuuucggcgcuaucgccggcuuuauugaaaacgggugggagggaaugguggaugguugguauggcuuccgucaccaaaauuccgaggggcgcggacaggcagcugaccugaagucuacacaggccgcgauagaucagaucaacggcaaauugaauagacucauugguaagaccaacgaaaaauuccaccagaucgagaaggaauuuagcgaggucgaagggaggauccaagaccuggagaaguacguugaggauacgaaaauugacuuauggucauauaacgccgaacugcucguggcacuugagaaucagcauaccauagaucugacagacagugaaaugaacaaguuguucgagaaaacuaagaaacagcuacgggaaaaugcugaggauaugggcaacggaugcuuuaagaucuaccacaagugugacaaugccugcauuggcuccauccgaaacgggaccuaugaucaugacguauaccgcgacgaggcucugaauaacagauuccagauuaaaggaguggaacucaagagcgguuacaaagauuggauccuguggauaucuuuugccaucucaugcuuccuucugugugucgcauugcucggcuuuauuaugugggccugccaaaaggggaauaucagguguaacauuugcaucuga

SEQ ID NO: 131509 - RNA, 1701 nt, Artificial Sequence
  derived and/or modified sequence opt3 from hemagglutinin__InfluenzaA__AFN19529
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauuccucauuuuucagucgacugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccaaagcucuggccguaucacaguguccacuaagagaucacagcaggcuguaauaccaaacauugggagcaggccccggauccgcaauauuccuaguagaaucucuaucuacuggaccauuguuaaaccaggagauauacugcuaaucaacuccacagguaaucucauugccccgaggggcuacuucaagauccggagcgggaaaucgucuauaaugcgcuccgacgcgcccauuggaaaguguaacucagaaugcaucaccccuaauggcaguaucccaaacgacaagcccuuucagaaugugaaccgaauuacguauggugcauguccuagauacgucaaacaaagcacucugaaacuugccacagggaugaggaaugugccagagaagcagacccggggaaucuucggcgcuauugccggcuuuauagaaaacgggugggagggaaugguggaugguugguauggcuuccgucaccaaaauuccgaggggcgcggacaggcagcugaccugaagucuacucaggccgcgaucgaucagauuaacggcaaauugaauagacucaucgguaagacaaacgaaaaauuccaccagaucgagaaggaauuuagcgaggucgaagggaggauucaagaccuggagaaguacguugaggauaccaaaauagacuuauggucauauaacgccgaacugcucguggcacuugagaaucagcauacgaucgaucugaccgacagugaaaugaacaaguuguucgagaaaacaaagaaacagcuacgggaaaaugcugaggauaugggcaacggaugcuuuaagauuuaccacaagugugacaaugccugcaucggcuccauucgaaacgggacuuaugaucaugacguauaccgcgacgaggcucugaauaacagauuccagaucaaaggaguggaacucaagagcgguuacaaagauuggauacuguggaucucuuuugccauuucaugcuuccuucugugugucgcauugcucggcuuuaucaugugggccugccaaaaggggaauauuagguguaacaucugcauauga

SEQ ID NO: 131510 - RNA, 1701 nt, Artificial Sequence; identical to SEQ ID NO: 131090
  derived and/or modified sequence opt3 from hemagglutinin__InfluenzaA__AFN19531

SEQ ID NO: 131511 - RNA, 1701 nt, Artificial Sequence; identical to SEQ ID NO: 131509
  derived and/or modified sequence opt3 from hemagglutinin__InfluenzaA__AFN19533

SEQ ID NO: 131512 - RNA, 1701 nt, Artificial Sequence
  derived and/or modified sequence opt3 from hemagglutinin__InfluenzaA__AFN19535
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcauucggcgcuccaacucaaguuucuuuagccgacugaauuggcugacucaucucaacuuuaaguauccagcauuaaaugugaccaugcccaacaacgagcaguucgacaagcuguacaucuggggaguccaccauccuggcacagauaaagaccagauuuuucuuuaugcccaaucuuccggccguaucacugugucaaccaagagaagccagcaggcuguaauaccaaauauugggaguaggccccggauccgcaacauuccuucuagaaucuccaucuacuggacaauuguuaaaccaggagauauauugcugaucaauagcaccgguaaccuaauugccccgaggggcuacuucaagauccggucggggaaaucuuccauaaugcgcucagacgcgcccauuggaaaguguaauagugaaugcaucacgccuaacggcagcaucccaaaugacaagcccuuucagaacgugaaucgaauuacuuauggugcauguccuagauacgucaaacaauccacacucaagcuggccaccgggaugaggaacgugccagagaaacagacucggggaaucuucggcgcuauugccggcuuuauagaaaaugggugggagggaaugguggaugguugguauggcuuccgucaccagaacucugaggggcgcggacaagcagcugaccuuaagagcacacaggccgcgaucgaucagauuaauggcaaacugaacagauugaucgguaagaccaaugaaaaauuccaccagaucgagaaggaauuuucagaggucgaagggaggauucaagaccucgagaaguacguugaggauacgaaaauagaccuguggaguuauaacgccgaauuacugguggcacucgagaaccagcauaccaucgaucuuacagacuccgaaaugaauaagcuguucgagaaaacuaagaaacaguugcgggaaaacgcugaggauaugggcaauggaugcuuuaagauuuaccacaagugugacaacgccugcaucggcagcauucgaaaugggaccuauaaccaugauguauaccgcgacgaggcucuaaauaacagauuccagaucaaaggaguggaacugaagucugguuacaaagacuggauacucuggaucucauuugccauuaguugcuuccugcuuugugucgcacuguugggcuuuaucaugugggccugccaaaaggggaauauuagguguaacaucugcauauga

SEQ ID NO: 131513 - RNA, 1701 nt, Artificial Sequence; identical to SEQ ID NO: 131090
  derived and/or modified sequence opt3 from hemagglutinin__InfluenzaA__AFN19537

SEQ ID NO: 131514 - RNA, 1701 nt, Artificial Sequence; identical to SEQ ID NO: 131090
  derived and/or modified sequence opt3 from hemagglutinin__InfluenzaA__AFN19539

SEQ ID NO: 131515 - RNA, 1701 nt, Artificial Sequence; identical to SEQ ID NO: 131090
  derived and/or modified sequence opt3 from hemagglutinin__InfluenzaA__AFN19543

SEQ ID NO: 131516 - RNA, 1701 nt, Artificial Sequence
  derived and/or modified sequence opt3 from hemagglutinin__InfluenzaA__AFN19545
augaagaccaucauugcccugagcuacauacucugccuuguguucgcucagaaacugcccggcuccgacaacucuacagcaacuuuguguuuagggcaccaugccgucccuaauggaacgaucguuaagaccauuacaaacgauagaaucgaggugacuaaugcgaccgaacugguacaaaacucaaguauuggugagaucugcgacagcccacaccagauacuagauggcgaaaauuguacacucaucgacgcucugcuuggggauccgcagugcgacggauuuaaaaacaagaaaugggaucuguucguggagagguccaaggccuauucuaauuguuaccccuaugacgucccugauuacgcaucguugcggucacucguggccagcaguggcacccuggaauuuaacaaugaguccuucaacuggacugguguuacacagaaugggaccucuagcgcuugcauucgccgauccaacaauucauuuuucagucgucugaacuggcucacgcauuuaaauuuuaaguauccagcacugaacgugacuaugcccaacaaugagcaauucgacaaacuuuacaucuggggaguccaccauccuggcaccgauaaggaccagauuuuucuuuaugcccagagcucuggcagaaucacaguguccacuaaaaggucacagcaagcuguaauaccaaacauugggagccggccccgcaucagaaauauuccuaguaggaucucuaucuacuggaccauuguuaagccaggagauauacugcuaaucaacuccacagguaaucucauugccccgcggggcuacuucaaaauccagagcgggaagucgucuauaaugcgcuccgacgcgcccauuggaaaguguaaaucagaaugcaucaccccuaacggcaguaucccaaaugacaagcccuuucagaacgugaaucgaauuacguauggugcauguccuagauacgucaaacagagcacucugaaguuggccacagggaugaggaacgugccagagaaacaaacccggggaaucuucggcgcuauugccggcuuuauagaaaaugggugggagggaaugguggaugguugguauggcuuccgucaccagaacuccgaggggcgcggacaggcagcugaccugaagucuacucaagccgcgaucgaucagauuaauggcaaauugaacagacucaucgguaagacaaaugaaaaguuccaccagaucgagaaagaauuuagcgaggucgaagggaggauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaagcagcuacgggaaaacgcugaggauaugggcaauggaugcuuuaaaauuuaccacaagugugacaacgccugcaucggcuccauucgaaaugggacuuaugaucaugacguauaccgcgacgaggcucugaacaauagauuccagaucaaaggaguggaacucaagagcgguuacaaagauuggauacuguggaucucuuuugccauuucaugcuuccuucugugugucgcauugcucggcuuuaucaugugggccugccagaaggggaacauuagguguaauaucugcauauga

SEQ ID NO: 131517 - RNA, 1701 nt, Artificial Sequence; identical to SEQ ID NO: 131090
  derived and/or modified sequence opt3 from hemagglutinin__InfluenzaA__AFN19547

SEQ ID NO: 131518 - RNA, 1701 nt, Artificial Sequence
  derived and/or modified sequence opt3 from hemagglutinin__InfluenzaA__AFN19549
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguaaaggugagauuugcaauagcccacaccagauccuagacggcgggaacuguacacucauagaugcucugcuuggagacccgcagugcgauggcuuucaaaauaagaaaugggaccuguucguggaaagauccaaggcccauucuaacuguuaucccuacgaugucccugacuaugcaucguugaggucacucguggccagcagugguacccuggaguuuaauaacgaauccuucaauuggacugggguuacacagaacggaaccucuagcgcuugcaugcggcgcuccaauaacucauuuuucagucgacugaauuggcucacgcacuuaaacuuuaaguacccagcacugaacgugacuaugcccaauaacgagcaguucgauaaacuuuauaucuggggcguccaucacccuggcaccgacaaggaucagaucuuuuuguacgcccaagcuagcgggcguauuacagugucuacuaaaagaucccagcaggccguaauuccaaauaucggaucaaggccccggguucgcaacauaccuagcagagugaguauuuauuggaccaucgucaagccaggugacauucugcuaaucaauucuacaggcaaccucaucgcgccgaggggguacuucaaaauucgguccggaaagagcucgauaaugcgcucugaugcacccaucggcaaguguaauuccgccugcauuaccccuaacgguucaaucccaaaugacaaacccuuucagaacgugaaucgaauaacguacggggcuuguccuagauaugugaagcaaaacacucugaaacuugccacaggaaugaggaaugucccagagaagcagacccggggcauuuucggcgcaaucgcuggguuuaucgaaaacggaugggaggguaugguugacggcugguacggguuccgucaccagaauagugaaggacgcggccaagccgcggaucugaaaagcacucaggccgcaauugaccagaucaacgguaaguugaacagacucauugggaaaacaaaugagaaguuccaucagauagagaaggaauuuuccgagguggaaggcaggauccaagauauugagaaauauguagaagacaccaagaucgaucuguggucuuacaacgcugaguuacugguggcccucgagaaucagcacacgaucgaccuuaccgauagcgaaaugaacaaacuguucgagaagacuaaaaagcaguugcgggaaaaugcugaggacaugggaaacggcugcuuuaagauuuaucauaaaugugauaaugccugcauagggucaauccgaaacggaacauacgaccacgaugucuaucgcgacgaagcacuaaauaacagauuccagauuaaggguguggagcugaaaaguggcuacaaggacuggauccucuggauuuccuuugccaucagcugcuuccugcuuuguguugcucuguugggguuuauaaugugggcgugccaaaaaggaaauaucagguguaacauuugcaucuga

SEQ ID NO: 131519 - RNA, 1701 nt, Artificial Sequence
  derived and/or modified sequence opt3 from hemagglutinin__InfluenzaA__AFN19551
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcauugcgacggauuucagaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccaaaaugggacgucuagcgcuugcauucggcgcuccaacucaaguuucuuuagccgacugaauuggcugacucaccucaacuuuaaguauccagcauuaaaugugaccaugcccaacaacgagcaguucgacaagcuguacaucuggggaguccaucacccuggcacagauaaagaccagauuuuucuuuaugcccagucuuccggccguaucacugugucaaccaagagaagccaacaggcuguaauaccaaauauugggaguaggccccggauccgcaacauuccuucuagaaucuccaucuacuggacaauuguuaaaccaggagauauauugcugaucaauagcaccgguaaccuaauugccccgaggggcuacuucaagauccggucggggaaaucuuccauaaugcgcucagacgcgcccauuggaaaguguaauagugaaugcaucacgccuaacggcagcaucccaaaugacaagcccuuucagaacgugaaucgaauuacuuauggugcauguccuagauacgucaaacaguccacacucaagcuggccaccgggaugaggaacgugccagagaaacaaacucggggaaucuucggcgcuauugccggcuuuauagaaaaugggugggagggaaugguggaugguugguauggcuuccgucaccagaacucugaggggcgcggacaggcagcugaccuuaagagcacacaagccgcgaucgaucagauuaauggcaaacugaacagauugaucgguaagaccaaugaaaaauuccaucagaucgagaaggaauuuucagaggucgaagggaggauucaggaccucgagaaguacguugaggauacgaaaauagaccuguggaguuauaacgccgaauuacugguggcacucgagaaccaacacaccaucgaucuuacagacuccgaaaugaauaagcuguucgagaaaacuaagaaacaguugcgggaaaacgcugaggauaugggcaauggaugcuuuaagauuuaccauaagugugacaacgccugcaucggcagcauucgaaaugggaccuauaaccacgauguauaccgcgacgaggcucuaaauaacagauuccagaucaaaggaguggaacugaagucugguuacaaagacuggauacucuggaucucauuugccauuaguugcuuccugcuuugugucgcacuguugggcuuuaucaugugggccugccagaaggggaauauuagguguaacaucugcauauga

SEQ ID NO: 131520 - RNA, 1701 nt, Artificial Sequence; identical to SEQ ID NO: 131469
  derived and/or modified sequence opt3 from hemagglutinin__InfluenzaA__AFN19553

SEQ ID NO: 131521 - RNA, 1701 nt, Artificial Sequence; identical to SEQ ID NO: 131469
  derived and/or modified sequence opt3 from hemagglutinin__InfluenzaA__AFN19555

SEQ ID NO: 131522 - RNA, 1701 nt, Artificial Sequence; identical to SEQ ID NO: 131090
  derived and/or modified sequence opt3 from hemagglutinin__InfluenzaA__AFN19557

SEQ ID NO: 131523 - RNA, 1701 nt, Artificial Sequence; identical to SEQ ID NO: 131469
  derived and/or modified sequence opt3 from hemagglutinin__InfluenzaA__AFN19559

SEQ ID NO: 131524 - RNA, 1701 nt, Artificial Sequence; identical to SEQ ID NO: 131477
  derived and/or modified sequence opt3 from hemagglutinin__InfluenzaA__AFN19561

SEQ ID NO: 131525 - RNA, 1701 nt, Artificial Sequence
  derived and/or modified sequence opt3 from hemagglutinin__InfluenzaA__AFN19563
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucggcaguauucgcaacgggacuuaugaucaugacguauacagagacgaggcucugaauaacagguuccagaucaagggaguggaacucaaauccgguuacaaggauuggauacuguggaucagcuuugccaccucuugcuuccuucugugugucgcauugcucggcuuuauuaugugggccugccagaaagggaauauccgguguaacauuugcaucuga

SEQ ID NO: 131526 - RNA, 1701 nt, Artificial Sequence; identical to SEQ ID NO: 131447
  derived and/or modified sequence opt3 from hemagglutinin__InfluenzaA__AFN19565

SEQ ID NO: 131527 - RNA, 1701 nt, Artificial Sequence
  derived and/or modified sequence opt3 from hemagglutinin__InfluenzaA__AFN19567
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcaauaacuccuuuuucucacgucugaauuggcugacgcaucucaacuuuaaguauccagcauuaaacgugacuaugcccaauaacgagcaguucgacaagcuguacauuuggggaguccaccauccuggcaccgauaaagaccagaucuuucuuuaugcccagaguagcggcagaauaacagugucuacuaagaggucccaacaggcuguaauuccaaauaucgggucacggccccgcauuagaaacaucccuagcaggaucaguauuuacuggaccauaguuaaaccaggagauaucuugcugauuaauucuacagguaaccuaaucgccccgcggggcuacuucaagauacgcuccgggaaaagcucgauuaugcgaucugacgcgcccaucggaaaguguaaguccgaaugcaucaccccuaauggcucaauuccaaacgacaaacccuuucagaaugugaacagaaucacguauggugcauguccuagguacgucaagcagaguacucucaaacuggccacagggaugcggaaugugccagagaagcaaacccguggaauuuucggcgcuauagccggcuuuaucgaaaacgggugggagggaaugguggaugguugguauggcuuccgccaccagaauagcgaggggagaggacaggcagcugaccuuaaauccacucaagccgcgauugaucagaucaacggcaagcugaauagguugaucgguaaaacaaacgaaaaguuccaccagauugagaaggaauuuucugaggucgaagggcggauacaggaccucgagaaauacguugaggauaccaagaucgaccuguggagcuauaacgccgaauuacugguggcacucgagaaucaacauacgauugaucuuaccgacucagaaaugaacaaacuguucgagaagacuaaaaagcaguugcgagaaaaugcugaggauaugggcaacggaugcuuuaagaucuaccacaaaugugacaaugccugcauuggcaguauccgcaacgggacauaugaucaugacguauacagagacgaggcucuaaauaacagguuccagauaaagggaguggaacugaaauccgguuacaaggauuggauccucuggauuagcuuugccaucucuugcuuccugcuuugugucgcacuguugggcuuuauuaugugggccugccagaaagggaauauccgguguaacauaugcauuuga

SEQ ID NO: 131528 - RNA, 1701 nt, Artificial Sequence; identical to SEQ ID NO: 131090
  derived and/or modified sequence opt3 from hemagglutinin__InfluenzaA__AFN19569

SEQ ID NO: 131529 - RNA, 1701 nt, Artificial Sequence
  derived and/or modified sequence opt3 from hemagglutinin__InfluenzaA__AFN19571
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuucagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguauucucaauccucaggccguauuacugugagcaccaagagaagucagcaggccguaaucccaaauauagggucuaggccccggauucgcaacaucccuuccagaauuagcaucuacuggacaaucguuaaaccaggagauauucugcuaauaaauucgaccgguaaccucaucgcuccgaggggcuacuuccggauucgcucugggaaguccucaaucaugcgaagugacgcccccauaggaaaauguaauagcgaaugcauuacgccuaacggcuccaucccaaaugacaagcccuuucagaacgugaauagaaucacuuaugguccuuguccaagguacgucaagcaaucuacacugaaacuugcgaccgggaugcggaacgugcccgagaagcagacucguggaauuuucggcgcaaucgccggcuuuauugaaaaugggugggagggaaugguggaugguugguauggcuaccgccaccagaacagcgaggggagaggacaagcugccgaccugaaaucaacacaggcagcuauagaucagaucaauggcaaguugaacaggcucauugguaaaaccaaugaaaaguuccaccagaucgagaaagaauuuagugaggucgaagggcggauccaagaccuggagaaguauguugaggauacgaagauugacuuauggaccuacaacgccgaacugcucguggcgcuugagaaccagcauacaauagaucugacugacuccgaaaugaauaaauuguuugagaagaccaaaaagcagcuacgagaaaacgccgaggauaugggcaauggaugcuucaaaaucuaucacaagugugacaacgcaugcauuggcagcauccgcaaugggacauacaaccaugauguauacagagacgaggcucugaauaacagguuucagauuaagggaguggaacucaaaucugguuauaaggacuggauccuguggauaucauucgccaucaguugcuuucuucugugugucgcuuugcucggcuucauuaugugggccugccaaaaagggaauauccgguguaacauuugcaucuga

SEQ ID NO: 131530 - RNA, 1701 nt, Artificial Sequence
  derived and/or modified sequence opt3 from hemagglutinin__InfluenzaA__AFN19573
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguaaaauuugcgacagcccacaccagauccuagauggcaagaauuguacccucauagacgcucugcuuggggauccgcagugcgacggauuucaaaacaaaaagugggaucuguucguggagagauccaaggccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaaaaacucauuuuucagucgacugaauuggcucacucauuuaaacuuuaaguauagcgcacugaaugugaccaugccaaacaaagaacaguucgacaaacuuuacauuuggggaguccaccaucccggcacagauaaggaccagaucucuuuguaugcccaggcuuccggccguauuacugugucaaccaagagaagccaacagacaguaaucccuaacauagggaguaggccacggguucgcaauauucccucuagaaucuccauuuacuggaccaucgugaagccuggagauauccugcuaauuaacagcacggguaaucucauagccccaaggggcuacuuuaaaaugcagucggggaagucuuccaucaugcggucagacgcgccgauuggaaaauguaacagugagugcaucacucccaauggcagcauaccuaacgacaagccauuccaaaaugucaaccgcauuacauauggugcauguccccgauacgugaaacagaauacccugaaacuugccacugggaugagaaacgugccugagaagcagacaaggggaaucuuuggcgcuaucgccggcuucauugaaaaugggugggagggaauggucgaugguugguauggcuuucggcaccaaaacuccgaagggcguggacaggcagcugaccugaagucuacccaggccgcgaucgaucagauuaauggcaaguugaaccgccucauagguaaaacgaaugagaaguuccaccaaaucgagaaagaguucagcgaaguugaagggaggauucaggaccuggagaaguacguggaagauaccaaaaucgacuuauggucauauaacgccgagcugcucguagcacuugagaaccagcauacaaucgaucugacugacagugaaaugaauaaguuguuugagaagaccaaaaagcagcuaagagaaaacgcugaggauaugggcaauggaugcuucaaaauuuaccacaagugugacaacgccugcauaggcuccauccggaaugggacauaugaucaugacguguaccgagacgaagcucugaacaaucgcuuucaaauuaaaggagucgagcucaagagcgguuacaaggauuggauccuguggauuucuuucgccaucucaugcuuucuucuguguguggcauugcucggcuucauaaugugggccugccagaaagggaacaucagauguaauauuugcaucuga

SEQ ID NO: 131531 - RNA, 1701 nt, Artificial Sequence
  derived and/or modified sequence opt3 from hemagglutinin__InfluenzaA__AFN19575
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacaauccacaccagauccuagauggcgaaaacuguacccucauagacgcucugcuuggggauccgcagugcgacggauuucaaaauaaaaagugggaucuguucguggagagaagcaaagccuauuccaacuguuaccccuaugacgucccugauuacgcaucuuugaggucgcucguggccucaagcggcacucuggaauuuaauaacgagaguuucaauuggacagguguuacccagaacgggacguccucugcuugcauccggcgcagcaauaacuccuuuuucucacgacugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccaaaguagcggccguauuacugugucuaccaagagaucccagcaggcuguaaucccaaauauagggucaaggccccggguucgcaacauuccuagcagaaucaguauuuacuggacaaucgugaaaccaggagauauccugcuaauuaauucuaccgguaaccucauagccccgaggggcuacuucaagauccgguccgggaaaagcucgauuaugcgcucugacgcgcccaucggaaaguguaauuccgaaugcauaacgccuaacggcucaauuccaaaugacaagcccuuucagaacgucaaucgaaucacuuauggugcauguccuagauacgugaaacaaaguacacugaaacuugccaccgggaugaggaacgugccagagaagcagacucggggaaucuucggcgcuauugccggcuuuaucgaaaaugggugggagggaauggucgaugguugguauggcuuccgucaccagaacagcgaggggcgcggacaagcagcugaccugaaguccacacaggccgcgauugaucagauaaauggcaaauugaacagacucaucgguaagaccaacgaaaaauuccaccagauugagaaggaauuuucugagguugaagggaggauccaagaccuggagaaguacguggaggauacgaaaaucgacuuauggagcuauaaugccgaacugcucguagcacuugagaaccagcauaccauugaucugacagacucagaaaugaauaaguuguucgagaaaacuaagaaacagcuacgggaaaacgcugaggauaugggcaauggaugcuuuaagauauaccacaagugugacaacgccugcaucggcaguauucgaaaugggaccuaugaucaugacguguaccgcgacgaggcucugaacaauagauuccagaucaaaggagucgaacucaaguccgguuacaaagauuggauucuguggaucagcuuugccauaucuugcuuccuucuguguguggcauugcucggcuuuaucaugugggccugccaaaaggggaacauuagguguaauaucugcauuuga

SEQ ID NO: 131532 - RNA, 1701 nt, Artificial Sequence; identical to SEQ ID NO: 131446
  derived and/or modified sequence opt3 from hemagglutinin__InfluenzaA__AFN19577

SEQ ID NO: 131533 - RNA, 1701 nt, Artificial Sequence; identical to SEQ ID NO: 131446
  derived and/or modified sequence opt3 from hemagglutinin__InfluenzaA__AFN19579

SEQ ID NO: 131534 - RNA, 1701 nt, Artificial Sequence; identical to SEQ ID NO: 131446
  derived and/or modified sequence opt3 from hemagglutinin__InfluenzaA__AFN19581

SEQ ID NO: 131535 - RNA, 1701 nt, Artificial Sequence; identical to SEQ ID NO: 131446
  derived and/or modified sequence opt3 from hemagglutinin__InfluenzaA__AFN19583

SEQ ID NO: 131536 - RNA, 1701 nt, Artificial Sequence
  derived and/or modified sequence opt3 from hemagglutinin__InfluenzaA__AFN19587
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugugaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaggucacucguugccagcaguggaacucuggaauuuaacaaugaguccuucaacuggacaggcgugacccagaaugguacgucuagcgcuugcauccggcgcuccaacucaaguuucuuuagccgacugaauuggcucacucauuuaaacuuuaaguauccagcacugaaugucaccaugcccaacaacgagcaguucgacaagcuguacauuuggggagugcaccauccugggacagauaaagaccagaucuuuuuguaugcccaaucuuccggccguauuacuguaucaaccaagagaagccagcaggcuguuaucccaaauauaggcaguaggccccggauucgcaacaucccuucuagaauuuccaucuacuggacaaucgugaaaccaggggauauucugcuaauaaauagcaccggaaaccucaucgccccgagggguuacuucaagauucggucgggcaaaucuuccaucaugcgcucagacgcgcccauagggaaguguaauagugaaugcauuacgccuaacggaagcaucccaaaugacaagcccuuucagaacgucaaucgaaucacuuauggcgcauguccuagauacgugaaacaauccacacugaaacuugccaccgguaugaggaacgugccagagaagcagacucgggggauuuucggagcuaucgccggcuuuauugaaaauggcugggaggggauggucgauggaugguaugguuuccgucaccagaacucugagggccgcgggcaagcagcugaccuuaagagcacacaggccgcgauagaucagaucaauggaaaauugaacagacucauuggcaagaccaaugaaaaauuccaccagaucgagaaggaauuuucagagguugaagguaggauccaagaccuggagaaguacguggaggauacgaaaauugacuuauggaguuauaacgccgaacugcucguagcacuugagaaccagcauaccauagaucugacagacuccgaaaugaauaaguuguucgagaaaacuaagaaacagcuacgggaaaacgcugaggauauggggaauggcugcuuuaagaucuaccacgagugugacaacgccugcauuggaagcauccgaaauggcaccuauaaccaugauguguaccgcgacgaagcucugaauaacagauuccagauuaagggggucgagcucaaaucuggauacaaggacuggauccuguggauaucauuugccaucaguugcuuccuucuguguguggcauugcucgguuuuauuaugugggccugccaaaaaggcaauaucagguguaacauuugcaucuga

SEQ ID NO: 131537 - RNA, 1701 nt, Artificial Sequence; identical to SEQ ID NO: 131446
  derived and/or modified sequence opt3 from hemagglutinin__InfluenzaA__AFN19589

SEQ ID NO: 131538 - RNA, 1701 nt, Artificial Sequence
  derived and/or modified sequence opt3 from hemagglutinin__InfluenzaA__AFN19591
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcaugcggcgcagcaauuccucauuuuucagucgacugaacuggcucacgcauuuaaauuuuaaguauccagcacugaacgugacuaugcccaacaaugagcaguucgacaaacuuuacauuuggggaguccaccauccuggcaccgauaaggaccagaucuuuuuguaugcccaaagcucuggccguauuacaguguccacuaagagaucacagcaggcuguaaucccaaacauagggagcaggccccggauucgcaauaucccuaguagaauuucuaucuacuggaccaucguuaaaccaggagauauucugcuaauaaacuccacagguaaucucaucgccccgaggggcuacuucaagauucggagcgggaaaucgucuaucaugcgcuccgacgcgcccauaggaaaguguaacucagaaugcauuaccccuaauggcaguaucccaaacgacaagcccuuucagaaugugaaccgaaucacguauggugcauguccuagauacgucaaacaaagcacucugaaacuugccacagggaugaggaaugugccagagaagcagacccggggaauuuucggcgcuaucgccggcuuuauugaaaacgggugggagggaaugguggaugguugguauggcuuccgucaccaaaauuccgaggggcgcggacaggcagcugaccugaagucuacucaggccgcgauagaucagaucaacggcaaauugaauagacucauugguaagacaaacgaaaaauuccaccagaucgagaaggaauuuagcgaggucgaagggaggauccaagaccuggagaaguacguugaggauaccaaaauugacuuauggucauauaacgccgaacugcucguggcacuugagaaucagcauacgauagaucugaccgacagugaaaugaacaaguuguucgagaaaacaaagaaacagcuacgggaaaaugcugaggauaugggcaacggaugcuuuaagaucuaccacaagugugacaaugccugcauuggcuccauccgaaacgggacuuaugaucaugacguauaccgcgacgaggcucugaauaacagauuccagauuaaaggaguggaacucaagagcgguuacaaagauuggauccuguggauaucuuuugccaucucaugcuuccuucugugugucgcauugcucggcuuuauuaugugggccugccaaaaugggaacaucagguguaauauuugcaucuga

SEQ ID NO: 131539 - RNA, 1701 nt, Artificial Sequence; identical to SEQ ID NO: 131446
  derived and/or modified sequence opt3 from hemagglutinin__InfluenzaA__AFN19593

SEQ ID NO: 131540 - RNA, 1701 nt, Artificial Sequence; identical to SEQ ID NO: 131447
  derived and/or modified sequence opt3 from hemagglutinin__InfluenzaA__AFN19595

SEQ ID NO: 131541 - RNA, 1701 nt, Artificial Sequence; identical to SEQ ID NO: 131447
  derived and/or modified sequence opt3 from hemagglutinin__InfluenzaA__AFN19599

SEQ ID NO: 131542 - RNA, 1701 nt, Artificial Sequence; identical to SEQ ID NO: 131509
  derived and/or modified sequence opt3 from hemagglutinin__InfluenzaA__AFN19601

SEQ ID NO: 131543 - RNA, 1701 nt, Artificial Sequence; identical to SEQ ID NO: 131090
  derived and/or modified sequence opt3 from hemagglutinin__InfluenzaA__AFN19607

SEQ ID NO: 131544 - RNA, 1701 nt, Artificial Sequence; identical to SEQ ID NO: 131446
  derived and/or modified sequence opt3 from hemagglutinin__InfluenzaA__AFN19609

SEQ ID NO: 131545 - RNA, 1701 nt, Artificial Sequence
  derived and/or modified sequence opt3 from hemagglutinin__InfluenzaA__AFN19611
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggcgcagcaauaacuccuuuuucucacgacugaauuggcucacgcauuuaaacuuuaaguauccagcacugaacgugacuaugcccaauaacgagcaguucgacaaguuguacaucuggggaguccaccauccuggcaccgauaaagaccagauuuuucuuuaugcccaaaguagcggccguaucacagugucuacuaagagaucccagcaggcuguaauaccaaauauugggucaaggccccggauccgcaacauuccuagcagaaucaguaucuacuggaccauuguugaaccaggagauauacugcuaaucaauucuacagguaaccucauugccccgaggggcuacuucaaaauccgguccgggaaaagcucgauaaugcgcucugacgcgcccauuggaaaauguaauuccgagugcaucaccccuaacggcucaaucccaaaugacaagcccuuucagaacgugaaucgaauuacguauggugcauguccuagauacgucaagcaaaguacucugaaacuugccacagggaugaggaacgugccagaaaagcagacccggggaaucuucggcgcuauugccggcuuuauagagaaugggugggagggaaugguggaugguugguauggcuuccgucaccagaacagcgaagggcgcggacaagcagcugaccugaaauccacucaggccgcgaucgaucagauuaauggcaaguugaacagacucaucgguaaaacaaacgagaaguuccaccagaucgaaaaagaguuuucugaagucgaggggaggauucaagaccuggagaaguacguugaagauaccaagauagacuuauggagcuauaaugccgagcugcucguggcacuugaaaaccagcauacgaucgaucugaccgacucagagaugaauaaauuguucgaaaagacaaagaagcagcuacgggagaacgcugaggauaugggcaauggaugcuuuaaaauuuaccacaagugugacaacgccugcaucggcaguauucgaaaugggacuuaugaucaugacguauaccgcgacgaagcucugaacaauagauuccagaucaagggaguggagcucaaauccgguuacaaggauuggauacuguggaucagcuuugccauuucuugcuuccuucugugugucgcauugcucggcuuuaucaugugggccugccaaaaagggaacauuagguguaauaucugcauauga

SEQ ID NO: 131546 - RNA, 1701 nt, Artificial Sequence; identical to SEQ ID NO: 131469
  derived and/or modified sequence opt3 from hemagglutinin__InfluenzaA__AFN19613

SEQ ID NO: 131547 - RNA, 1701 nt, Artificial Sequence; identical to SEQ ID NO: 131447
  derived and/or modified sequence opt3 from hemagglutinin__InfluenzaA__AFN19617

SEQ ID NO: 131548 - RNA, 1701 nt, Artificial Sequence
  derived and/or modified sequence opt3 from hemagglutinin__InfluenzaA__AFN19619
augaagaccaucauugcccugagccacauacucugccuuguguucgcucagaaacugcccggcaacgacaauuccacagcaacuuuguguuuagggcaucacgccgucccuaacggaacgaucguuaagaccauuacaaaugaucaaaucgaggugacuaacgcgaccgaacugguacagucuucaaguacaggugagauuugcgacagcccacaucagauccuagauggcgaaaauuguacccucauagacgcucugcuuggggauccgcagugcgacggauuucaaaacaaaaagugggaucuguucguggagagauccaaagccuacucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucacuuaaacuuuaaguacccagcacugaaugugaccaugcccaacaacgagcaguucgacaaacuuuauauuuggggaguccaucacccuggcacagauaaggaccagaucuuuuuguacgcccaaucuuccggccguauuacugugucaaccaagagaagccagcaggcuguaaucccaaauauagggaguaaacccaggauucggaacaucccuucucgcauuuccaucuauuggacaaucguuaagccaggagauauucugcuaauaaauagcaccgguaaccucaucgccccgagaggcuacuucaaaauuaggucggggaagucuuccaucaugcggucagacgcgcccauaggaaaguguaauagugaaugcauuacgccuaacggcagcaucccaaaugacaaacccuuucagaacgugaaucgcaucacuuacggugcauguccucgauaugucaagcaauccacacugaaacuugccaccgggaugagaaacgugccagagaagcagacuaggggaauuuucggcgcuaucgccggcuuuauugaaaaugggugggagggaaugguggaugguugguacggcuuccggcaccagaacucugaggggcguggacaagcagcugaccugaaaagcacacaggccgcgauagaucagaucaauggcaaguugaaccgccucauugguaaaaccaaugaaaaguuccaucagaucgagaaggaauuuucagaggucgaagggagaauccaagaccuggagaaauauguugaggauacgaagauugacuuauggaguuacaacgccgaacugcucguggcacuugagaaccagcacaccauagaucugacagacuccgaaaugaauaaauuguucgagaagacuaaaaagcagcuaagggaaaacgcugaggauaugggcaauggaugcuuuaagaucuaucauaaaugugacaacgccugcauuggcagcauccggaaugggaccuacaaccacgauguauaucgagacgaggcucugaauaaccgcuuccagauuaagggaguggaacucaaaucugguuacaaggacuggauccuguggauaucauuugccaucaguugcuuccuucugugugucguguugcucggcuuuauuaugugggcaugccaaaaagggaauaucagauguaacauuugcaucuga

SEQ ID NO: 131549 - RNA, 1701 nt, Artificial Sequence; identical to SEQ ID NO: 131509
  derived and/or modified sequence opt3 from hemagglutinin__InfluenzaA__AFN19623

SEQ ID NO: 131550 - RNA, 1701 nt, Artificial Sequence; identical to SEQ ID NO: 131446
  derived and/or modified sequence opt3 from hemagglutinin__InfluenzaA__AFN19629

SEQ ID NO: 131551 - RNA, 1701 nt, Artificial Sequence
  derived and/or modified sequence opt3 from hemagglutinin__InfluenzaA__AFN19631
augaagaccaucauugcccugagcuacauacucugccuuguguucgcucagaaacugcccgagaacgacuauuccacagcaacuuuguguuuaggccaccaugccgucccuaaugggacgaucguuaagaccauuacaaacgaucaaaucgaagugacuaaugcgaccgagcugguacagucuucaaguacaggagaaauuugcgacagcccacaccagauccuagaugguauaaacuguacccucaucgacgcucugcuuggcgauccgcagugcgacggguuucaaaauaaaaagugggaucuguucguggagagauccaaagccuacucuaacuguuaucccuacgacgucccugauuaugcaucguugaggucacucguggccagcaguggaacucuggaauuuaauaacgaguccuucaauuggacaggcguuacccagaacgguacgucuagcgcuugcauucggcgcuccacuucaaguuucuuuagccgacugaauuggcucacccauuuaaacuuuaaguacccagcacugaaugugacaaugcccaacaaugagcaguucgacaaguuguauaucuggggaguccaccauccugggacugauaaagaccagauuuuucuuuacgcccaaccaucuggccguaucaccguguccacaaagagaucacagcaggcuguaauacccaacauuggcagcaggccucggauccgcaacauuccaaguagaaucucuaucuacuggaccauuguuaaaccgggggauauacugcuaaucaauuccacgggaaaccucauugcccccagggguuauuucaagauccggagcggcaaaucgucuauaaugcgcuccgacgcgccuauugggaaguguaauucagaaugcaucacuccaaacggaaguauccccaaugacaagccuuuucagaacgugaaucgaauuacauacggcgcauguccaagauaugucaaacaaagcacccugaaacuugccacugguaugaggaacgugcccgagaagcagacacgggggaucuucggagcuauugccggcuuuauagaaaauggcugggaggggaugguggauggaugguacgguuuccgucaccagaacuccgagggccgcgggcaagcagcugaccugaagucuacccaggccgcgaucgaucagauuaauggaaaauugaacagacucaucggcaagacgaaugaaaaauuccaccagaucgagaaggaauuuagcgaggucgaagguaggauucaagaccuggagaaguauguugaggauaccaaaauagacuuauggucauacaacgccgaacugcucguggcacuugagaaucagcauacaaucgaucugacugacagugaaaugaacaaguuguucgagaaaaccaagaaacagcuacgggaaaacgcugaggauauggggaauggcugcuuuaagauuuaucacaagugugacaacgccugcaucggauccauucgaaauggcacauacaaccaugauguauaccgcgacgaggcucugaauaacagauuccagaucaaagggguggaacucaagagcggauauaaagacuggauacuguggaucucuuuugccauuucaugcuuccuucugugugucgcauugcucgguuuuaucaugugggccugccaaaagggcaauauuagguguaacaucugcauauga

SEQ ID NO: 131552 - RNA, 1701 nt, Artificial Sequence
  derived and/or modified sequence opt3 from hemagglutinin__InfluenzaA__AFN19633
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacuaucucaaccaagagaagccagcaggcugugauaccaaauauugggaguaggccccggauccgcaacauuccuucuagaaucuccaucuacuggacaauuguaaaaccaggagauauacugcuaaucaauagcaccgguaaccucauugccccgaggggcuacuucaagauccggucggggaaaucuuccauaaugcgcucagacgcgcccauuggaaaguguaauagugaaugcaucacgccuaacggcagcaucccaaaugacaagcccuuucagaacguuaaucgaauuacuuauggugcauguccuagauacgugaaacaauccacacugaaacuugccaccgggaugaggaacgucccagagaagcagacucggggaaucuucggcgcuauugccggcuuuauagaaaaugggugggagggaaugguggaugguugguauggcuuccgucaccagaacucugaggggcgcggacaagcagcugaccuuaagagcacacaggccgcgaucgaucagauuaauggcaaauugaacagacucaucgguaagaccaaugaaaaauuccaccagaucgagaaggaauuuucagagguggaagggaggauucaagaccuggagaaguacgucgaggauacgaaaauagacuuauggaguuauaacgccgaacugcucguugcacuugagaaccagcauaccaucgaucugacagacuccgaaaugaauaaguuguucgagaaaacuaagaaacagcuacgggaaaacgcugaggauaugggcaauggaugcuuuaagauuuaccacaagugugacaacgccugcaucggcagcauucgaaaugggaccuauaaccaugauguguaccgcgacgaggcucugaauaacagauuccagaucaaaggaguagaacucaagucugguuacaaagacuggauacuguggaucucauuugccauuaguugcuuccuucuguguguggcauugcucggcuuuaucaugugggccugccaaaaggggaauauuagguguaacaucugcauauga

SEQ ID NO: 131553 - RNA, 1701 nt, Artificial Sequence
  derived and/or modified sequence opt3 from hemagglutinin__InfluenzaA__AFN19635
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagaugguauaaauuguacccucaucgacgcucugcuuggcgauccgcagugcgacggguuucaaaacaaaaagugggaucuguucguggagagauccaaagccuauucuaauuguuaccccuaugacgucccugauuacgcaucguugaggucacucguggccagcaguggaacucuggaauuuaacaaugaguccuucaacuggacaggcguuacccagaaugguacgucuagcgcuugcauucggcgcuccaacucaaguuucuuuagccgacugaauuggcucacucauuuaaacuuuaaguauccagcacugaaugugaccaugcccaacaacgagcaguucgacaaguuguacaucuggggaguccaccauccugggacagauaaagaccagauuuuucuuuaugcccaaccaucuggccguaucacuguguccaccaagagaucacagcaggcuguaauacccaauauuggcagcaggccucggauccgcaacauuccaaguagaaucucuaucuacuggacaauuguuaaaccgggggauauacugcuaaucaauuccaccggaaaccucauugcccccagggguuacuucaagauccggagcggcaaaucgucuauaaugcgcuccgacgcgccuauugggaaguguaauucagaaugcaucacgccaaacggaaguauccccaaugacaagccuuuucagaacgugaaucgaauuacuuauggcgcauguccaagauacgucaaacaaagcacacugaaacuugccaccgguaugaggaacgugcccgagaagcagacucgggggaucuucggagcuauugccggcuuuauagaaaauggcugggaggggaugguggauggaugguaugguuuccgucaccagaacuccgagggccgcgggcaagcagcugaccugaagucuacacaggccgcgaucgaucagauuaauggaaaauugaacagacucaucggcaagaccaaugaaaaauuccaccagaucgagaaggaauuuagcgaggucgaagguaggauucaagaccuggagaaguacguugaggauacgaaaauagacuuauggucauauaacgccgaacugcucguggcacuugagaaccagcauaccaucgaucugacagacagugaaaugaauaaguuguucgagaaaacuaagaaacagcuacgggaaaacgcugaggauauggggaauggcugcuuuaagauuuaccacaagugugacaacgccugcaucggauccauucgaaauggcaccuauaaccaugauguauaccgcgacgaggcucugaauaacagauuccagaucaaagggguggaacucaagagcggauacaaagacuggauacuguggaucucuuuugccauuucaugcuuccuucugugugucgcauugcucgguuuuaucaugugggccugccaaaagggcaauauuagguguaacaucugcauauga

SEQ ID NO: 131554 - RNA, 1701 nt, Artificial Sequence; identical to SEQ ID NO: 131553
  derived and/or modified sequence opt3 from hemagglutinin__InfluenzaA__AFN19637

SEQ ID NO: 131555 - RNA, 1701 nt, Artificial Sequence; identical to SEQ ID NO: 131090
  derived and/or modified sequence opt3 from hemagglutinin__InfluenzaA__AFN19639

SEQ ID NO: 131556 - RNA, 1701 nt, Artificial Sequence; identical to SEQ ID NO: 131509
  derived and/or modified sequence opt3 from hemagglutinin__InfluenzaA__AFN19641

SEQ ID NO: 131557 - RNA, 1701 nt, Artificial Sequence; identical to SEQ ID NO: 131553
  derived and/or modified sequence opt3 from hemagglutinin__InfluenzaA__AFN19643

SEQ ID NO: 131558 - RNA, 1701 nt, Artificial Sequence; identical to SEQ ID NO: 131090
  derived and/or modified sequence opt3 from hemagglutinin__InfluenzaA__AFN19645

SEQ ID NO: 131559 - RNA, 1701 nt, Artificial Sequence
  derived and/or modified sequence opt3 from hemagglutinin__InfluenzaA__AFN19647
augaagaccaucauugcccugagcuacauacucugccuuguguucgcucagaaacugcccgagaacgacaauuccacagcaacuuuguguuuaggccaccaugccgucccuaacgggacgaucguuaagaccauuacaaaugaucaaaucgaagugacuaacgcgaccgagcugguacagucuucaaguacaggagaaauuugcgacagcccacaccagauccuagauggugugaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaagucacucguugccagcaguggaacucuggaauuuaacaaugaguccuucaacuggacaggcgugacccagaaugguacgucuagcgcuugcaucaggcgguccaacucaaguuucuuuagccgccugaauuggcucacucauuuaaacuuuaaguauccagcacugaaugucaccaugcccaacaacgagcaguucgacaaacuuuacauuuggggagugcaccauccugggacagauaaggaccagaucuuuuuguaugcccaaucuuccggccgaauuacuguaucaaccaaacguagccagcaggcuguuaucccaaauauaggcaguagacccaggauucggaacaucccuucucgcauuuccaucuacuggacaaucgugaagccaggggauauucugcuaauaaauagcaccggaaaccucaucgccccgagagguuacuucaaaauucagucgggcaagucuuccaucaugaggucagacgcgcccauagggaaguguaauagugaaugcauuacgccuaacggaagcaucccaaaugacaaacccuuucaaaacgucaaucggaucacuuauggcgcauguccucgcuacgugaagcaguccacacugaaacuugccaccgguaugcgaaacgugccagagaagcagacuagagggauuuucggagcuaucgccggcuuuauugaaaauggcugggaggggauggucgauggaugguaugguuucaggcaccaaaacucugagggccgggggcaggcagcugaccugaaaagcacacaggccgcgauagaucagaucaauggaaaguugaaccgucucauuggcaaaaccaaugaaaaguuccaccaaaucgagaaggaauuuucagagguugaaggucgcauccaggaccuggagaaauacguggaggauacgaagauugacuuauggaguuauaacgccgaacugcucguagcacuugagaaccagcauaccauagaucugacagacuccgaaaugaauaaauuguucgagaagacuaaaaagcagcuaagagaaaacgcugaggauauggggaauggcugcuuuaagaucuaccacaaaugugacaacgccugcauuggaagcaucaggaauggcaccuauaaccaugauguguaccgggacgaggcucugaauaaccgauuccaaauuaagggggucgaacucaaaucuggauacaaggacuggauccuguggauaucauuugccaucaguugcuuccuucuguguguggcauugcucgguuuuauuaugugggccugccagaaaggcaauauccgcuguaacauuugcaucuga

SEQ ID NO: 131560 - RNA, 1701 nt, Artificial Sequence
  derived and/or modified sequence opt3 from hemagglutinin__InfluenzaA__AFN19649
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuagugagaucugcgacagcccacaccagauacuagauggugaaaacuguacacucaucgacgcucugcuuggcgauccgcagugcgacggguuucagaauaaaaagugggaucuguucguggagagauccaaagccuauucuaacuguuaccccuaugacgucccugauuacgcaucguugaggucacucguggccagcaguggaacccuggaauuuaauaacgaguccuucaauuggacuggcguuacacagaacgguaccucuagcgcuugcauucggcgcuccaauucaaguuucuuuagccgacugaacuggcucacgcauuuaaauuuuaaguauccagcacugaacgugacuaugcccaacaaugagcaguucgacaagcuguacaucuggggaguccaccauccugggaccgauaaagaccagauuuuucuuuaugcccaaucuuccggccguaucacagugucaacuaagagaagccagcaggcuguaauaccaaacauuggcaguaggccccggauccgcaauauuccuucuagaaucuccaucuacuggaccauuguuaaaccaggggauauacugcuaaucaacagcacaggaaaucucauugccccgagggguuacuucaagauccggucgggcaaaucuuccauaaugcgcucagacgcgcccauugggaaguguaacagugaaugcaucaccccuaauggaagcaucccaaacgacaagcccuuucagaaugugaaccgaauuacguauggcgcauguccuagauacgucaaacaauccacucugaaguuggccacagguaugaggaaugugccagagaaacagacccgggggaucuucggagcuauugccggcuuuauagaaaacggcugggaggggaugauggauggaugguaugguuuccgucaccaaaauucugagggccgcgggcaggcagcugaccuuaagagcacucaggccgcgaucgaucagauuaacggaaaauugaauagacucaucggcaagacaaacgaaaaauuccaccagaucgagaaggaauuuucagagguggaagguaggauucaagaccuggagaaguacgucgaggauaccaaaauagacuuauggaguuauaacgccgaacugcucguugcacuugagaaucagcauacgaucgaucugaccgacuccgaaaugaacaaguuguucgagaaaacaaagaaacagcuacgggaaaaugcugaggauauggggaacggcugcuuuaagauuuaccacaagugugacaaugccugcaucggaagcauucgaaacggcacuuaugaucaugacguguaccgcgacgaggcucugaauaacagauuccagaucaaagggguagaacucaagucuggauacaaagauuggauacuguggaucucauuugccauuaguugcuuccuucuguguguggcauugcucgguuuuaucaugugggccugccaaaagggcaauauuagguguaacaucugcauauga

SEQ ID NO: 131561 - RNA, 1701 nt, Artificial Sequence; identical to SEQ ID NO: 131553
  derived and/or modified sequence opt3 from hemagglutinin__InfluenzaA__AFN19653

SEQ ID NO: 131562 - RNA, 1701 nt, Artificial Sequence; identical to SEQ ID NO: 131469
  derived and/or modified sequence opt3 from hemagglutinin__InfluenzaA__AFN19663

SEQ ID NO: 131563 - RNA, 1701 nt, Artificial Sequence; identical to SEQ ID NO: 131477
  derived and/or modified sequence opt3 from hemagglutinin__InfluenzaA__AFN19665

SEQ ID NO: 131564 - RNA, 1701 nt, Artificial Sequence
  derived and/or modified sequence opt3 from hemagglutinin__InfluenzaA__AFN19667
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcaugcggcgcagcaauuccucauuuuucagucgacugaacuggcucacgcauuuaaauuuuaaguauccagcacugaacgugacuaugcccaacaaugagcaguucgacaaacuuuacauuuggggaguccaccauccuggcaccgauaaggaccagaucuuuuuguaugcccaaagcucuggccguauuacaguguccacuaagagaucacagcaggcuguaaucccaaacauagggagcaggccccggauucgcaauaucccuaguagaauuucuaucuacuggaccaucguuaaaccaggagauauucugcuaauaaacuccacagguaaucucaucgccccgaggggcuacuucaagauucggagcgggaaaucgucuaucaugcgcuccgacgcgcccauaggaaaguguaacucagaaugcauuaccccuaauggcaguaucccaaacgacaagcccuuucagaaugugaaccgaaucacguauggugcauguccuagauacgucaaacaaagcacucugaaacuugccacagggaugaggaaugugccagagaagcagacccggggaauuuucggcgcuaucgccggcuuuauugaaaacgggugggagggaaugguggaugguugguauggcuuccgucaccaaaauuccgaggggcgcggacaggcagcugaccugaagucuacucaggccgcgauagaucagaucaacggcaaauugaauagacucauugguaagacaaacgaaaaauuccaccagaucgagaaggaauuuagcgaggucgaagggaggauccaagaccuggagaaguacguugaggauaccaaaauugacuuauggucauauaacgccgaacugcucguggcacuugagaaucagcauacgauagaucugaccgacagugaaaugaacaaguuguucgagaaaacaaagaaacagcuacgggaaaaugcugaggauaugggcaacggaugcuuuaagaucuaccacaagugugacaaugccugcauuggcuccauccgaaacgggacuuaugaucaugacguauaccgcgacgaggcucugaauaacagauuccagauuaaaggaguggaacucaagagcgguuacaaagauuggauccuguggauaucuuuugccaucucaugcuuccuucugugugucgcauugcucggcuuuauuaugugggccugccaaaaggggaauaucagguguaacauuugcaucuga

SEQ ID NO: 131565 - RNA, 1701 nt, Artificial Sequence
  derived and/or modified sequence opt3 from hemagglutinin__InfluenzaA__AFN19669
augaagaccaucauugcccugagcuacauacucugcaugguguucgcucagaaacuucccggcaacgacaauuccacagcaacucuguguuuggggcaccaugccgucccuaacggaacgaucguuaagaccauuacaaaugaucaaaucgaggugacuaacgcgaccgaauuaguacagaauagcucaauuggugagaucugcgacaguccacaccagauacuggauggcgaaaacuguacacuaaucgacgcucuccugggggauccgcagugcgacggauuucaaaauaaaaagugggaucuuuucguggagagaagcaaagccuauuccaacuguuaccccuaugacgucccuaauuacgcaucucugaggucguugguggccucaagcggcacccucgaauuuaacaaugagaguuucaacuggacugguguuacacagaaugggaccuccucugcuugcaugcggcgcagcaacuccucauuuuucagucgacugaauuggcugacgcaucucaacuuuaaguauccagcauuaaacgugacuaugcccaauaacgagcaguucgauaagcuguacauuuggggaguccaccauccuggcaccgacaaagaucagaucuuucuuuaugcccaaagcucuggccguauuacaguguccacuaagagaucacagcaggcuguaaucccaaauauagggagcaggccccggauucgcaacaucccuaguagaauuucuaucuacuggaccaucguuaaaccaggagacauuuugcugauaaauuccacagguaaccuaaucgccccgaggggcuacuucaagauucggagcgggaaaucgucuaucaugcgcuccgaugcgcccauaggaaaguguaauucagaaugcauuaccccuaacggcaguaucccaaaugacaagcccuuucagaacgugaaucgaaucacguauggugcauguccuagauacgucaaacaaagcacucucaagcuggccacagggaugaggaacgugccagagaaacagacccggggaauuuucggcgcuaucgccggcuuuauugaaaaugggugggagggaaugguggacgguugguauggcuuccgucaccagaacuccgaggggcgcggacaagcagcugaucuuaagucuacucaggccgcgauagaccagaucaauggcaaacugaacagauugauugguaagacaaacgaaaaauuccaccagaucgagaaggaauuuagcgaggucgaagggaggauccaagaucucgagaaguacguugaggacaccaaaauugaucuguggucauauaaugccgaauuacugguggcacucgagaaccagcauacgauagaccuuaccgauagugaaaugaauaagcuguucgagaaaacaaagaaacaguugcgggaaaacgcugaggacaugggcaauggaugcuuuaagaucuaccacaagugugauaacgccugcauuggcuccauccgaaaugggacuuaugaccaugauguauaccgcgacgaggcucuaaacaauagauuccagauuaaaggaguggaacugaagucugguuacaaagacuggauccucuggauaucuuuugccaucucaugcuuccugcuuugugucgcacuguugggcuuuauuaugugggccugccaaaaggggaacaucagguguaauauuugcaucuga

SEQ ID NO: 131566 - RNA, 1701 nt, Artificial Sequence
  derived and/or modified sequence opt3 from hemagglutinin__InfluenzaA__AFN19671
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauaacuccuuuuucucacgucugaauuggcucacgcauuuaaacuuuaaguauccagcacugaacgugacuaugcccaauaacgagcaguucgacaaacuuuacaucuggggaguccaccauccuggcaccgauaaagaccagaucuuuuuguaugcccagaguagcggcagaauuacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacaaacccuuucagaaugugaacagaauuacguauggugcauguccuagguacgucaagcagaguacucugaaacuugccacagggaugcggaaugugccagagaagcaaacccguggaaucuucggcgcuauugccggcuuuauagaaaacgggugggagggaaugguggaugguugguauggcuuccgccaccagaauagcgaggggagaggacaggcagcugaccugaaauccacucaagccgcgaucgaucagauuaacggcaaguugaauaggcucaucgguaaaacaaacgaaaaguuccaccagaucgagaaggaauuuucugaggucgaagggcggauucaggaccuggagaaauacguugaggauaccaagauagacuuauggagcuauaacgccgaacugcucguggcacuugagaaucaacauacgaucgaucugaccgacucagaaaugaacaaauuguucgagaagacaaagaagcagcuacgagaaaaugcugaggauaugggcaacggaugcuuuaagauuuaccacaaaugugacaaugccugcaucgagaguauucgcaacggcacuuaugaucaugacguauacagagacgaagcucugaauaacagguuccagaucaaggggguggagcucaaauccggauacaaggauuggauacuguggaucagcuuugccauuucuugcuuccuucugugugucgcauugcucgguuuuaucaugugggccugccagaaaggcaauauucgguguaacaucugcauauga

SEQ ID NO: 131567 - RNA, 1701 nt, Artificial Sequence; identical to SEQ ID NO: 131090
  derived and/or modified sequence opt3 from hemagglutinin__InfluenzaA__AFN19674

SEQ ID NO: 131568 - RNA, 1701 nt, Artificial Sequence; identical to SEQ ID NO: 131090
  derived and/or modified sequence opt3 from hemagglutinin__InfluenzaA__AFN19676

SEQ ID NO: 131569 - RNA, 1701 nt, Artificial Sequence; identical to SEQ ID NO: 131477
  derived and/or modified sequence opt3 from hemagglutinin__InfluenzaA__AFN19678

SEQ ID NO: 131570 - RNA, 1701 nt, Artificial Sequence
  derived and/or modified sequence opt3 from hemagglutinin__InfluenzaA__AFN19682
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccuaauuacgcaucuuugaggucgcucguggccucaagcggcacccuggaauuuaacaaugagaguuucaacuggacugguguuacacagaaugggaccuccucugcuugcaugcggcgcagcaacuccucauuuuucagucgacugaauuggcucacgcauuuaaacuuuaaguauccagcacugaacgugacuaugcccaauaacgagcaguucgauaaacuuuacauuuggggaguccaccauccuggcaccgacaaggaucagaucuuuuuguaugcccaaagcucuggccguauuacaguguccacuaagagaucacagcaggcuguaaucccaaauauagggagcaggccccggauucgcaacaucccuaguagaauuucuaucuacuggaccaucguuaaaccaggagacauucugcuaauaaauuccacagguaaccucaucgccccgaggggcuacuucaagauucggagcgggaaaucgucuaucaugcgcuccgaugcgcccauaggaaaguguaauucagaaugcauuaccccuaacggcaguaucccaaaugacaagcccuuucagaacgugaaucgaaucacguauggugcauguccuagauacgucaaacaaagcacucugaaacuugccacagggaugaggaacgugccagagaagcagacccggggaauuuucggcgcuaucgccggcuuuauugaaaaugggugggagggaaugguggacgguugguauggcuuccgucaccagaacuccgaggggcgcggacaagcagcugaucugaagucuacucaggccgcgauagaccagaucaauggcaaauugaacagacucauugguaagacaaacgaaaaauuccaccagaucgagaaggaauuuagcgaggucgaagggaggauccaagaucuggagaaguacguugaggacaccaaaauugauuuauggucauauaaugccgaacugcucguggcacuugagaaccagcauacgauagaccugaccgauagugaaaugaauaaguuguucgagaaaacaaagaaacagcuacgggaaaacgcugaggacaugggcaauggaugcuuuaagaucuaccacaagugugauaacgccugcauuggcuccauccgaaaugggacuuaugaccaugauguauaccgcgacgaggcucugaacaauagauuccagauuaaaggaguggaacucaagagcgguuacaaagacuggauccuguggauaucuuuugccaucucaugcuuccuucugugugucgcauugcucggcuuuauuaugugggccugccaaaaggggaacaucaaauguaauauuugcaucuga

SEQ ID NO: 131571 - RNA, 1701 nt, Artificial Sequence
  derived and/or modified sequence opt3 from hemagglutinin__InfluenzaA__AFN19684
augaagaccaucauugcccugagcuacauacucugccuugcuuucgcacagaaacugcccggcaacgacaauuccacagccacuuuguguuuagggcaccaugcggugccuaacggaacgaucgucaagaccauuacaaaugaucaaaucgagguuacuaacgcuaccgaacuggugcagucuucaaguacaggugagauuugcgacagcccacaccagauccuagauggcgaaaauuguacccucauagacgcccugcuuggggauccgcagugcgacggauuucaaaacaaaaagugggaucuguucguagagagauccaaagcauauucuaauuguuaccccuaugacgugccugauuacgccucguugaggucacucgucgcuagcaguggcacucuggaauuuaacaaugaguccuucaacuggacaggugugacccagaaugggacgucuagcgcaugcauccggggauccaacucaaguuucuuuagccgccugaauuggcucacucauuuaaacuuuaaguauccagcccugaauguuaccaugcccaacaacgagcaguucgacaagcuguacauuuggggcgugcaccauccuggcacagauaaagaccagaucuuuuuguaugcucaaucuuccgggcgaauuacugucucaaccaagcguagccagcaggccgugaucccaaauauaggaaguagacccaggauucggaacaucccuucucgcauuuccaucuacuggacaaucguaaaaccaggugauauucugcuaauaaauagcaccggcaaccucaucgcgccgagaggguacuucaagauuaggucgggaaaaucuuccaucaugcggucagacgcacccauaggcaaguguaauagugaaugcauuacgccuaacgguagcaucccaaaugacaagcccuuucagaacguuaaucgcaucacuuauggggccuguccucgauacgugaaacaauccacacugaaacuugcuaccggaaugagaaacgucccagagaagcagacuaggggcauuuucggcgccaucgcaggguuuauugaaaauggaugggaggguaugguggauggcugguauggguuccggcaccagaacucugagggacguggccaagcugccgaccuuaagagcacacaggcggccauagaucagaucaaugguaaauugaaccgccucauugggaagaccaaugaaaaauuccaccagaucgagaaggaauuuucagagguggaaggcagaauccaagaccuggagaaguacgucgaggauacgaaaauugacuuauggaguuauaacgcagaacugcucguugcucuugagaaccagcauaccauagaucugacagacuccgaaaugaauaaguuguucgagaaaacuaagaaacagcuaagggaaaacgccgaggauaugggaaauggcugcuuuaagaucuaccacaagugugacaacgcuugcauugggagcauccggaauggaaccuauaaccauaauguguaccgagaugaggcccugaacaaucgcuuccagauuaaagguguagaacucaagucuggcuacaaagacuggauccuguggauaucauuugcaaucaguugcuuccuucuguguguggccuugcucggguuuauuaugugggcuugccaaaagggaaacaucagauguaauauuugcaucuga

SEQ ID NO: 131572 - RNA, 1701 nt, Artificial Sequence
  derived and/or modified sequence opt3 from hemagglutinin__InfluenzaA__AFN19686
augaagaccaucauugcccugagcuacauacucugccuugcuuucgcacagaaacugcccggcaacgacaauuccacagccacuuuguguuuagggcaccaugcggugccuaacggaacgaucgucaagaccauuacaaaugaucaaaucgagguuacuaacgcuaccgaacuggugcagucuucaaguacaggugagauuugcgacagcccacaccagauccuagauggcgaaaauuguacccucauagacgcccugcuuggggauccgcagugcgacggauuucaaaacaaaaagugggaucuguucguagagagauccaaagcauauucuaauuguuaccccuaugacgugccugauuacgccucguugaggucacucgucgcuagcaguggcacucuggaauuuaacaaugaguccuucaacuggacaggugugacccagaaugggacgucuagcgcaugcauccggcgcuccaacucaaguuucuuuagccgacugaauuggcucacucauuuaaacuuuaaguauccagcccugaauguuaccaugcccaacaacgagcaguucgacaagcuguacauuuggggagugcaccauccuggcacagauaaagaccagaucuuuuuguaugcucaaucuuccggccguauuacugucucaaccaagagaagccagcaggccgugaucccaaauauagggaguaggccccggauucgcaacaucccuucuagaauuuccaucuacuggacaaucguaaaaccaggagauauucugcuaauaaauagcaccgguaaccucaucgcgccgaggggcuacuucaagauucggucggggaaaucuuccaucaugcgcucagacgcacccauaggaaaguguaauagugaaugcauuacgccuaacggcagcaucccaaaugacaagcccuuucagaacguuaaucgaaucacuuauggugccuguccuagauacgugaaacaauccacacugaaacuugcuaccgggaugaggaacauuccagagaagcagacucggggaaucuucggcgccauugcaggcuuuauagaaaaugggugggagggaauggucgaugguugguauggcuuccgucaccagaacucugaggggcgcggacaagcugccgaccuuaagagcacacaggcggccaucgaucagauuaauggcaaauugaacagacucaucgguaagaccaaugaaaaauuccaccagaucgagaaggaauuuucagagguggaagggaggauucaagaccuggagaaguacguggaggauacgaaaauagacuuauggaguuauaacgcagaacugcucgucgcucuugagaaccagcauaccaucgaucugacagacuccgaaaugaauaaguuguucgagaaaacuaagaaacagcuacgggaaaacgccgaggauaugggcaauggaugcuuuaagauuuaccacaagugugacaacgcuugcaucggcagcauucgaaaugggaccuauaaccauaauguuuaccgcgaugaggcccugaacaauagauuccagaucaaaggaguggaacucaagucugguuacaaagacuggauacuguggaucucauuugcaauuaguugcuuccuucuguguguagccuugcucggcuuuaucaugugggcuugccaaaaggggaacauuagguguaauaucugcauauga

SEQ ID NO: 131573 - RNA, 1701 nt, Artificial Sequence
  derived and/or modified sequence opt3 from hemagglutinin__InfluenzaA__AFN19688
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcgacagcccacaccagauccuagauggcgagaauuguacccucauagacgcucugcuuggggauccgcagugcgacggauuucaaaacaagaaaugggaucuguucguggaaagauccaaggccuauucuaauuguuaccccuaugacgucccugauuacgcaucguugaggucacucguggccagcaguggcacucuggaguuuaacaaugaguccuucaacuggacagguguuacccagaaugggacgucuagcgcuugcauccggcgcuccaacucaaguuucuuuagccgacugaauuggcucacucauuuaaacuuuaaauauccagcacugaaugugaccaugcccaacaacgaacaguucgacaaacuuuacauuuggggaguccaccauccuggcacagauaaggaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaagccaggagauauucugcuaauaaauagcaccgguaaccucaucgccccgaggggcuacuucaaaauucggucggggaagucuuccaucaugcgcucagacgcgcccauaggaaaauguaauagugagugcauuacgccuaacggcagcaucccaaaugacaagcccuuucagaacgugaaucgaaucacuuauggugcauguccuagauacgucaagcaauccacacugaaacuugccaccgggaugaggaacgugccagaaaagcagacucggggaauuuucggcgcuaucgccggcuuuauugagaaugggugggagggaaugguggaugguugguauggcuuccgucaccagaacucugaagggcgcggacaagcagcugaccugaaaagcacacaggccgcgauagaucagaucaauggcaaguugaacagacucauugguaaaaccaaugagaaguuccaccagaucgaaaaagaguuuucagaagucgaggggaggauccaagaccuggagaaguacguugaagauacgaagauugacuuauggaguuauaacgccgagcugcucguggcacuugaaaaccagcauaccauagaucugacagacuccgagaugaauaaauuguucgaaaagacuaaaaagcagcuacgggagaacgcugaggauaugggcaauggaugcuuuaaaaucuaccacaagugugacaacgccugcauuggcagcauccgaaaugggaccuauaaccaugauguauaccgcgacgaagcucugaauaacagauuccagauuaagggaguggagcucaaaucugguuacaaggacuggauccuguggauaucauuugccaucaguugcuuccuucugugugucgcauugcucggcuuuauuaugugggccugccaaaaagggaauaucagguguaacauuugcaucuga

SEQ ID NO: 131574 - RNA, 1701 nt, Artificial Sequence
  derived and/or modified sequence opt3 from hemagglutinin__InfluenzaA__AFN19690
augaagaccacaaucgcccugagcuacauucucugccuuguguucgcucagaaacugcccggcaacgacaauuccacugcaacguuguguuuagggcaccaugccgucccuaacggaaccauaguuaagacaaucacuaaugauagaauugaggugaccaacgcgacagaacugguacaaaauucuucaaucggugagauuugcgacaguccacaccagauccuagauggcgaaaacuguacccucauagacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacucuggaauuuaauaacgagaguuucaauuggacagguguuacccaaaacgggacguccucugcuugcauccgccgaagcaauaacuccuuuuucucacgucugaauuggcucacucauuuaaacuuuaaguauccagcacugaacgugaccaugcccaauaacgagcaguucgacaaacuuuacauuuggggaguccaccauccuggcacagauaaggaccagaucuuuuuguaugcccagaguagcggcagaauuacugugucuaccaagaggucccaacaggcuguaaucccaaauauagggucacggccccgcauuagaaacaucccuagcaggauuaguaucuacuggacaaucguuaaaccaggagauauucugcuaauaaauucuaccgguaaccucaucgccccgcggggcuacuucaagauucgcuccgggaaaagcucgaucaugcgaucugacgcgcccauaggaaaguguaaguccgaaugcauuacgccuaauggcucaaucccaaacgacaaacccuuucagaaugugaacagaaucacuuauggugcauguccuagguacgucaagcagaguacacugaaacuugccaccgggaugcggaaugugccagagaagcaaacucguggaauuuucggcgcuaucgccggcuuuauugaaaacgggugggagggaaugguggaugguugguauggcuuccgccaccagaauagcgaggggagaggacaggcagcugaccugaaauccacacaagccgcgauagaucagaucaacggcaaguugaauaggcucauugguaaaaccaacgaaaaguuccaccagaucgagaaggaauuuucugaggucgaagggcggauccaggaccuggagaaauacguugaggauacgaagauugacuuauggagcuauaacgccgaacugcucguggcacuugagaaucaacauaccauagaucugacagacucagaaaugaacaaauuguucgagaagacuaaaaagcagcuacgagaaaaugcugaggauaugggcaacggaugcuuuaagaucuaccacaaaugugacaaugccugcauuggcaguauccgcaacgggaccuaugaucaugacguauacagagacgaggcucugaauaacagguuccagauuaagggaguggaucucaaauccgguuacaaggacuggauccuguggaucagcuuugccauaucuugcuuccuucugugugucgcauugcucggcuuuauuaugugggccugccagaaagggaauauccgguguaacauuugcaucuga

SEQ ID NO: 131575 - RNA, 1701 nt, Artificial Sequence
  derived and/or modified sequence opt3 from hemagglutinin__InfluenzaA__AFN19692
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacagucuucaaguacaggugagaucugcgacagcccacaccagauacuggauggcgaaaauuguacccuaaucgacgcucuccugggggauccgcagugcgacggauuucaaaacaaaaagugggaucuuuucguggagagauccaaagccuauucuaauuguuaccccuaugacgucccugauuacgcaucgcugaggucauugguggccagcaguggcacucucgaauuuaacaaugaguccuucaacuggacagguguuacccagaaugggacgucuagcgcuugcauucggcgcuccgacucaaguuucuuuagccgacugaacuggcugacucaucucaauuuuaaguauccagcauuaaacgugaccaugcccaauaacgagcaguucgauaagcuguacaucuggggaguccaccauccuggcacagacaaagaucagauuuuucuuuaugcccaggcuucuggccguaucacuguguccaccaagagaucacaacaggccguaauaccaaacauugggagcaggccccggauccgcaauauuccuaguagaaucucuaucuacuggacaauuguuaaaccaggagacauauugcugaucaacuccaccgguaaucuaauugcgccgaggggcuacuucaagauccggagcgggaaaucgucuauaaugcgcuccgacgcacccauuggaaaguguaacucagaaugcaucacgccuaauggcaguaucccaaacgauaagcccuuucagaaugugaaccgaauuacuuauggugccuguccuagauacgucaaacaaaauacacucaagcuggcuaccgggaugaggaacgugccagagaaacagacucggggaaucuucggcgccauugcaggcuuuauagaaaaugggugggagggaaugguggacgguugguauggcuuccgucaccagaacagcgaggggcgcggacaagcugccgaucuuaaguccacacaggcggccaucgaccagauuaauggcaaacugaacagauugaucgguaagaccaaugaaaaauuccaccagaucgagaaggaauuuucugaggucgaagggaggauucaagaucucgagaaguacguugaggacacgaaaauagaucuguggagcuauaacgcagaauuacugguggcucucgagaaccagcauaccaucgaccuuacagauucagaaaugaauaagcuguucgagaaaacuaagaaacaguugcgggaaaacgccgaggacaugggcaauggaugcuuuaagauuuaccacaagugugauaacgcuugcaucggcaguauucgaaaugggaccuauaaccaugacguauaccgcgacgaggcccuaaauaacagauuccagaucaaaggaguggaacugaaguccgguuacaaagauuggauacucuggaucagcuuugcaauuucuugcuuccugcuuugugucgcccuguugggcuuuaucaugugggcuugccaaaaggggaauauuagguguaacaucugcauauga

SEQ ID NO: 131576 - RNA, 1701 nt, Artificial Sequence
  derived and/or modified sequence opt3 from hemagglutinin__InfluenzaA__AFN19694
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuccaauuggugagaucugcgacucaccgcaccagauacuagauggcgaaaacuguacacucaucgacgcucugcuuggggauccccagugcgacggauuucagaauaaaaagugggaucuguucguggagaggaguaaagccuauagcaacuguuacccuuaugacgucccagauuacgcauccuugcggucucucguggccucgucaggcacccuggaauuuaauaacgagagcuucaauuggacugguguuacacaaaacgggaccaguuccgcuugcauucgccgaucuaauaacagcuuuuucucccgucugaauuggcucacgcauuuaaacuuuaaguaucccgcacugaacgugacuaugccuaauaacgagcaguucgacaaacuuuacaucuggggaguccaccauccaggcaccgauaaagaccagaucuuuuuguaugcccagucaaguggcagaauuacagugagcacuaagaggucucaacaggcuguaauacccaauauugggucccggccucgcaucagaaacauuccaucaaggaucagcaucuacuggaccauuguuaaaccgggagauauacugcuaaucaauaguacagguaaccucauugcgccccggggcuacuucaagauccgcucugggaaauccagcauaaugcgaucggacgccccuauuggaaaguguaagucugaaugcaucaccccaaauggcuccauccccaacgacaaaccuuuucagaaugugaacagaauuacguauggugcauguccaagguacgucaagcagucaacucugaaacuugccacagggaugcggaaugugcccgagaagcaaacccguggaaucuucggcgcuauugccggcuuuauagaaaacgggugggagggaaugguggaugguugguauggcuuccgccaccagaauagugaggggagaggacaggcagcugaccugaaaagcacucaagccgcgaucgaucagauuaacggcaaguugaauaggcucaucgguaaaacaaacgaaaaguuccaccagaucgagaaggaauuuuccgaggucgaagggcggauucaggaccuggagaaauacguugaggauaccaagauagacuuauggucuuauaacgccgaacugcucguggcacuugagaaucaacauacgaucgaucugaccgacagcgaaaugaacaaauuguucgagaagacaaagaagcagcuacgagaaaaugcugaggauaugggcaacggaugcuuuaagauuuaccacaaaugugacaaugccugcaucggcucaauucgcaacgggacuuaugaucaugacguauacagagacgaggcucugaauaacagguuccagaucaagggaguggaacucaaaagugguuacaaggauuggauacuguggaucuccuuugccauuagcugcuuccuucugugugucgcauugcucggcuuuaucaugugggccugccagaaagggaauauucgguguaacaucugcauauga

SEQ ID NO: 131577 - RNA, 1701 nt, Artificial Sequence
  derived and/or modified sequence opt3 from hemagglutinin__InfluenzaA__AFN19700
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagcgguucaauuggagugguguuacucagaacgggacauccucugcuugcaugcgccgaagcaauuccucauuuuucagucgucugaacuggcucacccauuuaaauuuuaaguauccagcacugaacgugacgaugcccaacaaugagcaguucgacaaacuuuacauuuggggaguccaccauccuggcacugauaaggaccagaucuuuuuguaugcccaaagcucuggcagaauuaccguguccacaaagaggucacagcaggcuguaaucccaaacauagggagccggccccgcauuagaaauaucccuaguaggauuucuaucuacuggacuaucguuaaaccaggagauauucugcuaauaaacuccaccgguaaucucaucgccccgcggggcuacuucaagauucgcagcgggaaaucgucuaucaugcgauccgacgcgcccauaggaaaguguaacucagaaugcauuacaccuaauggcaguaucccaaacgacaagcccuuucagaaugugaacagaaucaccuauggugcauguccuagguacgucaaacaaagcacgcugaaacuugccacugggaugcggaaugugccagagaagcagacacguggaauuuucggcgcuaucgccggcuuuauugaaaacgggugggagggaaugguggaugguugguauggcuuccgccaccaaaauuccgaggggagaggacaggcagcugaccugaagucuacccaggccgcgauagaucagaucaacggcaaauugaauaggcucauugguaagacuaacgaaaaauuccaccagaucgagaaggaauuuagcgaggucgaagggcggauccaagaccuggagaaguacguugaggauacaaaaauugacuuauggucauauaacgccgaacugcucguggcacuugagaaucagcauaccauagaucugacggacagugaaaugaacaaguuguucgagaaaaccaagaaacagcuacgagaaaaugcugaggauaugggcaacggaugcuuuaagaucuaccacaagugugacaaugccugcauuggcuccauccgcaacgggacauaugaucaugacguauacagagacgaggcucugaauaacagguuccagauuaaaggaguggaacucaagagcgguuacaaagauuggauccuguggauaucuuuugccaucucaugcuuccuucugugugucgcauugcucggcuuuauuaugugggccugccaaaaggggaauauccgguguaacauuugcaucuga

SEQ ID NO: 131578 - RNA, 1701 nt, Artificial Sequence
  derived and/or modified sequence opt3 from hemagglutinin__InfluenzaA__AFN19702
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggggcaaagccuauagcaacuguuaccccuaugacgucccugauuacgcauccuugcggucucucguggccucgucagguacccuggaauuuaauaacgagagcuucaauuggacugggguuacacaaaacggaaccaguuccgcuugcauucgccgaucuaauaacagcuuuuucucccgucugaauuggcucacgcauuuaaacuuuaaguauccagcacugaacgugacuaugcccaauaacgagcaguucgacaaacuuuacaucuggggcguccaccauccuggcaccgauaaagaccagaucuuuuuguaugcccagucaagugggagaauuacagugagcacuaagaggucucaacaggcuguaauaccaaauauuggaucccggccccgcaucagaaacauuccuucaaggaucagcaucuacuggaccauuguuaaaccaggugauauacugcuaaucaauaguacaggcaaccucauugccccgcggggguacuucaagauccgcucuggaaaauccagcauaaugcgaucggacgcgcccauuggcaaguguaagucugaaugcaucaccccuaaugguuccaucccaaacgacaaacccuuucagaaugugaacagaauuacguauggggcauguccuagguacgucaagcagucaacucugaaacuugccacaggaaugcggaaugugccagagaagcaaacccguggcaucuucggcgcuauugccggguuuauagaaaacggaugggaggguaugguggauggcugguauggguuccgccaccagaauagugagggaagaggccaggcagcugaccugaaaagcacucaagccgcgaucgaucagauuaacgguaaguugaauaggcucaucgggaaaacaaacgaaaaguuccaccagaucgagaaggaauuuuccgaggucgaaggccggauucaggaccuggagaaauacguugaggauaccaagauagacuuauggucuuauaacgccgaacugcucguggcacuugagaaucaacauacgaucgaucugaccgacagcgaaaugaacaaauuguucgagaagacaaagaagcagcuacgagaaaaugcugaggauaugggaaacggcugcuuuaagauuuaccacaaaugugacaaugccugcaucgggucaauucgcaacggaacuuaugaucaugacguauacagagacgaggcucugaauaacagguuccagaucaaggguguggaacucaaaaguggcuacaaggauuggauacuguggaucuccuuugccauuagcugcuuccuucugugugucgcauugcucggguuuaucaugugggccugccagaaaggaaauauucgguguaacaucugcauauga

SEQ ID NO: 131579 - RNA, 1701 nt, Artificial Sequence; identical to SEQ ID NO: 128831
  derived and/or modified sequence opt3 from hemagglutinin__InfluenzaA__AFN19709

SEQ ID NO: 131580 - RNA, 1701 nt, Artificial Sequence
  derived and/or modified sequence opt3 from hemagglutinin__InfluenzaA__AFN19719
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaacccagcucaagaacaaugccaaggagaucggcaacggauguuuugaguucuaucacaaaugcgacaauacauguauggaaagcgugaagaacggcaccuacgauuauccuaaauacucagaagaggcaaagcugaauagagaagagauugacggggucaaacuugagaguacuaggguguaucaaauccuggccauuuacuccacggucgcuagcucuuuggugcucguugugucacugggagcgauaaguuuuuggaugugcagcaacgguuccuuacagugccggaucuguauuuga

SEQ ID NO: 131581 - RNA, 1701 nt, Artificial Sequence; identical to SEQ ID NO: 128451
  derived and/or modified sequence opt3 from hemagglutinin__InfluenzaA__AFN19730

SEQ ID NO: 131582 - RNA, 1701 nt, Artificial Sequence; identical to SEQ ID NO: 128831
  derived and/or modified sequence opt3 from hemagglutinin__InfluenzaA__AFN19736

SEQ ID NO: 131583 - RNA, 1701 nt, Artificial Sequence
  derived and/or modified sequence opt3 from hemagglutinin__InfluenzaA__AFN19748
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaacgggaaacagcuacccaaaguuaucuaaauccuauauaaaugacaagggcaaggaaguacugguucuuuggggcauccaccaccccucaacuaccgcugaucaacagagcuuguaccagaacgccgacacauacguguucgucgggaccagucgcuauucuaaaaaguuuaaaccugagauugcgauccgaccaaaggugcgugaucaggagggaagaaugaauuacuauuggacucugguggaacccggugacaaaauuacauucgaggcaaccggcaaccuagucguuccuagguacgccuuugcuauggaacggaacgccggguccggaaucauaauuagcgauacgccagugcaugacugcaauacuacaugucaaaccccgaagggcgcaaucaacacuucgcuccccuuccagaauauucacccuaucacaaucgguaaaugcccaaaguauguaaagucuaccaaacugcgccuugcuacggggcugagaaacgugcccuccauucagucaaggggauuguuuggcgccauagcgggcuucaucgaagggggauggaccgguauggucgacggcugguacggguaucaucaccagaaugaacaaggaaguggcuacgccgcagaucucaagagcacacagaacgcuauugacaaaaucacuaauaaggugaacuccguuauagagaaaaugaauacccaguuuacagccguggguaaggaguucaaccaccuggaaaagcggauugagaauuuaaacaaaaaggucgaugacggguuccuggauaucuggacuuacaaugcugaacuccuugugcuguuggagaacgaacgcacccuagacuaucaugauucuaauguaaagaaccuguacgagaagguucgaaaccagcucaaaaauaacgccaaggagacaggcaauggauguuuugaguucuaucacaagugcgacaacaccuguauggaaagcgugaaaaauggcacuuacgauuauccuaaguacucagaagaggcaaaacugaacagagaagagaucgacggggucaaacuugagaguacgaggauuuaucaaauccuggccauuuacuccacaguggcuagcucuuugguccucgugguuucacugggagcgauaaguuuuuggaugugcagcaaugguuccuuacagugccggaucuguauuuga

SEQ ID NO: 131584 - RNA, 1701 nt, Artificial Sequence; identical to SEQ ID NO: 128840
  derived and/or modified sequence opt3 from hemagglutinin__InfluenzaA__AFN19757

SEQ ID NO: 131585 - RNA, 1701 nt, Artificial Sequence; identical to SEQ ID NO: 128831
  derived and/or modified sequence opt3 from hemagglutinin__InfluenzaA__AFN19768

SEQ ID NO: 131586 - RNA, 1701 nt, Artificial Sequence
  derived and/or modified sequence opt3 from hemagglutinin__InfluenzaA__AFN19781
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuguggaacggaacgccggguccggaaucauaauuagcgauaccccaguacaugacugcaauacgacuugucaaacaccgaaaggcgcaaucaacaccucgcuccccuuccagaauauucacccuaucacuaucgguaagugcccaaaguaugugaaaucuacaaagcugcgccuugcuaccgggcugagaaacguccccuccauucagucaaggggauuguuuggcgccauagcgggcuucaucgaagggggauggacggguaugguggacggcugguacggguaucaucaccagaaugaacaaggaaguggcuacgccgcagaucucaaaagcacccagaacgcuauugacaagaucacaaauaaaguuaacuccgugauagagaagaugaauacucaguuuaccgccgucgguaaggaguucaaccaccuggaaaaacggauugagaauuuaaacaagaaaguggaugacggguuccuggauaucuggacauacaaugcugaacuccuuguacuguuggagaacgaacgcacucuagacuaucaugauucuaauguuaagaaccuguacgagaaagugcgaaaccagcucaagaauaacgccaaggagaucggcaauggauguuuugaguucuaucacaaaugcgacaacaccuguauggaaagcgucaagaauggcacauacgauuauccuaaauacucagaagaggcaaagcugaacagagaagagauugacggggugaaacuugagaguaccaggaucuaucaaauucuggccauauacuccacugucgcuagcucuuuggugcucguugugucacugggagcgaucaguuuuuggaugugcagcaaugguuccuuacagugccggauuuguaucuga

SEQ ID NO: 131587 - RNA, 1701 nt, Artificial Sequence
  derived and/or modified sequence opt3 from hemagglutinin__InfluenzaA__AFN19791
augaaggccauccuggugguccuccuuuacaccuucgcuauugcaaacgccgacacacugugcauaggcuaucacgcgaauaacagcacugauacgguugacaccguguuggagaaaaauguaacagugacucauuccgucaacuuacuggaagauaagcacaaugggaaacuauguaagcucagaggaguggcuccccugcaucuugguaaaugcaacaucgccggcuggauucuggggaauccugagugugaaucuuugucaaccgcaaguagcugguccuacaucguugagacaucuucgucagacaacggaaccugcuauccaggcgauuuuauuaauuacgaagaacucagggagcagcugagcaguguguccucuuucgaacgguuugagaucuucccgaagacuagcuccuggcccaaccacgacucaaauaagggugucacagccgcuuguccucaugcaggggccaaaaguuuuuauaagaaccugauauggcucgugaaaaagggaaauagcuacccaaaauuaucuaaguccuauaucaacgauaagggcaaagaaguacugguucuuuggggcauucaccaccccucaaccagcgcugaccaacagaguuuguaccagaaugccgaugcguacguguucgucgggacgucuaaguauuccaaaaaguuuaaaccugagaucgcagugcgcccaaaggugcgagaccaggagggacguaugaacuacuauuggacucuggucgaacccggugauaaaauuaccuucgaggccacaggcaaccuacucguuccuagauacgcuuuugccauggaaaggaaugcagggagcggaaucauaauuucggacacuccagugcaugauugcaacaccacaugucaaaccccggagggcgcuaucaauacgucucugcccuuccagaacauucacccuaucacuaucgguaagugcccaaaguauguaaaauccacaaaacuucggcuggccaccggguugcgcaaugugcccucaauucagaguagaggacucuuuggcgcgauagccggcuucaucgaagggggauggacugguauggucgacggcugguacggguaucaucaccagaacgagcaaggaagcggcuacgcagcugaccugaaguccacacagaaugccauugauaagaucaccaacaaaguuaauucugugauagagaagaugaacacgcaguuuaccgcuguggguaaggaguucaaucacuuagagaaaaggauugaaaaccugaauaagaaagucgacgauggguuccucgacaucuggacauacaacgccgagcuucugguguugcuagaaaaugagcggacucuggauuaucaugacagcaacguaaagaaccucuacgagaaaguucgcucacagcugaagaauaacgcaaaggaaaucggcaauggauguuuugaguucuaucacaaaugcgauaacaccuguauggaaagugugaagaauggcacauacgacuauccuaaauacuccgaggaagccaaacuuaaccgagaggagauugauggggucaagcuggaaagcacuagaaucuaucaaauuuuggcuauauacucuaccguggcgucaagucucguccugaucgugagcuuaggagcaauuuccuuuuggaugugcucuaaugguucgcugcagugcaggaucuguaucuga

SEQ ID NO: 131588 - RNA, 1701 nt, Artificial Sequence; identical to SEQ ID NO: 128831
  derived and/or modified sequence opt3 from hemagglutinin__InfluenzaA__AFN19806

SEQ ID NO: 131589 - RNA, 1701 nt, Artificial Sequence
  derived and/or modified sequence opt3 from hemagglutinin__InfluenzaA__AFN19808
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaacaguuggagcuacauuguugagaccuccucuucggacaauggaacuugcuauccaggcgauuuuaucgacuacgaggagcucagggagcagcugucaagcgugaguuccuucgaacgguuugagauuuucccgaagacaaacucuuggcccaaucacgauagcaacaagggugucaccgccgcuuguccucaugcaggggccaaauccuuuuauaagaaucugaucuggcucgugaaaaagggaaacucauacccaaaauuaaguaagagcuauauaaaugacaagggcaaagaaguacugguucuuuggggcauccaccaccccucuacguccgcugaucaacagucauuguaccagaacgccgacgcguacguguucgucgggacuagccgcuauaguaagaaauuuaagccugagauugcaauccgaccaaaagugcgugaucaggagggaagaaugaacuacuauuggacccugguggaacccggugacaagauuacauucgaggccacuggcaaucuagucguuccuagguacgcuuuugccauggaacggaacgcagggucuggaaucauaauuuccgauaccccagcucaugacugcaauacaaccugucaaacgccgaaaggcgccaucaacacuagccuccccuuccagaauauucacccuaucacaaucgguaagugcccaaaguaugugaacucgaccaaacugcgccuugcgacugggcugagaaauguacccucuauucaguccaggggauuguuuggcgccauagcaggcuucaucgaagggggauggacagguaugguggacggcugguacggguaucaucaccagaacgaacaaggaucaggcuacgcugccgaucucaagaguacccagaaugcuauugacaaaaucacgaacaaggucaauagcgugauagagaaaaugaacacccaguuuacagccguugguaaggaguucaaucaccuggaaaagcggauugagaacuuaaauaaaaagguggaugacggguuccuggauaucuggacuuacaacgcagaacuccuuguccuguuggagaacgaacgcacccuagacuaucaugauuccaaugugaaaaaccuguacgagaagguacgaucucagcucaaaaauaacgccaaggagaucggcaauggauguuuugaguucuaucacaagugcgacaacacauguauggaaagcguuaaaaauggcacuuacgauuauccuaaguacucagaagaggcuaaacugaacagagaagagauugacggggugaaacuugagaguaccaggaucuaucaaauucuggcgauauacuccacagucgcaagcucuuuggugcucgucgugucacugggagccaucaguuuuuggaugugcagcaaugguuccuuacagugccggauuuguaucuga

SEQ ID NO: 131590 - RNA, 1701 nt, Artificial Sequence; identical to SEQ ID NO: 128840
  derived and/or modified sequence opt3 from hemagglutinin__InfluenzaA__AFN19814

SEQ ID NO: 131591 - RNA, 1701 nt, Artificial Sequence
  derived and/or modified sequence opt3 from hemagglutinin__InfluenzaA__AFN19816
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacgggaugccggaucuggcaucauaauuuccgacaccccagugcaugacugcaacacgacuugucaaacaccgaaaggugcaaucaauaccagccuccccuuccagaacauucacccuaucacuaucgggaagugcccaaaguauguaaaaucgacaaagcugcgccuugcuaccggacugagaaaugugcccucuauucaguccaggggcuuguuuggcgccauagcgggguucaucgagggagguuggacgggcauggucgaugggugguacggauaucaucaccagaacgaacaaggcucagguuacgccgcagaccucaaaaguacccagaaugcuauugauaagaucacaaacaaagugaauagcguuauagagaagaugaacacucaguuuaccgccguggggaaggaguucaaucaccuggaaaaacggauugagaacuuaaauaagaaagucgacgauggcuuccuggacaucuggacauacaacgcugaacuccuugugcuguuggagaaugaacgcacucuagauuaucaugacuccaacguaaagaaucuguacgagaaaguucgaaaccagcucaagaacaaugccaaggagaucggaaacggcuguuuugaguucuaucacaaaugcgauaauaccuguauggagucugugaagaacgggacauacgacuauccuaaauacagcgaagaggcaaagcugaauagagaagagauugauggagucaaacuugagucaaccaggaucuaucaaauucuggccauauacaguacuguggcuuccagcuugguccucgugguuucucugggugcgaucucauuuuggaugugcaguaacggcagcuuacagugccggauuuguaucuga

SEQ ID NO: 131592 - RNA, 1701 nt, Artificial Sequence
  derived and/or modified sequence opt3 from hemagglutinin__InfluenzaA__AFN19821
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaacugaagccugagauugcgauccgaccaaaagugcgugaucaggagggaagaaugaauuacuauuggacucuaguggaacccgguggcaagauuaccuuugaggcaacagggaaccucgucguuccuagguacgccuucgcuauggaacggaacgccggauccggcaucauaauuagcgacaccccagugcaugauugcaauacgacuugucaaacaccgaaaggugcaaucaacaccucgcugcccuuucagaauauucacccuaucacuaucgggaagugcccaaaguauguaaaaucuacaaagcugcgccuugcuaccggauugagaaacgugcccuccauucagucaaggggccucuucggcgccauagcgggguuuaucgagggagguuggacgggcauggucgacgggugguacggauaucaucaccagaaugaacaaggcagugguuacgccgcagaccugaaaagcacccagaacgcuauugauaagaucacaaauaaagugaacuccguuauagagaagaugaauacucaguucaccgccguggggaaggaguuuaaccacuuagaaaaacggauugagaaucugaacaagaaagucgacgauggcuuccucgacaucuggacauacaaugcugaacuucugguguugcuagagaacgaacgcacucuggauuaucaugacucuaauguaaagaaccucuacgagaaaguucgaaaccagcugaagaauaacgccaaggagaucggaaauggcuguuucgaauuuuaucacaaaugcgauaacaccuguauggagagcgugaagaaugggacauacgacuauccuaaauacucagaagaggcaaaacuuaacagagaagagauugauggagucaagcuggagaguaccaggaucuaucaaauuuuggccauauacuccacuguggcuagcucucucguccuggugguuucauuaggugcgaucaguuucuggaugugcagcaauggcucccugcagugccggauuuguaucuga

SEQ ID NO: 131593 - RNA, 1701 nt, Artificial Sequence; identical to SEQ ID NO: 128451
  derived and/or modified sequence opt3 from hemagglutinin__InfluenzaA__AFN19831

SEQ ID NO: 131594 - RNA, 1701 nt, Artificial Sequence
  derived and/or modified sequence opt3 from hemagglutinin__InfluenzaA__AFN19849
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcgacauagccggcuggauccuggggaacccugagugugaaucuuugucaacagcaaguagcugguccuacauuguugagaccucuucgucagauaauggaacuugcuauccaggcgacuuuaucaacuacgaggagcucagggagcagcugagcaguguguccucuuucgaacgguuugagauuuucccgaagacaagcuccuggcccaaucacgauucaaacaagggugucaccgccgcuuguccucaagcaggggccaaaaguuuuuauaagaaucugaucuggcucgugaaaaagggaaacagcuacccaaaauuaucuaaguccuauauaaaugacaagggcaaagaaguacugguucuuuggggcauccaucaccccucaacgagcgcugaucagcagaguuuguaccagaacgccgacgcguacguguucgucgggacuucuaaguauuccaaaaaguuuaaaccugagauugcagugcgcccaaaggugcgagaucaagagggacguaugaauuacuauuggacccuggucgaacccggugacaaaaucacauucgaggccacuggcaaccuacucguuccuagauacgcuuuugccauggaaaggaacgcagggagcggaauuaucauaucggauaccccagugcacgacugcaauacaaccugucagacgccgaagggcgcuauuaacacuucucugcccuuccagaauauccauccuauuacaaucgguaagugcccaaaauauguaaaguccaccaaacuucggcuggccacuggguugcgcaacgugcccucaauccagaguagaggacucuuuggcgcgauugccggcuucauagaagggggauggacagguauggucgacggcugguacggguaucaccaucaaaaugcacagggaagcggcuacgcugccgaucugaaguccacccagaacgcuaucgacaaaauuacgaauaaggugaacucuguuaucgaaaagaugaauacccaguuuacagccguggguaaagaguucaaccacuuagagaagaggauagaaaaucugaacaaaaaggucgaugacggguuccucgauauuuggacuuacaaugcagagcuucugguguugcuagaaaacgagcggacccuggacuaucacgauagcaauguuaaaaaccucuacgaaaagguacgcucacaacugaagaacaaugccaaagagaucggcgacggauguuuugaguucuaucauaagugcgauaacacauguauggaaagugugaaaaauggcacuuacgacuauccuaaguacuccgaggaagcuaaacuuaaccgagaggaaaucgauggggucaagcuggagagcaccagaauuuaucagaucuuggcgauuuacucuacaguggcaucaagucucguccuggugguuagcuuaggagccauauccuuuuggaugugcucuaaugguucgcugcagugcaggaucuguauuuga

SEQ ID NO: 131595 - RNA, 1701 nt, Artificial Sequence
  derived and/or modified sequence opt3 from hemagglutinin__InfluenzaA__AFN19865
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacgcguacguguucgucgggaccagucgcuauucuaagaaauuuaagccugagauugcaauccgaccaaaagugcgugaucaggagggaagaaugaauuacuauuggacacugguggaacccggugacaagauuacuuucgaggccaccggcaaccuagucguuccuagguacgcuuuugccauggaacggaacgcaggguccggaaucauaauuagcgauacacucgugcaugacugcaauaccacgugucaaacuccaaaaggcgcuaucaacacaucgcugccguuccagaauauucaccccaucaccaucgguaagugcccuaaguauguaaaaucuacuaagcugcgccuugccacaggguugagaaacgugccauccauucagucaaggggacucuuuggcgcgauagccggcuucaucgaagggggauggaccgguauggucgacggcugguacggguaucaucaccagaaugaacaaggaaguggcuacgcagcugaucugaaaagcacgcagaacgccauugacaagaucaccaauaaagugaacuccguuauagagaagaugaauacacaguuuacugcuguggguaaggaguucaaccacuuagaaaaacggauugagaaucugaacaagaaagucgaugacggguuccucgauaucuggaccuacaaugccgaacuucugguguugcuagagaacgaacgcacacuggacuaucaugauucuaauguaaagaaccucuacgagaaaguucgaaaccagcugaagaauaacgcaaaggagaucggcaauggauguuuugaguucuaucacaaaugcgacaacacuuguauggaaagcgugaagaauggcaccuacgauuaucccaaauacucagaagaggccaaacuuaacagagaagagauugacggggucaagcuggagaguacaaggaucuaucaaauuuuggcuauauacuccaccguggcgagcucucucguccuggugguuucauuaggagcaaucaguuuuuggaugugcagcaaugguucccugcagugccggauuuguaucuga

SEQ ID NO: 131596 - RNA, 1701 nt, Artificial Sequence
  derived and/or modified sequence opt3 from hemagglutinin__InfluenzaA__AFN19875
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggagaaaaguuuuuauaagaaccugaucuggcucgugaaaaagggaaauagcuacccaaaauuaucuaaguccuauauaaacgauaagggcaaagagguacugguucuuuggggcauccaccaccccucaacgagcgccgaccaacagaguuuguaccagaaugcugaugccuacguguucgucgggacuucuaaguauuccaaaaaguuuaaaccugagauugcggugcgcccaaaggugcgagaccaggaaggacguaugaacuacuauuggacccuggucgagcccggugauaaaaucacauucgaagcaacuggcaaccuacucguuccuagauacgccuuugcuauggagaggaaugccgggagcggaauuaucauaucggacaccccagugcaugauugcaacacaaccugucaaacgccgaagggcgcaauuaauacuucucugcccuuccagaacauccacccuauuacaaucgguaagugcccaaaauauguaaaguccaccaaacuucggcuggcuacuggguugcgcaaugugcccucaauccagaguagaggacucuuuggcgccauugcgggcuucauagaagggggauggacagguauggucgacggcugguacggguaucaucaccagaacgagcaaggaagcggcuacgccgcagaccugaaguccacccagaaugcuaucgauaaaauuacgaacaagguaaauucuguuaucgagaagaugaacacccaguuuacagccguggguaaagaguucaaucacuuagaaaagaggauagaaaaccugaauaaaaaggucgacgauggguuccucgacauuuggacuuacaacgcugagcuucugguguugcuagaaaaugagcggacccuggauuaucaugacagcaacgugaaaaaccucuacgagaagguucgcucacagcugaagaauaacgccaaagaaaucggcaauggauguuuugaguucuaucacaagugcgauaacacauguauggaaagugugaaaaauggcacuuacgacuauccuaaguacuccgaggaagcaaaacuuaaccgagaggagaucgauggggucaagcuggaaagcaccagaauuuaucaaaucuuggccauuuacucuacaguggcuucaagucucguccuggugguuagcuuaggagcgauauccuuuuggaugugcucuaaugguucgcugcagugcaggaucuguauuuga

SEQ ID NO: 131597 - RNA, 1701 nt, Artificial Sequence
  derived and/or modified sequence opt3 from hemagglutinin__InfluenzaA__AFN19895
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaguugagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaaauaucuaaguccuauaucaaugacaagggcaaagaaguauuaguucuguggggcauucaccaccccucaacgacugcugaucaacagagccuuuaccagaacgccgacaccuacguguucgucgggacaagucgcuauucuaagaaauuuaagccugagaucgcgauucgaccaaaagugcgugaucaggagggaagaaugaauuacuauuggacuuugguggaacccggugacaagaucaccuucgaggcaacaggcaaccuggucguuccuagguacgccuuugcuauggaacggaacgccggguccggaauaauuaucagcgauaccccagugcaugacugcaauacgacuugucaaacaccgaaaggcgcaauuaacaccucgcuacccuuccagaauauccacccuaucacuauuggucgcugcccaaaguauguaaagucuacaaaacucagacuggcuaccgggcuuaggaacgugcccuccauacagucacggggacuguuuggcgccaucgcgggcuucauugaagggggauggacggguauggucgacggcugguacggguaucaucaccagaaugaacaaggaaguggcuacgccgcagaucucaagagcacccagaacgcuaucgacaaaauaacaaauaaggugaacuccguuauugagaaaaugaauacucaguuuaccgccguggguaaggaguucaaccaccucgaaaagcgcaucgagaaucugaacaaaaaggucgaugacggguucuuagauaucuggacauacaaugcugaacugcucgugcuucuggagaacgaacgaacuuuggacuaucaugauucuaauguuaaaaaccuauacgagaagguaagaaaccagcugaaaaauaacgccaaggagaccggcaauggauguuuugaguucuaucacaagugcgacaacacauguauggagagcgugaaaaauggcaccuacgauuauccuaaguacucagaagaggcaaaacucaacagggaagucauugacggggugaagcuggagaguacucggaucuaucaaauucuugccauauacuccacggucgcuagcucucugguguugguugugucacucggagcgaucaguuuuuggaugugcagcaaugguucccugcagugccguauuuguaucuga

SEQ ID NO: 131598 - RNA, 1701 nt, Artificial Sequence
  derived and/or modified sequence opt3 from hemagglutinin__InfluenzaA__AFN19905
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuguggacaagauuacaaauaaaguuaacagcgugaucgagaagaugaauacucaguuuaccgccgucgggaaggaguucaaccaccuggaaaaacggauagagaauuuaaacaagaaaguggaugacggcuuccuggauauuuggacauacaaugcugaacuccuuguacuguuggagaacgaacgcacucuagacuaucaugauuccaauguuaagaaccuguacgagaaagugcgaaaccagcucaagaauaacgccaaggagaucggaaauggcuguuuugaguucuaucacaaaugcgacaacaccuguauggagucugucaagaaugggacauacgauuauccuaaauacagcgaagaggcaaagcugaacagagaaaagaucgacggagugaaacuugagucaaccaggauuuaucaaauccuggccauuuacaguacugucgcuuccagcuuggugcucauaguuucucugggugcgaucucauuuuggaugugcaguaauggcagcuuacagugccggauuuguaucuga

SEQ ID NO: 131599 - RNA, 1701 nt, Artificial Sequence
  derived and/or modified sequence opt3 from hemagglutinin__InfluenzaA__AFN19915
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuuccucauauauaaacgauaagggcaaggaaguacugguucuuuggggcauccaucaccccagcacgagugcugaccagcagucuuuguaccagaaugccgaugcguacguguucgucgggacuuccgaguauagcaaaaaguuuaaaccugagauugcagugcgcccaaaggugcgagaccaagaaggacguaugaacuacuauuggacccuggucgagcccggugauaaaaucacauucgaagccacuggcaaccuacucguuccuagauacgcuuuugccauggagaggaaugcagggucgggaauuaucauaucugacaccccagugcacgauugcaacacaaccugucagacgccgaagggcgcuauuaauacuucccugcccuuccagaacauccauccuauuacaaucgguaaaugcccaaaguauguaaagucaaccaaacuucggcuggccacuggguugcgcaaugugcccaguauccagagcagaggacucuuuggcgcgauugccggcuucauagaagggggauggacagguauggucgacggcugguacggguaucaccaucaaaacgcacagggauccggcuacgcugccgaccugaagucuacccagaaugcuaucgauaaaauuacgaacaaggugaauagcguuaucgagaaaaugaacacccaguuuacagccguggguaaggaguucaaucacuuagaaaagaggauagagaaccugaauaaaaaggucgacgauggguuccucgacauuuggacuuacaacgcagaacuucugguguugcuagagaaugaacggacccuggauuaucacgacucaaacguuaaaaaccucuacgagaagguacgcagucaacugaaaaauaacgccaaggagaucggcaauggauguuuugaguucuaucauaagugcgauaacacauguauggaguccgugaaaaauggcacuuacgacuauccuaaguacagcgaagaggcuaaacuuaaccgagaagagaucgauggggucaagcuggagucuaccagaauuuaucagaucuuggcgauuuacucaacaguggcaaguagccucguccuggugguuuccuuaggagccauaucuuuuuggaugugcucgaaugguagccugcagugcaggaucuguauuuga

SEQ ID NO: 131600 - RNA, 1701 nt, Artificial Sequence
  derived and/or modified sequence opt3 from hemagglutinin__InfluenzaA__AFN19922
augaaggccauccugguggucguucucuacaccuucgcuacagcaaacgccgacacucuuugcauuggcuaucacgcgaauaacagcacggauaccguggacacaguacuggagaaaaaugugacugucacccauuccgugaacuuguuagaagauaagcacaaugggaaacuguguaagcuaagaggaguugcuccccuccaucuggguaaaugcaacauagccggcuggauccuugggaauccugagugugaaucucugucaacagcaaguagcugguccuacauuguggagaccucuucgucagacaacggaacuugcuauccaggcgauuuuaucgacuacgaagaguugagggagcagcucagcagugucuccucuuucgaacgguuugagauuuucccgaagacaagcuccuggcccaaucacgauucaaacaagggugugaccgccgcuuguccucaugcaggggccaaaggauuuuauaagaaucugaucuggcugguuaaaaagggcaacaguuacccaaaacucagccgcucuuauauaaaugacaagggcaaggaaguauuagugcugugggggauccaccaccccuccacgacugcugaucaacagucacuuuaccagaacgccgacaccuacgucuucgugggaacaagccgauauaguaaaaaguuuaaaccugagauugcgauccguccaaaggugagagaucaggaggguaggaugaauuacuauuggacuuuggucgaacccggcgacaaaauuaccuucgaggcaacagggaaccugguugugccucgguacgccuuugcuauggaacgcaacgccggaucuggcaucauaauuuccgauaccccagcacaagacugcaauacgacuugucagacaccgaagggugcuaucaacaccagccuacccuuccagaauauucauccuaucacuaucgggaaaugcccaaaguauguaaagucgacaaaacucagacuggccaccggacuuaggaacgugcccucuauucagucccggggccuguuuggcgcgauagccggguucaucgagggagguuggacgggcauggucgacgggugguacggauaucaccaucaaaaugaacagggcucagguuacgcagcugauuugaagaguacccagaacgccauugacaaaaucacaaauaaggugaacagcguuauagagaaaaugaauacucaguuuaccgcuguggggaaggaguucaaccaccucgaaaagcgcauugagaaucugaacaaaaaggucgaugacggcuucuuagauaucuggacauacaaugccgaacugcucgugcuucuggagaacgaacgaacuuuggacuaucacgauuccaauguuaaaaaccuauacgagaagguaagaaaccaacugaaaaauaacgcaaaggagaucggaaauggcuguuuugaguucuaucauaagugcgacaacaccuguauggaaucugugaaaaaugggacauacgauuauccuaaguacagcgaagaggccaaacucaacagggaagagauugacggagucaagcuggagucaacccggaucuaucagauucuugcuauauacaguacuguggcguccagccuggucuuggugguuucucucggugcaaucucauuuuggaugugcaguaauggcagccugcagugccguauuuguaucuga

SEQ ID NO: 131601 - RNA, 1701 nt, Artificial Sequence; identical to SEQ ID NO: 128470
  derived and/or modified sequence opt3 from hemagglutinin__InfluenzaA__AFN19931

SEQ ID NO: 131602 - RNA, 1701 nt, Artificial Sequence
  derived and/or modified sequence opt3 from hemagglutinin__InfluenzaA__AFN19941
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauuaauuacgaggagcucagggagcagcugucaagcgugaguuccuucgaacgguuugagaucuucccgaagacaucuagcuggcccaaccacgacuccaauaagggugucaccgccgcuuguccucaagcaggggccaaaucauuuuauaagaaccugauauggcucgugaaaaagggaaauaguuacccaaaauuaagcaagucuuauaucaacgauaagggcaaagaaguacugguucuuuggggcauucaucaccccuccacgucagcugaccagcagagcuuguaccagaaugccgaugcguacguguucgucgggacuuccaaguauucuaaaaaguuuaaaccugagaucgcagugcgcccaaaggugcgagaccaagagggacguaugaacuacuauuggacccuggucgaacccggugauaaaauuacauucgaggccacuggcaaccuacucguuccuagauacgcuuuugccauggaaaggaaugcaggguccggaaucauaauuagcgacaccccagugcacgauugcaacacaaccugucagacgccgaagggcgcuaucaauacuucgcugcccuuccagaacauucauccuaucacaaucgguaagugcccaaaauauguaaagucuaccaaacuucggcuggccacuggguugcgcaaugugcccuccauucagucaagaggacucuuuggcgcgauagccggcuucaucgaagggggauggacagguauggucgacggcugguacggguaucaccaucaaaacgcacagggaaguggcuacgcugccgaccugaaaagcacccagaaugcuauugauaaaaucacgaacaaggugaauaguguuauagaaaagaugaacacccaguuuacagccguggguaaagaguucaaucacuuagagaagaggauugaaaaccugaauaaaaaggucgacgauggguuccucgacaucuggacuuacaacgcagagcuucugguguugcuagaaaaugagcggacccuggauuaucacgacucuaacguaaagaaccucuacgaaaagguucgcagccaacugaagaauaacgccaaagagaucggcaauggauguuuugaguucuaucauaagugcgauaacacauguauggaaucagugaaaaauggcacuuacgacuauccuaaguacagugaggaagcuaaacuuaaccgagaggaaauugauggggucaagcuggaguccaccagaaucuaucagauuuuggcgauauacagcacaguggcaucuucacucguccuggugguuaguuuaggagccaucagcuuuuggaugugcuccaaugguucucugcagugcaggauuuguaucuga

SEQ ID NO: 131603 - RNA, 1701 nt, Artificial Sequence
  derived and/or modified sequence opt3 from hemagglutinin__InfluenzaA__AFN19951
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccggugacaagauuaccuucgaggcaacaggcaaccuagucguuccuagguacgccuuugcuauggaacggaacgccggguccggaaucauaauuagcgauaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgacggcugguacggguaucaucaccagaaugaacaaggaaguggcuacgccgcagaucucaaaagcacccagaacgcuauugacaagaucacaaauaaagugaacuccguuauagagaagaugaauacucaguuuaccgccguggguaaggaguucaaccaccuggaaaaacggauugagaauuuaaacaagaaagucgaugacggguuccuggauaucuggacauacaaugcugaacuccuugugcuguuggagaacgaacgcacucuagacuaucaugauucuaauguaaagaaccuguacgagaaaguucgaaaccagcucaagaauaacgccaaggagaccggcaauggauguuuugaguucuaucacaaaugcgacaacacauguauggaaagcgugaagaauggcaccuacgauuauccuaaauacucagaagaggcaaagcugaacagagaagagaucgacggggucaaacuugagaguacuaggauuuaucaaauccuggccauuuacuccacggcugcgagcucuuuggugcucgucgugucacugggagcaauaaguuuuuggaugugcagcaaugguuccuuacagugccggaucuguauuuga

SEQ ID NO: 131604 - RNA, 1701 nt, Artificial Sequence; identical to SEQ ID NO: 128831
  derived and/or modified sequence opt3 from hemagglutinin__InfluenzaA__AFN19966

SEQ ID NO: 131605 - RNA, 1701 nt, Artificial Sequence
  derived and/or modified sequence opt3 from hemagglutinin__InfluenzaA__AFN19972
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacaaugaggagcucagggagcagcugagcaguguguccucuuucgaacgguuugagauuuucccgaagacaagcuccuggcccaaccacgauucaaauaagggugucaccgccgcuuguccucaugcaggggccaaaaguuuuuacaagaaccugaucuggcucgugaaaaagggaaauagcuauccaaaauuaucuaaguccuacauaaacgacaagggcaaagaaguacugguucuuuggggcauccaccaccccucaacgacugcugaucaacagagcuuguaucagaaugccgacaccuacguguucgucgggacaagucgcuacucuaagaaauuuaagccugagauugcgauccgaccaaaagugcgugaucaggagggaagaaugaacuauuacuggacucugguggaacccggugacaagauuaccuucgaggcaacaggcaaccuagucguuccuagguaugccuuugcuauggaacggaaugccggguccggaaucauaauuagcgauaccccagugcaugacugcaacacgacuugucaaacaccgaaaggcgcaaucaauaccucgcuccccuuccagaacauucacccuaucacuaucgguaagugcccaaaguacguaaaaucuacaaagcugcgccuugcuaccgggcugagaaaugugcccuccauucagucaaggggauuguuuggcgccauagcgggcuucaucgaagggggauggacggguauggucgacggcugguauggguaccaucaccagaacgaacaaggaaguggcuaugccgcagaucucaaaagcacccagaaugcuauugacaagaucacaaacaaaguuaauuccgugauagagaagaugaacacucaguuuaccgccguggguaaggaguucaaucaccuggaaaaacggauugagaacuuaaauaagaaagucgaugacggguuccuggauaucuggacauacaacgcugaacuccuugugcuguuggagaaugaacgcacucuagacuaccaugauucuaacguaaagaaccuguaugagaaaguucgaaaucagcucaagaacaaugccaaggagaucggcaacggauguuuugaguucuaccacaaaugcgacaauaccuguauggaaagcgugaagaacggcacauaugauuacccuaaauauucagaagaggcaaagcugaauagagaagagauugacggggucaaacuugagaguaccaggguguaccaaauccuggccauuuauuccacugucgcuagcucuuuggugcucguugugucacugggagcgauaaguuuuuggaugugcagcaacgguuccuuacagugccggaucuguauuuga

SEQ ID NO: 131606 - RNA, 1701 nt, Artificial Sequence
  derived and/or modified sequence opt3 from hemagglutinin__InfluenzaA__AFN19978
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggacuuugguggaacccggcgacaagauuaccuucgaggcaacagggaaccuggucguuccuagguacgccuuugcuauggaacggaacgccggaucuggcaucauaauuuccgauaccccagugcaugacugcaauacgacuugucaaacaccgaaaggugcaaucaacaccagccuacccuuccagaauauucacccuaucacuaucgggaagugcccaaaguauguaaaaucgacaaagcuccgccuggcuaccggacuuagaaacgugcccucuauucaguccaggggccuguuuggcgccauagcgggguucaucgagggagguuggacgggcauggucgacgggugguacggauaucaucaccagaaugaacaaggcucagguuacgccgcagauuugaaaaguacccagaacgcuauugacaagaucacaaauaaagugaacagcguuauagagaagaugaauacucaguuuaccgccguggggaaggaguucaaccaccucgaaaaacggauugagaaucugaacaagaaagucgaugacggcuucuuagauaucuggacauacaaugcugaacugcucgugcuucuggagaacgaacgcacuuuggacuaucaugauuccaauguaaagaaccuauacgagaaaguucgaaaccagcugaagaauaacgccaaggagaucggaaauggcuguuuugaguucuaucacaaaugcgacaacaccuguauggaaucugugaagaaugggacauacgauuauccuaaauacagcgaagaggcaaagcucaacagagagaaaauugacggagucaagcuggaaucaaccaggaucuaucaaauucuugccauauacaguacuguggcuuccagccuggucuuggugguuucucucggugcgaucucauuuuggaugugcaguaauggcagccugcagugccggauuuguaucuga

SEQ ID NO: 131607 - RNA, 1701 nt, Artificial Sequence; identical to SEQ ID NO: 128831
  derived and/or modified sequence opt3 from hemagglutinin__InfluenzaA__AFN19983

SEQ ID NO: 131608 - RNA, 1701 nt, Artificial Sequence
  derived and/or modified sequence opt3 from hemagglutinin__InfluenzaA__AFN19993
augaaggccauccuggugguccuccuuuacaccguugcuacaacuaacgcagacacgcugugcauuggcuaucacgccaauaacagcaccgauacaguggacacuguauuggagaaaaaugugaccgucacacauuccgugaacuuacuggaagauaagcacaaugggaaacuauguaagcucagaggaguugcgccccugcaucuugguaaaugcaacauagcuggcuggauccuggggaauccugagugugaaucuuugucaaccgccaguagcugguccuacauuguggagacuucuucgucagacaacggaacaugcuauccaggcgauuucaucgacuacgaggaacucagggagcagcugagcagugucuccucuuuugaacgguucgagauuuuuccgaagaccagcuccuggcccaaucacgauucaaacaagggugugacggcagccuguccucaugcuggggcaaaaggauucuauaagaaucugaucuggcucguuaaaaagggcaacaguuacccaaaauuaagcaagucuuauauaaaugacaagggcaaagaaguacuggugcuuugggggauccaccaccccuccacuaccgccgaucaacagucauuguaccagaacgcugacacauacgucuuugugggaacuagccgcuauaguaagaaauucaagccugagauugccauccgaccaaaagugcgugaucaggaggguagaaugaauuacuauuggacccuggucgaacccggcgacaagauuacauuugaggcgaccgggaaccuaguugugccuagguacgcauucgccauggaacggaacgcuggaucuggcaucauaauuuccgauacgccaguacaugacugcaauacuacaugucaaaccccgaaaggugccaucaacacuagccuccccuuucagaauauucacccuaucacaaucgggaagugcccaaaguaugugaaaucgaccaagcugcgccuugcaacgggacugagaaacguccccucuauucaguccaggggcuuguucggcgcuauagccggguuuaucgagggagguuggaccggcaugguggacgggugguacggauaucaucaccagaaugaacaaggcucagguuacgcggccgaucucaaaaguacacagaacgcaauugacaagaucacuaauaaaguuaacagcgugauagagaagaugaauacccaguucacagcugucgggaaggaguuuaaccaccuggaaaaacggauugagaauuuaaacaagaaaguggaugacggcuuccuggauaucuggacuuacaaugccgaacuccuuguacuguuggagaacgaacgcacccuagacuaucaugauuccaauguuaagaaccuguacgagaaagugcgaaaccagcucaagaauaacgcuaaggagaucggaaauggcuguuucgaauuuuaucacaaaugcgacaacacauguauggagucugucaagaaugggaccuacgauuauccuaaauacagcgaagaggccaagcugaacagagaagagauugacggagugaaacuugagucaacuaggaucuaucaaauucuggcaauauacaguacggucgccuccagcuuggugcucguugugucucugggugcuaucucauucuggaugugcaguaauggcagcuuacagugccggauuuguaucuga

SEQ ID NO: 131609 - RNA, 1701 nt, Artificial Sequence; identical to SEQ ID NO: 128831
  derived and/or modified sequence opt3 from hemagglutinin__InfluenzaA__AFN20000

SEQ ID NO: 131610 - RNA, 1701 nt, Artificial Sequence; identical to SEQ ID NO: 128838
  derived and/or modified sequence opt3 from hemagglutinin__InfluenzaA__AFN20006

SEQ ID NO: 131611 - RNA, 1701 nt, Artificial Sequence; identical to SEQ ID NO: 128470
  derived and/or modified sequence opt3 from hemagglutinin__InfluenzaA__AFN20012

SEQ ID NO: 131612 - RNA, 1701 nt, Artificial Sequence
  derived and/or modified sequence opt3 from hemagglutinin__InfluenzaA__AFN20018
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuaacuccuauauaaaugauaagggcaaggaaguacugguucuuuggggcauccaucaccccucaacgagcgcugaccagcagaguuuguaccagaacgccgaugcguacguguucgucgggacuucuaaauauuccaagaaauuuaagccugagauugcagugcgcccaaaagugcgagaccaagagggacguaugaacuacuauuggacccuggucgaacccggugauaagaucacauucgaggccacuggcaaucuacucguuccuagauacgcuuuugccauggaaaggaacgcagggagcggaauuaucauaucggacaccccagugcacgauugcaauacaaccugucagacgccgaaaggcgcuauuaacacuucucugcccuuccagaauauccauccuauuacaaucgguaagugcccaaaguauguaaaauccaccaaacuucggcuggccacuggguugcgcaacgugcccucaauccagaguagaggacucuuuggcgcgauugccggcuucauagaagggggauggacagguauggucgacggcugguacggguaucaccaucaaaaugcacagggaagcggcuacgcugccgaccugaaguccacccagaacgcuaucgauaagauuacgaauaaagugaacucuguuaucgaaaagaugaauacccaguuuacagccguggguaaggaguucaaccacuuagagaaaaggauagaaaaucugaacaagaaagucgacgauggguuccucgacauuuggacuuacaaugcagagcuucugguguugcuagaaaacgagcggacccuggauuaucacgacagcaacguaaagaaucucuacgaaaaaguucgcucacaacugaagaacaaugccaaggagaucggcaacggauguuuugaguucuaucauaaaugcgauaauacauguauggaaagugugaagaacggcacuuacgacuauccuaaauacuccgaggaagcuaaacuuaaucgagaggaaaucgauggggucaagcuggagagcaccagaauuuaucagaucuuggcgauuuacucuacaguggcaucaagucucguccuggugguuagcuuaggagccauauccuuuuggaugugcucuaacgguucgcugcagugcaggaucuguauuuga

SEQ ID NO: 131613 - RNA, 1701 nt, Artificial Sequence; identical to SEQ ID NO: 128840
  derived and/or modified sequence opt3 from hemagglutinin__InfluenzaA__AFN20019

SEQ ID NO: 131614 - RNA, 1701 nt, Artificial Sequence; identical to SEQ ID NO: 128470
  derived and/or modified sequence opt3 from hemagglutinin__InfluenzaA__AFN20021

SEQ ID NO: 131615 - RNA, 1701 nt, Artificial Sequence; identical to SEQ ID NO: 128840
  derived and/or modified sequence opt3 from hemagglutinin__InfluenzaA__AFN20034

SEQ ID NO: 131616 - RNA, 1701 nt, Artificial Sequence; identical to SEQ ID NO: 128831
  derived and/or modified sequence opt3 from hemagglutinin__InfluenzaA__AFN20040

SEQ ID NO: 131617 - RNA, 1701 nt, Artificial Sequence; identical to SEQ ID NO: 131603
  derived and/or modified sequence opt3 from hemagglutinin__InfluenzaA__AFN20046

SEQ ID NO: 131618 - RNA, 1701 nt, Artificial Sequence; identical to SEQ ID NO: 128840
  derived and/or modified sequence opt3 from hemagglutinin__InfluenzaA__AFN20052

SEQ ID NO: 131619 - RNA, 1701 nt, Artificial Sequence; identical to SEQ ID NO: 128840
  derived and/or modified sequence opt3 from hemagglutinin__InfluenzaA__AFN20061

SEQ ID NO: 131620 - RNA, 1701 nt, Artificial Sequence
  derived and/or modified sequence opt3 from hemagglutinin__InfluenzaA__AFN20076
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugacugugagucuuugucaacagcaaguagcugguccuacauuguugaaaccucuucgucagauaacggaacuugcuauccaggcgacuuuaucgauuacgaggaacucagggagcagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgacugcugaccaacagagcuuguaccagaacgccgauaccuacguguucgucgggacaagucgcuauucuaagaaauuuaagccugaaauugcgauccgaccaaaagugcgugaccaggagggaagaaugaauuacuauuggacucugguggagcccggugauaagauuaccuucgaagcaacaggcaaccuagucguuccuagguacgccuuugcuauggagcggaacgccggguccggaaucauaauuagcgacaccccagugcaugacugcaauacgacuugucaaacaccgaaaggcgcaaucaacaccucgcuccccuuccagaauauucacccuaucacuaucgguaagugcccaaaguauguaaaaucuacaaagcugcgccuugcuaccgggcugagaaacgugcccuccauucagucaaggggauuguuuggcgccauagcgggcuucaucgaagggggauggacggguauggucgauggcugguacggguaucaucaccagaaugagcaaggaaguggcuacgccgcagaccucaaaagcacccagaacgcuauugauaagaucacaaauaaagugaacuccguuauagaaaagaugaauacucaguuuaccgccguggguaaggaguucaaccaccuggagaaacggauugaaaauuuaaacaagaaagucgacgauggguuccuggacaucuggacauacaaugcugagcuccuugugcuguuggaaaacgagcgcacucuagauuaucaugacucuaauguaaagaaccuguacgaaaaaguucgaaaccagcucaagaauaacgccaaggagaccggcaauggauguuuugaguucuaucacaaaugcgauaacacauguauggaaagcgugaagaauggcaccuacgacuauccuaaauacucagaggaagcaaagcugaacagagaggaaaucgauggggucaaacuugagaguacuaggauuuaucaaauccuggccauuuacuccacgguggcuagcucuuugguccucgugguuucacugggagcgauaaguuuuuggaugugcagcaaugguuccuuacagugccggaucuguauuuga

SEQ ID NO: 131621 - RNA, 1701 nt, Artificial Sequence
  derived and/or modified sequence opt3 from hemagglutinin__InfluenzaA__AFN20081
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaguugagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaaauaucuaaguccuauaucaaugacaagggcaaagaaguauuaguucuguggggcauucaccaccccucaacgacugcugaucaacagagccuuuaccagaacgccgacaccuacguguucgucgggacaagucgcuauucuaagaaauuuaagccugagaucgcgauucgaccaaaagugcgugaucaggagggaagaaugaauuacuauuggacuuugguggaacccggugacaagaucaccuucgaggcaacaggcaaccuggucauaccuagguacgccuuugcuauggaacggaacgccggguccggaauuaucauuagcgauaccccaguucaugacugcaauacgacuugucaaacaccgaaaggcgcaaucaacaccucgcuacccuuccagaauauccacccuauuacuauaggucgcugcccaaaguaugugaagucuacaaaacucagacuggcuaccgggcuuaggaacguacccuccauccagucacggggacuguuuggcgccauugcgggcuucaucgaagggggauggacggguaugguggacggcugguacggguaucaucaccagaaugaacaaggaaguggcuacgccgcagaucucaagagcacccagaacgcuauagacaaaauuacaaauaaggucaacuccgugaucgagaaaaugaauacucaguuuaccgccguugguaaggaguucaaccaccucgaaaagcgcaucgagaaucugaacaaaaagguggaugacggguucuuagauauuuggacauacaaugcugaacugcucguccuucuggagaacgaacgaacuuuggacuaucaugauucuaaugugaaaaaccuauacgagaagguaagaaaccagcugaaaaauaacgccaaggagaccggcaauggauguuuugaguucuaucacaagugcgacaacacauguauggagagcguuaaaaauggcaccuacgauuauccuaaguacucagaagaggcaaaacucaacagggaagugaucgacggggucaagcuggagaguacucggauuuaucaaauacuugccaucuacuccacgguggcuagcucucuggucuuggugguuucacucggagcgauuaguuuuuggaugugcagcaaugguucccugcagugccguaucuguaucuga

SEQ ID NO: 131622 - RNA, 1701 nt, Artificial Sequence; identical to SEQ ID NO: 128840
  derived and/or modified sequence opt3 from hemagglutinin__InfluenzaA__AFN20092

SEQ ID NO: 131623 - RNA, 1701 nt, Artificial Sequence; identical to SEQ ID NO: 131602
  derived and/or modified sequence opt3 from hemagglutinin__InfluenzaA__AFN20099

SEQ ID NO: 131624 - RNA, 1701 nt, Artificial Sequence
  derived and/or modified sequence opt3 from hemagglutinin__InfluenzaA__AFN20112
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugaguguaagucuuugucaacagcaaguagcugguccuacauuguugaaaccucuucgucagacaacggaacuugcuauccaggcgauuuuaucgacuacgaggaacucagggagcagcugagcaguguguccucuuucgagcgguuugaaauuuucccgaagacaagcuccuggcccaaucacaacccuaauaaaggugucaccgccgcuuguccacaugcaggggccaagucauuuuauaaaaaccugaucuggcucgugaagaauggaaacaguuaccccaaauuaaauacgagcuauauaaacgauaagggcaaggagguacugguucuuuggggcauccaccacccuucuacuuccgcugaccaacagucauuguaccagaacgccgaugcguacgcauucguggggaccagccgcuauaguaaaaaguuuaaaccagaaauugccauccgacccaagguccgugaccaggagggaagaaugaauuacuauuggacacugguggagccuggugauaaaauuacuuucgaagcuaccggcaaccuaguggucccaagguacgccuuugcaauggagcggaaugcugggucuggaaucauaauuuccgacacaagcguucaugauugcaacaccacgugucaaacuccgaagggcgccaucaauacaucgcuccccuuccagaacgugcacccuauuaccaucgguaaaugcccaaaguauguaaagucuacuaaacugcgccuugcgacagggcugagaaaugugcccuccauccagucaaggggauuguuuggcgccauugcaggcuucauagaagggggauggaccgguauggucgacggcugguacggguaucaucaccagaacgagcaaggaaguggcuacgcugccgaccucaagagcacgcagaaugcuuuugauaaaaucaccaacaagguaaauuccguuauugaaaagaugaacacacaguucacugccguggguaaggaguucaaucaccuggagaagcggaucgaaaacuuaaauaaaaaggucgacgauggguuucuggacauauggaccuacaacgcagagcuccuugugcuguuggaaaacgagcgcacacuagauuaucaugacucuaaugugaaaaaccuguacgaaaagguucgaagccagcucaaaacuaaugccaaggagauuggcaacggauguuucgaguuuuaucacaagugcgauaauaccuguauggaaucagugaaaaacggcacauacgacuauccuaaguacagugaggaagcuaaacugaauagagaggaaaucgauggggucaaacuugaguccaccaggaucuaucaaauucuggcgaucuacagcacuguggcaucuucauugguccucgugguuagucugggagccauuagcuucuggaugugcuccaacgguucuuuacagugccggauauguaucuga

SEQ ID NO: 131625 - RNA, 1701 nt, Artificial Sequence
  derived and/or modified sequence opt3 from hemagglutinin__InfluenzaA__AFN87924
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggaacucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcacgucuuauauaaaugacaagcgcaaggaaguacugguucuuuggggcauccaccacccuuccacuucagcugaucaacagagcuuguaccagaacgccgacgcguacgcauucgugggcaccagucgauauucuaaaaaguuuaaaccagagauugccauccgucccaaggucagagaucaggaggggaggaugaauuacuauuggacacugguggaaccuggagacaaaauuacuuucgaggcuaccgguaaccuaguggucccacgguacgccuuugcaauggaacgcaacgcuggcuccgggaucauaauuagcgauacaucgguucaugacugcaauaccacgugucaaacuccgaagggagccaucaacacaucucuccccuuccagaaugugcacccuauuaccaucggcaaaugcccaaaguauguaaaguccacuaaacugagacuugcgacaggucugaggaacgugcccucaauccagagucggggguuguuuggagccauugcaggcuucauagagggcggguggaccggaauggucgacgguugguacggcuaucaucaccagaaugaacaagggagcggauacgcugccgaucucaaguccacgcagaacgcuuuugacaaaaucaccaauaaggugaacucuguuauugagaaaaugaauacacaguucacugccgugggcaaggaguucaaccaccuggaaaagcgcaucgagaauuuaaacaaaaaggucgaugacgguuuucuggauauauggaccuacaaugcagaacuccuugugcuguuggagaacgaacgaacacuagacuaucaugauagcaauguaaagaaccuguacgagaagguuagaucacagcucaaaaacaaugccaaggagauugggaacggcuguuucgaauuuuaucacaagugcgacaauacuuguauggagagugugaaaaacggaaccuacgauuauccuaaguacuccgaagaggcuaaacugaauagggaagagaucgacggcgucaaacuugagagcacacggaucuaucaaauucuggcgaucuacucuaccguggcaucaaguuugguccucgugguuagccugggggccauuuccuucuggaugugcucuaacggaucguuacagugccguauauguaucuga

SEQ ID NO: 131626 - RNA, 1701 nt, Artificial Sequence; identical to SEQ ID NO: 124685
  derived and/or modified sequence opt3 from hemagglutinin__InfluenzaA__AFN87926

SEQ ID NO: 131627 - RNA, 1701 nt, Artificial Sequence
  derived and/or modified sequence opt3 from hemagglutinin__InfluenzaA__AFN87927
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagcgcaaagaaguacugguucuuuggggcauccaccaccccucaacgagcgcugaucaacagaguuuguaccagaacgccgacgcguacguguucgucggcacuucucgauauuccaagaaauuuaagccugagauugcaauccguccaaaagugagagaucaggaggggaggaugaauuacuauuggacccugguggaacccggagacaagauuacauucgaggccacugguaaccuagucguuccucgguacgcuuuugccauggaacgcaacgcaggcagcgggaucauaauuucgggaaccccagugcaugauugcaauacaaccugucaaacgccgaaaggcgcuaucaacacuucucuccccuuccagaauauucacccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaccucaaauccacccagaacgccauugauaagaucacgaaucgcgugaacucuguuauagagaaaaugaauacccaguuuacagcuguggguaaggaguucaaccaccuggaaaagcgaauugagaauuuaaacaaaaaggucgacgauggguuccuggacaucuggacuuacaaugccgaacuccuugugcuguuggagaacgaaagaacccuagauuaucaugacagcaauguaaagaaccuguacgagaagguuaggucacagcucaaaaacaaugcaaaggagaucggcaacggauguuuugaguucuaucacaagugcgauaauacauguauggaaagugugaaaaacggcacuuacgacuauccuaaguacuccgaagaggccaaacugaaucgggaagagauugauggggucaaacuugagagcacccguaucuaucaaauucuggcuauauacucuacaguggcgucaaguuugguccucgugguuagccugggagcaaucuccuuuuggaugugcucuaacgguucguuacagugccgcauuuguaucuga

SEQ ID NO: 131628 - RNA, 1701 nt, Artificial Sequence
  derived and/or modified sequence opt3 from hemagglutinin__InfluenzaA__AFN87928
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugauagagagggaaggaugaauuacuauuggacccugguggaacccggugacaagauuacauucgaggccacuggcaaccuagucguuccucgguacgcuuuugccauggaacgcaacgcagggagcggaaucauaauuucggauaccccagugcaugacugcaauacaaccugucagacgccgaaaggcgcuaucaacacuucucuccccuuccaaaauauucacccuaucacaaucgguaagugcccaaaguauguaaaauccaccaagcugagacuugccacugggcugaggaacgugcccucaauucagagucggggauuguuuggcgcgauagccggcuucaucgaagggggauggacagguauggucgacggcugguacggguaucaucaccagaaugaacagggaagcggcuacgcagcugaucucaaauccacccaaaacgccauugacaagaucacgaauaaagugaacucuguuauagagaagaugaauacccaguuuacagcuguggguaaggaguucaaccaccuggaaaaacgcauugagaauuuaaacaagaaagucgaugacggguuccuggauaucuggacuuacaaugccgaacuccuugugcuguuggagaacgaacgaacccuagacuaucaugauagcaauguaaagaaccuguacgagaaaguuagaucacagcucaagaacaaugcaaaggagaucggcaacggauguuuugaguucuaucacaaaugcgacaauacauguauggaaagugugaagaacggcacuuacgauuauccuaaauacuccgaagaggccaagcugaauagggaagagauugacggggucaaacuugagagcacccggaucuaucagauucuggcuauauacucuacaguggcgucaaguuugguccucgcagugagccugggagccaucuccuuuuggaugugcucuaacgguucguuacaaugccguauuuguaucuga

SEQ ID NO: 131629 - RNA, 1701 nt, Artificial Sequence; identical to SEQ ID NO: 125849
  derived and/or modified sequence opt3 from hemagglutinin__InfluenzaA__AFN87929

SEQ ID NO: 131630 - RNA, 1701 nt, Artificial Sequence; identical to SEQ ID NO: 125849
  derived and/or modified sequence opt3 from hemagglutinin__InfluenzaA__AFN87930

SEQ ID NO: 131631 - RNA, 1701 nt, Artificial Sequence
  derived and/or modified sequence opt3 from hemagglutinin__InfluenzaA__AFN87931
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagagaagcacaaugggaaacuauguaagcucagaggaguggcuccccugcaucuugguaaaugcaacauagccggcuggauccuggggaauccugaaugugagucuuugucaacagcaaguagcugguccuacauuguugaaaccucuucgucagauaacggaacuugcuauccaggcgacuuuaucgauuacgaggagcucagggaacagcugagcaguguguccucuuucgagcgguuugaaauuuucccgaagacaagcuccuggcccaaucacgacucaaacaagggugucaccgccgcuuguccucaugcaggggccaaaaguuuuuauaagaaucugaucuggcucgugaaaaagggaaacagcuacccaaaauuaucuaaguccuauauaaaugauaagggcaaagagguacugguucuuuggggcauccaccaccccucaacgagcgcugaccaacagaguauuuaccagaacgccgaugcguacguguucgucgggacuucucgcuauuccaagaaauuuaagccugagaucgcaauucgaccaaaagugcgugaccaggaaggaagaaugaauuacuauuggaccuugguggagcccggugauaagaucacauucgaagccacuggcaaccuggucguuccuagguacgcuuuuaccauggagcggaacgccgggagcggaauaauuaucucggacacaccagugcaugauugcaauaccacgugucaaacuccgaaaggcgcaauuaacacaucucuacccuuccagaauauccacccuaucaccauugguaagugcccaaaguauguaaaauccacuaagcuccgccuggcuacagggcuuagaaacgugcccucaauacagaguaggggacuguuuggcgccaucgcgggcuucauugaagggggauggaccgguauggucgacggcugguacggguaucaucaccagaaugagcaaggaagcggcuacgccgcagacuugaaauccacgcagaacgcuaucgauaagauaaccaauaaagugaacucuguuauugagaagaugaauacacaguuuacugccguggguaaggaguucaaccaccucgaaaaacggaucgaaaaucugaacaagaaagucgacgauggguucuuagacaucuggaccuacaaugcugagcugcucgugcuucuggaaaacgagcgcacauuggauuaucaugacagcaauguaaagaaccuauacgagaaaguucgaucacagcugaagaacaaugccaaggaaauuggcaacggauguuuugaguucuaucacaaaugcgauaauacuuguauggaaagugugaagaacggcaccuacgacuauccuaaauacuccgaggaagcaaagcucaauagagaggagaucgauggggucaaacuggaaagcacaaggauuuaucaaauacuugccaucuacucuaccguggcuucaagucuggucuuggugguuagccucggagcgauuuccuuuuggaugugcucuaacgguucgcugcagugccggaucuguaucuga

SEQ ID NO: 131632 - RNA, 1701 nt, Artificial Sequence
  derived and/or modified sequence opt3 from hemagglutinin__InfluenzaA__AFN87932
auggaggccauccuggugguccuccuuuacaccuucgcuacagcaaacgccgacacucugugcauuggcuaucacgcgaauaacagcacggauaccguugacacaguguuggaaaagaauguaacugugacccauuccgucaacuuacuggaggauaaacacaaugggaagcuauguaaacucagaggaguggcuccccugcaucuugguaagugcaacauagccggcuggauccuggggaauccugaaugugagucuuugucaacagcaaguagcugguccuacauuguugaaaccucuucgucagacaacggaacuugcuauccaggcgauuuuaucgacuacgaggagcucagggaacagcugagcaguguguccucuuucgagcgguuugaaauuuucccgaaaacaagcuccuggcccaaucacgauucaaacaagggugucaccgccgcuuguccucaugcaggggccaagaguuuuuauaaaaaucugaucuggcucgugaagaaaggaaacagcuacccaaaguuaucuaaauccuauauaaaugacaagggcaaggagguacugguucuuuggggcauccaccaccccucaacgagcgcugaucaacagaguuuguaccagaacgccgacgcguacguguucgucgggucuucccgcuauagcaaaaaguuuaaaccugagauugcaauccgaccaaaggugcgugauagagaaggaaggaugaauuacuauuggacucugguggagcccggugacaaaauuaccuucgaagccacaggcaaccuagucguuccucgguacgcuuuugccauggagcgcaacgcagggucgggaaucauaauuucugauacuccagugcaugacugcaauaccacaugucagaccccgaagggcgcuaucaacacgucccuccccuuccacaauauucauccuaucacuaucgguaaaugcccaaaguauguaaagucaacaaaacugagacuugccaccgggcugaggaacgugcccaguauucaaagccggggauuguuuggcgcgauagccggcuucaucgaagggggauggacugguauggucgacggcugguacggguaucaccaccagaaugagcagggauccggcuacgcagcugaucucaagucuacacagaacgccauugacgagaucaccaauaaagugaacagcguuauagaaaagaugaauacgcaauuuaccgcuguggguaaagaguucaaccaucuggaaaagcgcauugagaauuuaaacaagaaagucgaugacggguuccuggauaucuggacauacaaugccgaacuccuugugcuguuggagaacgagcgaacucuagacuaucacgauucaaauguaaagaaccuguacgaaaaaguuagaagucagcucaagaacaaugcaaaagagaucggcaacggauguuuugaguucuaucauaagugcgacaauaccuguauggaauccgugaagaacggcacauacgauuauccuaaauacagcgaagaggccaagcugaauagggaggaaauugacggggucaaacuugagucuacucggaucuaucagauucuggcuauauacucaaccguggcgaguagcuugguccucgugguuucccugggagcaaucucuuuuuggaugugcucgaacgguagcuuacagugccguauuuguaucuga

SEQ ID NO: 131633 - RNA, 1701 nt, Artificial Sequence; identical to SEQ ID NO: 125849
  derived and/or modified sequence opt3 from hemagglutinin__InfluenzaA__AFN87933

SEQ ID NO: 131634 - RNA, 1701 nt, Artificial Sequence
  derived and/or modified sequence opt3 from hemagglutinin__InfluenzaA__AFN87934
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccagcuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcaacucagcaguguguccucuuucgaacgguuugagauuuucccgaagacaagcuccuggcccaaucaugauucaaacaagggugucaccgccgcuuguccucacgcaggggccaaaggauuuuauaagaaucugaucuggcuggugaaaaagggcaacaguuacccaaaacucagcaagucuuauauaaaugacaagggcaaagaaguauuaguucugugggggauccaucaccccuccacgucagcugaucagcagagccuuuaccagaacgccgacacuuacguguucgucggaaccagucgcuauucuaagaaauuuaagccugagauugcgauccgaccaaaagugcgugaucaagaggguagaaugaauuacuauuggacauugguggaacccggcgacaagauuacuuucgaggcaaccgggaaccuggucguuccuagguacgccuuugcuauggaacggaacgccggauccggcaucauaauuagcgauacaccagugcacgacugcaauaccacgugucagacuccgaaaggugcaaucaacacaucgcuacccuuccagaauauucauccuaucaccaucgggaagugcccaaaguauguaaaaucuacuaagcuccgccuggcuacaggacuuagaaacgugcccuccauucagucaaggggccuguuuggcgccauagcgggguucaucgagggagguuggaccggcauggucgacgggugguacggauaucaccaucaaaaugaacagggcagugguuacgccgcagauuugaaaagcacgcagaacgcuauugacaagaucaccaauaaagugaacuccguuauagagaagaugaauacacaguuuacugccguggggaaggaguucaaccaccucgaaaaacggauugagaaucugaacaagaaagucgaugacggcuucuuagauaucuggaccuacaaugcugaacugcucgugcuucuggagaacgaacgcacauuggacuaucacgauucuaauguaaagaaccuauacgagaaaguucgaagccaacugaagaacaaugccaaggagaucggaaacggcuguuuugaguucuaucauaaaugcgacaauacuuguauggaaucagugaagaacgggaccuacgauuauccuaaauacagugaagaggcaaagcucaauagagaagagauugacggagucaaacuggaguccacaaggaucuaucagauucuugccauauacagcaccguggcuucuucacuggucuuggugguuagucucggugcgaucagcuuuuggaugugcuccaacggcucucugcagugccggauuuguaucuga

SEQ ID NO: 131635 - RNA, 1701 nt, Artificial Sequence
  derived and/or modified sequence opt3 from hemagglutinin__InfluenzaA__AFN87936
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaggagcucagggagcagcugucaagcgugaguuccuucgaacgguuugagaucuucccgaagacaucuagcuggcccaaucacgauccuaacaagggugucaccgccgcuuguccacaugcaggggccaaauccuuuuauaagaaucugauauggcucgugaaaaagggaaacucauaccccaaauuaaguacgagcuauaucaaugacaagggcaaggaaguacugguucuuuggggcauucaccacccuucuacuuccgcugaucaacagucauuguaccagaacgccgacgcguacgcauucguggggaccagccgcuauaguaaaaaguuuaaaccagagaucgccauucgacccaagguccgugaucaggagggaagaaugaauuacuauuggacacugguggaaccuggugacaaaaucacuuucgaggcuaccggcaaccuaguggucccaagguacgccuuugcaauggaacggaacgcugggucuggaauaauuaucuccgauacaagcguucaugacugcaauaccacgugucaaacuccgaagggcgccauuaacacaucgcuccccuuccagaaugugcacccuaucaccaucgguaaaugcccaaaguauguaaagucuacuaaacugcgccuugcgacagggcugagaauugugcccuccauacagucaaggggauuguuuggcgccaucgcaggcuucauugaagggggauggaccgguauggucgacggcugguacggguaucaucaccagaacgaacaaggaaguggcuacgcugccgaucucaagagcacgcagaaugcuuuugacaaaaucaccaacaagguaaauuccguuauagagaaaaugaacacacaguucacugccguggguaaggaguucaaucaccuggaaaagcggauugagaacuuaaauaaaaaggucgaugacggguuucuggauaucuggaccuacaacgcagaacuccuugugcuguuggagaaugaacgcacacuagacuaucaugauucuaacgugaaaaaucuguacgagaagguucgaagccagcucaaaaacaacgccaaggagaucggcaauggauguuucgaauuuuaucacaagugcgacaacacuuguauggagucagugaaaaauggcaccuacgauuauccuaaguacagugaagaggcuaaacugaacagagaagagauugacggggucaaacuugaguccacaaggaucuaucaaauucuggcgauauacagcaccguggcaucuucauugguccucgugguuagucugggagccaucagcuucuggaugugcuccaaugguucuuuacagugccggauuuguaucuga

SEQ ID NO: 131636 - RNA, 1701 nt, Artificial Sequence
  derived and/or modified sequence opt3 from hemagglutinin__InfluenzaA__AFN87938
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgucgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguaaagaaccuguacgagaagguucgaaaccagcucaaaaauaacgcaaaggaaaucggcaauggauguuuugaguucuaucacaagugcgacaacacauguauggaaucagugaaaaauggcacuuacgauuauccuaaguacagugaggaagccaaacugaacagagaggagauugacggggucaaacuugaauccaccaggaucuaucaaauucuggcuauauacagcacaguggcgucuucauugguccucgugguuagucugggagcaaucagcuuuuggaugugcuccaaugguucuuuacagugccggauuuguaucuga

SEQ ID NO: 131637 - RNA, 1701 nt, Artificial Sequence
  derived and/or modified sequence opt3 from hemagglutinin__InfluenzaA__AFN87939
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcacgucuuauauaaaugacaagggcaaggaaguacugguucuuuggggcauccaccacccuuccacuucagcugaucaacagagcuuguaccagaacgccgacgcguacgcauucguggggaccagucgcuauucuaaaaaguuuaaaccagagauugccauccgacccaagguccgugaucaggagggaagaaugaauuacuauuggacacugguggaaccuggugacaaaauuacuuucgaggcuaccggcaaccuaguggucccaagguacgccuuugcaauggaacggaacgcuggguccggaaucauaauuagcgauacaucgguucaugacugcaauaccacgugucaaacuccgaagggcgccaucaacacaucucuccccuuccagaaugugcacccuauuaccaucgguaaaugcccaaaguauguaaaguccacuaaacugcgccuugcgacagggcugagaaacgugcccucaauccagaguaggggauuguuuggcgccauugcaggcuucauagaagggggauggaccgguauggucgacggcugguacggguaucaucaccagaaugaacaaggaagcggcuacgcugccgaucucaaguccacgcagaacgcuaucgacgagauuaccaauaaagugaacucuguuaucgagaagaugaauacacaguuuacugccguggguaaagaguucaaccaccuggaaaagcggauagaaaauuuaaacaagaaagucgaugacggguuccuggauauuuggaccuacaaugcagagcuccuugugcuguuggaaaacgagcgcacacuagacuaucaugauagcaauguaaagaaccuguacgagaaaguucgaucacagcucaagaacaaugccaaagaaaucggcaacggauguuuugaguucuaucacaagugcgacaauacuuguauggaaagugugaagaacggcaccuacgauuauccuaaauacuccgaggaagcuaagcugaauagagaggagaucgacggggucaaacuugaaagcacaaggauuuaucaaauccuggcgauuuacucuaccguggcaucaaguuugguccucgugguuagccugggagccauauccuuuuggaugugcucuaacgguucguuacagugccggaucuguauuuga

SEQ ID NO: 131638 - RNA, 1701 nt, Artificial Sequence
  derived and/or modified sequence opt3 from hemagglutinin__InfluenzaA__AFN87941
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcaagucuuauauaaaugacaagggcaaagaaguacugguucuuuggggcauccaccacccuuccacgucagcugaucaacagagcuuguaccagaacgccgacgcguacguguucgucgggaccagucgcuauucuaagaaauuuaagccagagauugcaauccgacccaaagugcgugaucaggagggaagaaugaauuacuauuggacucugguggaaccuggugacaagauuacauucgaggccacuggcaaccuagucguuccaagguacgcuuuugccauggaacggaacgcaggguccggaaucauaauuagcgauaccccggugcaugacugcaauacaaccugucaaacgcccaaaggcgcuaucaacacuucgcucccuuuccagaauauucacccaaucacaaucgguaagugccccaaguauguaaaaucuaccaagcugcgccuugccacugggcugagaaacgugccuuccauucagucaaggggauuguuuggcgcgauagccggcuucaucgaagggggauggacagguauggucgacggcugguacggguaucaucaccagaaugaacaaggaaguggcuacgcagcugaucucaaaagcacccagaacgccauugacgagaucacgaauaaggugaacuccguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaaaccagcucaaaaauaacgcaaaggaaaucggcaauggauguuuugaguucuaucacaagugcgacaacacauguauggaaagcgugaaaaauggcacuuacgauuauccaaaguacucagaggaagccaaacugaacagagaggagauugacggggucaaacuugaaaguaccaggaucuaucaaauucuggcuauauacuccacaguggcgagcucuuugguccucgugguuucacugggagcaaucaguuuuuggaugugcagcaaugguuccuuacagugccggauuuguaucuga

SEQ ID NO: 131639 - RNA, 1701 nt, Artificial Sequence
  derived and/or modified sequence opt3 from hemagglutinin__InfluenzaA__AFN87943
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaggagcucagggagcagcugucaagcgugaguuccuucgaacgguuugagaucuucccgaagacaucuagcuggcccaaucacgauccuaacaagggugucaccgccgcuuguccacaugcaggggccaaauccuuuuauaagaaucugauauggcucgugaaaaagggaaacucauaccccaaauuaaguacgagcuauaucaaugacaagggcaaggaaguacugguucuuuggggcauucaccacccuucuacuuccgcugaucaacagucauuguaccagaacgccgacgcguacgcauucguggggaccagccgcuauaguaaaaaguuuaaaccagagaucgccauucgacccaagguccgugaucaggagggaagaaugaauuacuauuggacacugguggaaccuggugacaaaaucacuuucgaggcuaccggcaaccuaguggucccaagguacgccuuugcaauggaacggaacgcugggucuggaauaauuaucuccgauacaagcguucaugacugcaauaccacgugucaaacuccgaagggcgccauuaacacaucgcuccccuuccagaaugugcacccuaucaccaucgguaaaugcccaaaguauguaaagucuacuaaacugcgccuugcgacagggcugagaaacgugcccuccauucagucaaggggauuguuuggcgccauagcaggcuucaucgaagggggauggaccgguauggucgacggcugguacggguaucaucaccagaaugaacaaggaaguggcuacgcugccgaucucaagagcacgcagaacgcuauugacgagaucaccaauaaagugaacuccguuauagagaagaugaauacacaguuuacugccguggguaaagaguucaaccaccuggaaaagcggauugaaaauuuaaacaagaaagucgaugacggguuccuggauaucuggaccuacaaugcagagcuccuugugcuguuggaaaacgagcgcacacuagacuaucaugauucuaauguaaagaaccuguacgagaaaguucgaagccagcucaagaacaaugccaaagaaaucggcaacggauguuuugaguucuaucacaagugcgacaauacuuguauggaaucagugaagaacggcaccuacgauuauccuaaauacagugaggaagcuaagcugaauagagaggagauugacggggucaaacuugaauccacaaggaucuaucaaauucuggcgauauacagcaccguggcaucuucauugguccucgugguuagucugggagccaucagcuuuuggaugugcuccaacgguucuuuacagugccggauuuguaucuga

SEQ ID NO: 131640 - RNA, 1701 nt, Artificial Sequence
  derived and/or modified sequence opt3 from hemagglutinin__InfluenzaA__AFN87945
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacgacgggaaacuauguaagcucagaggaguggcuccccugcaucuugguaaaugcaauauagccggcuggauccuggggaacccugagugugaaucuuugucaacagcaaguagcugguccuacauuguugagaccucuucgucagauaauggaacuugcuauccaggcgacuuuaucgauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgagcgcugaccagcagaguuuguaccagaaugccgaugcguacguguucgucgggacuucucgcuauuccaaaaaguuuaaaccugagauugcaauccgaccaaaggugcgugaccaagagggaagaaugaacuacuauuggacccugguggaacccggugauaaaauuacauucgaggccacuggcaaucuagucguuccuagguacgcuuuugccauggaacggaacgcagggagcggaaucauaauuucggacaccccagugcaugacugcaacacaaccugucagacgccgaagggcgcuaucaauacuucucuccccuuccagaacauucacccuaucacaaucgguaaaugcccaaaguauguaaaguccaccaaacugcgccuugccacugggcugagaaaugugcccucaauucagaguaggggauuguuuggcgcgauagccggcuucaucgaagggggauggacagguauggucgauggcugguacggguaucaucaccaaaacgaacagggaagcggcuacgcagcugaccucaaguccacccagaaugccauugauaaaaucacgaacaagguaaauucuguuauagagaaaaugaacacccaguuuacagcuguggguaaggaguucaaucaccuggaaaagcggauugagaacuuaaauaaaaaggucgacgauggguuccuggacaucuggacuuacaacgccgaacuccuugugcuguuggagaaugaacgcacccuagauuaucaugacagcaacgugaaaaaucuguacgagaagguucgaucacaacucaaaaacaacgcaaaggagaucggcaauggauguuuugaguucuaucacaagugcgauaacacauguauggaaagugugaaaaauggcacuuacgacuauccuaaguacuccgaagaggccaaacugaacagagaagagauugauggggucaaacuugagagcaccaggaucuaucagauucuggcuauauacucuacaguggcgucaaguuugguccucgugguuagccugggagcaaucuccuuuuggaugugcucuaaugguucguuacagugccggauuuguaucuga

SEQ ID NO: 131641 - RNA, 1701 nt, Artificial Sequence
  derived and/or modified sequence opt3 from hemagglutinin__InfluenzaA__AFN87947
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauccuaacaagggugucaccgccgcuuguccacaugcaggggccaaaucauuuuauaagaaucugaucuggcucgugaaaaagggaaacaguuaccccaaauuaagcacgucuuauauaaaugacaagggcaaggaaguacugguucuuuggggcauccaccacccuuccacuucagcugaucaacagagcuuguaccagaacgccgacgcguacgcauucguggggaccagucgcuauucuaaaaaguuuaaaccagagauugccauccgacccaagguccgugaucaggagggaagaaugaauuacuauuggacacugguggaaccuggugacaaaauuacuuucgaggcuaccggcaaccuaguggucccaagguacgccuuugcaauggaacggaacgcuggguccggaaucauaauuagcgauacaucgguucaugacugcaauaccacgugucaaacuccgaagggcgccaucaacacaucucuccccuuccagaaugugcacccuauuaccaucgguaaaugcccaaaguauguaaaguccacuaaacugcgccuugcgacagggcugagaaacgugcccucaauccagaguaggggauuguuuggcgccauugcaggcuucauagaagggggauggaccgguauggucgacggcugguacggguaucaucaccagaaugaacaaggaagcggcuacgcugccgaucucaaguccacgcagaacgcuuuugacgagaucaccaauaaagugaacucuguuauugagaagaugaauacacaguucacugccguggguaaagaguucaaccaccuggaaaagcggaucgaaaauuuaaacaagaaagucgaugacggguuucuggauauauggaccuacaaugcagagcuccuugugcuguuggaaaacgagcgcacacuagacuaucaugauagcaauguaaagaaccuguacgagaaaguucgaucacagcucaagaacaaugccaaagaaauuggcaacggauguuucgaguuuuaucacaagugcgacaauacuuguauggaaagugugaagaacggcaccuacgauuauccuaaauacuccgaggaagcuaagcugaauagagaggagaucgacggggucaaacuugaaagcacaaggaucuaucaaauucuggcgaucuacucuaccguggcaucaaguuugguccucgugguuagccugggagccauuuccuucuggaugugcucuaacgguucguuacagugccggauauguaucuga

SEQ ID NO: 131642 - RNA, 1701 nt, Artificial Sequence
  derived and/or modified sequence opt3 from hemagglutinin__InfluenzaA__AFN87949
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgucagcugaucaacagagccuuuaccagaacgccgacacuuacguguucgucggaaccagucgcuauucuaagaaauuuaagccugagauugcgauccgaccaaaagugcgugaucaggaggguagaaugaauuacuauuggacauugguggaacccggcgacaagauuacuuucgaggcaaccgggaaccuggucguuccuagguacgccuuugcuauggaacggaacgccggauccggcaucauaauuagcgauacaccagugcaugacugcaauaccacgugucaaacuccgaaaggugcaaucaacacaucgcuacccuuccagaauauucacccuaucaccaucgggaagugcccaaaguauguaaaaucuacuaagcuccgccuggcuacaggacuuagaaacgugcccuccauucagucaaggggccuguuuggcgccauagcgggguucaucgagggagguuggaccggcauggucgacgggugguacggauaucaucaccagaaugaacaaggcagugguuacgccgcagauuugaaaagcacgcagaacgcuauugacaagaucaccaauaaagugaacuccguuauagagaagaugaauacacaguuuacugccguggggaaggaguucaaccaccucgaaaaacggauugagaaucugaacaagaaagucgaugacggcuucuuagauaucuggaccuacaaugcugaacugcucgugcuucuggagaacgaacgcacauuggacuaucaugauucuaauguaaagaaccuauacgagaaaguucgaagccagcugaagaacaaugccaaggagaucggaaacggcuguuuugaguucuaucacaaaugcgacaauacuuguauggaaucagugaagaacgggaccuacgauuauccuaaauacagugaagaggcaaagcucaauagagaagagauugacggagucaaacuggaguccacaaggaucuaucaaauucuugccauauacagcaccguggcuucuucacuggucuuggugguuagucucggugcgaucagcuuuuggaugugcuccaacggcucucugcagugccggauuuguaucuga

SEQ ID NO: 131643 - RNA, 1701 nt, Artificial Sequence; identical to SEQ ID NO: 128956
  derived and/or modified sequence opt3 from hemagglutinin__InfluenzaA__AFN87951

SEQ ID NO: 131644 - RNA, 1701 nt, Artificial Sequence
  derived and/or modified sequence opt3 from hemagglutinin__InfluenzaA__AFN87953
augaaggccauccuggugguccuccuuuacaccuucgcuacagcaaacgccgacacucugugcauuggcuaucacgcgaauaacagcacggauaccguugacacaguguuggagaaaaauguaacugugacccauuccgcuaacuuacuggaagauaagcacaaugggaaacuauguaagcucagaggagucgcaccccugcaucuugguaaaugcaacauagccggcuggauccuggggaauccugagugugaaucuuugucaacagccaguagcugguccuacauuguggagaccucuucgucagacaacggaacuugcuauccaggcgauuuuaucgacuacgaggagcucagggagcagcugagcaguguuuccucuuucgaacgguuugagauuuucccgaagacaagcuccuggcccaaucacgaucugaacaagggugugaccgcugcauguccucaugccggggcuaaaucauuuuauaagaaucucaucugguuagucaaaaagggaaacaguuacccaaaacugagcaagucuuauauaaaugacaagggcaaagaagugcuuguauuguggggcauccaccaccccuccacgucagccgaucaacagagccuguaccagaacgcggacgcauacguuuucguggggaccagucgcuauucuaagaaauuuaagccugagauugccauccgaccaaaaguccgugaucaggagggaagaaugaauuacuauuggacucuaguggaacccggugacaagauuacauucgaggcuacuggcaaccucguggucccuagguacgccuuugcaauggaacggaacgcuggguccggaaucauaauuagcgauaccccaguucaugacugcaauacaaccugucaaacgccgaaaggcgccaucaacacuucgcugcccuuccagaauauucacccuaucacaaucgguaagugcccaaaguaugugaaaucuaccaagcugcgccuugcgacuggguugagaaacguacccuccauucagucaaggggacucuuuggcgccauagcaggcuucaucgaagggggauggacagguaugguggacggcugguacggguaucaucaccagaaugaacaaggaaguggcuacgcugccgaucugaaaagcacccagaacgcuauugacgagaucacgaauaaggucaacuccgugauagagaaaaugaauacccaguuuacagccguugguaaggaguucaaccacuuagaaaagcggauugaaaaucugaacaaaaagguggaugacggguuccucgauaucuggacuuacaaugcagagcuucuggucuugcuagaaaacgagcgcacccuggacuaucaugauucuaaugugaaaaaccucuacgagaagguacgaagccagcugaaaaacaaugccaaggaaaucggcaacggauguuuugaguucuaucacaagugcgacaauacauguauggaaucaguuaaaaacggcacuuacgauuauccuaaguacagugaggaagcuaaacuuaauagagaggagauugacggggugaagcuggaauccaccaggaucuaucaaauuuuggcgauauacagcacagucgcaucuucacucgugcuggucgugaguuuaggagccaucagcuuuuggaugugcuccaacgguucucugcagugccggauuuguaucuga

SEQ ID NO: 131645 - RNA, 1701 nt, Artificial Sequence
  derived and/or modified sequence opt3 from hemagglutinin__InfluenzaA__AFN87955
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgacugcugaucaacagucacuuuaccagaacgccgacaccuacguguucgucggaacaagccgcuauaguaagaaauuuaagccugagauugcgauccgaccaaaagugcgugaucaggaggguagaaugaauuacuauuggacuuugguggaacccggcgacaagauuaccuucgaggcaacagggaaccuggucguuccuagguacgccuuugcuauggaacggaacgccggaucuggcaucauaauuuccgauaccccagugcaugacugcaauacgacuugucaaacaccgaaaggugcaaucaacaccagccuacccuuccagaauauucacccuaucacuaucgggaagugcccaaaguauguaaaaucgacaaagcuccgccuggcuaccggacuuagaaacgugcccucuauucaguccaggggccuguuuggcgccauagcgggguucaucgagggagguuggacgggcauggucgacgggugguacggauaucaucaccagaaugaacaaggcucagguuacgccgcagauuugaaaaguacccagaacgcuauugacgagaucacaaauaaggugaacagcguuauagagaaaaugaauacucaguuuaccgccguggggaaggaguucaaccaccucgaaaagcggauugaaaaucugaacaaaaaggucgaugacggcuucuuagauaucuggacauacaaugcugagcugcucgugcuucuggaaaacgagcgcacuuuggacuaucaugauuccaauguuaaaaaccuauacgagaagguacgaucucagcugaaaaacaaugccaaggaaaucggaaacggcuguuuugaguucuaucacaagugcgacaauaccuguauggaaagcgugaaaaacgggacauacgauuauccuaaguacucagaggaagcaaaacucaauagagaggagauugacggagucaagcuggaaaguaccaggaucuaucaaauucuugccauauacuccacuguggcuagcucucuggucuuggugguuucacucggugcgaucaguuuuuggaugugcagcaacggcucccugcagugccggauuuguaucuga

SEQ ID NO: 131646 - RNA, 1701 nt, Artificial Sequence
  derived and/or modified sequence opt3 from hemagglutinin__InfluenzaA__AFN87957
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauugacuacgaggagcucagggagcagcugucaagcgugaguuccuucgaacgguuugagaucuucccgaagacaucuagcuggcccaaucacgauccuaacaagggugucaccgccgcuuguccacaugcaggggccaaauccuuuuauaagaaucugauauggcucgugaaaaagggaaacucauaccccaaauuaaguacgagcuauaucaaugacaagggcaaggaaguacugguucuuuggggcauucaccacccuucuacuuccgcugaucaacagucauuguaccagaacgccgacgcguacgcauucguggggaccagccgcuauaguaaaaaguuuaaaccagagaucgccauucgacccaagguccgugaucaggagggaagaaugaauuacuauuggacacugguggaaccuggugacaaaaucacuuucgaggcuaccggcaaccuaguggucccaagguacgccuuugcaauggaacggaacgcugggucuggaauaauuaucuccgauacaagcguucaugacugcaauaccacgugucaaacuccgaagggcgccauuaacacaucgcuccccuuccagaaugugcacccuaucaccaucgguaaaugcccaaaguauguaaagucuacuaaacugcgccuugcgacagggcugagaaacgugcccuccauucagucaaggggauuguuuggcgccauagcaggcuucaucgaagggggauggaccgguauggucgacggcugguacggguaucaucaccagaaugaacaaggaaguggcuacgcugccgaucucaagagcacgcagaacgcuuuugacgagauuaccaauaaagugaacuccguuaucgagaagaugaauacacaguucacugccguggguaaagaguucaaccaccuggaaaagcggauagaaaauuuaaacaagaaagucgaugacggguuucuggauauuuggaccuacaaugcagagcuccuugugcuguuggaaaacgagcgcacacuagacuaucaugauucuaauguaaagaaccuguacgagaaaguucgaagccagcucaagaacaaugccaaagaaaucggcaacggauguuucgaguuuuaucacaagugcgacaauaaguguauggaaucagugaaaaacggcacuuacgauuauccuaaguacagugaggaagcuaaacugaauagagaggagaucgacggggucaaacuugaauccaccaggauuuaucaaauccuggcgauuuacagcacaguggcaucuucauugguccucgugguuagucugggagccaucagcuucuggaugugcuccaacgguucuuuacagugccggauauguauuuga

SEQ ID NO: 131647 - RNA, 1701 nt, Artificial Sequence
  derived and/or modified sequence opt3 from hemagglutinin__InfluenzaA__AFN87959
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauauaaaugacaagggcaaagaaguauuaguucugugggggauccaccaccccuccacgucagcugaucaacagagccuuuaccagaacgccgacacuuacguguucgucggaaccagucgcuauucuaagaaauuuaagccugagauugcgauccgaccaaaagugcgugaucaggaggguagaaugaauuacuauuggacauugguggaacccggcgacaagauuacuuucgaggcaaccgggaaccuggucguuccuagguacgccuuugcuauggaacggaacgccggauccggcaucauaauuagcgauacaccagugcaugacugcaauaccacgugucaaacuccgaaaggugcaaucaacacaucgcuacccuuccagaauauucacccuaucaccaucgggaagugcccaaaguauguaaaaucuacuaagcuccgccuggcuacaggacuuagaaacgugcccuccauucagucaaggggccuguuuggcgccauagcgggguucaucgagggagguuggaccggcauggucgacgggugguacggauaucaucaccagaaugaacaaggcagugguuacgccgcagauuugaaaagcacgcagaacgcuauugacaagaucaccaauaaagugaacuccguuauagagaagaugaauacacaguuuacugccguggggaaggaguucaaccaccucgaaaaacggauugagaaucugaacaagaaagucgaugacggcuucuuagauaucuggaccuacaaugcugaacugcucgugcuucuggagaacgaacgcacauuggacuaucaugauucuaauguaaagaaccuauacgagaaaguucgaaaccagcugaagaauaacgccaaggagaucggaaauggcuguuuugaguucuaucacaaaugcgacaacacuuguauggaaagcgugaagaaugggaccuacgauuauccuaaauacucagaagaggcaaagcucaacagagaagagauugacggagucaaacuggagaguacaaggaucuaucaaauucuugccauauacuccaccguggcuagcucucuggucuuggugguuucacucggugcgaucaguuuuuggaugugcagcaauggcucccugcagugccggauuuguaucuga

SEQ ID NO: 131648 - RNA, 1701 nt, Artificial Sequence; identical to SEQ ID NO: 125170
  derived and/or modified sequence opt3 from hemagglutinin__InfluenzaA__AFN87961

SEQ ID NO: 131649 - RNA, 1698 nt, Artificial Sequence
  derived and/or modified sequence opt3 from hemagglutinin__InfluenzaA__AFO64802
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacggugaaaaacggauuguaucccaaucugagcaagucuuacguaaacaauaaaggcaaggaaguucuagugcucuggggcguccaucacccuuccaacauccgcgaucagcgagccauauaccacacugagaacgcuuaugugucaguggucagcagucauuacucucguagauucaccccagaaaucgcaaaaaggcccaagguucgggaccaggaggggcgcauuaauuauuacuggacacugcuugaaccuggagauacuaucauuuuugaggccaacgguaaucugaucgcuccaugguaugccuucgcguuguccagaggcuuugggagcggaauaauuaccucgaacgcaccgauggacgagugugaugccaagugccagacaccccaaggcgcuaucaauucuucccucccuuuccagaacgugcacccaguaaccauuggugaaugucccaaauacgugaggucagccaagcugcggauggucacgggguuacgcaauaucccuaguauccagagccgaggacuguuuggcgcaauugcuggcuucauagaagggggauggacugguaugaucgacggcugguauggguaccaucaccagaacgaacaaggauccggcuacgccgcggaucagaaaucuacacagaaugccauuaacgguaucaccaauaaggugaacagcguuauagagaaaaugaauacucaguuuacagcaguggggaaggaguucaacaaacucgagagaaggauggagaaucuuaacaagaaggucgacgauggcuuccuggacauuuggaccuauaacgcugaauugcuagugcugcucgagaaugaacggacgcuggacuuucacgauucaaacguuaaaaaucuuuacgagaagguaaaaagucaacugaagaacaaugccaaagaaaucggaaacggcugcuucgaguuuuaucauaaguguaauaacgagugcauggaauccgugaagaaugggaccuacgacuauccaaaauacagcgaggaaucuaaguugaaccgugagaaaaucgauggagucaagcucgagucaauggguguguaucagauucuggcuaucuacaguacagucgccagcuccuuagugcugcuaguuucucucggcgcaauuucguucuggaugugcagcaaugggucccugcagugucgcauaugcaucuga

SEQ ID NO: 131650 - RNA, 1701 nt, Artificial Sequence
  derived and/or modified sequence opt3 from hemagglutinin__InfluenzaA__AFO64813
augaaggccaaacugcucgugcuucugugcgcuuucaccgcaacagacgccgauacuaucuguauuggcuaccacgcgaacaauagcacggacaccgucgauacaguuuuggagaagaacgugacuguaacccauuccgugaauuuacuggaagacucucacaacgggaaacuaugcagacucaagggaauagcuccccugcagcuugguaauuguucaaucgccggcuggauucuggggaacccugagugcgaaaguuuguuuagcaaaaaguccuggucuuauaucgcagagacaccaaauucggaaaacggaaccuguuacccgggcuauuucgccgauuacgaggagcucagggaacaacugucaagcgucaguuccuuugagcgguucgaaauuuuucccaaggagucuagcuggccuaaucauacugugacaaaagguguuaccgcuuccugcucacacaaggggcgcaguagcuucuaucgaaaccugcucugguuaacggagaaaaauggaucuuacccaaaccuguccaagucauaugugaauaacaaagaaaaggagguccuuguguuguggggcguacaucaccccagcaauauccgugaccagagagcaauauaccacacugaaaacgccuacguuaguguggucucuucccauuauaacaggcgguuuaccccugagaucgcuaagcgcccaaaagugagagaucaggaaggcaggauuaauuacuauuggacacugcuagagcccggggacacuaucauuuucgaggccaacggaaaucucaucgcgccuugguacgcauuugcccugagccgggguuucggcucggggauaauuaccucuaacgcuuccauggaugaaugugacgccaagugccagacaccacaaggagcaaucaauucaagucuuccguuucagaacgugcaccccgucaccauuggcgaguguccuaaauauguucgcagcacgaagcugcgaauggugacugguuugagaaauaucccauccauccagucuaggggacucuucggggcuauugccggcuuuauagaaggcggguggacaggaaugaucgaugguugguacggcuaucaucaccagaacgagcaagggagcggauacgcggccgaccagaaaucaacccagaaugcaauuaacggcaucacuaauaagguaaacagugugauagaaaagaugaauacacaguucaccgcugucgguaaggaguucaacaagcuggagcggcguauggaaaauuuaaacaaaaagguggaugacggguuucuggacauuuggacguacaacgccgagcuccuuguucuguuggaaaaugagcgcacccuagauuuccacgacuccaacgugaaaaaucuguaugaaaaggucaaaagccaacucaagaacaaugcuaaggagaucggcaacggaugcuuugaguucuaccauaaauguaauaacgaaugcauggagucugugaagaauggcacauaugauuaccccaaauauucagaagagaguaagcugaacagagagaaaaucgacgggguaaaacuugaaagcaugggaguuuaccagauucuggccaucuauuccacuguggcaucuucguugguccuccuggugagcuuaggugccauuuccuuuuggaugugcucaaauggcagucugcaguguaggauaugcaucuga

SEQ ID NO: 131651 - RNA, 1701 nt, Artificial Sequence
  derived and/or modified sequence opt3 from hemagglutinin__InfluenzaA__AFO64824
augaaggccauccugcucgugcuucugugcgcuuucaccgcaacagacgccgauacuauuuguauaggcuaccacgcgaacaauagcacggacaccgucgauacaguuuuggagaaaaacgugacuguaacccauuccgugaauuuacuggaagacucucacaacgggaagcuaugcagacucaaaggaaucgcuccccugcagcuugguaauuguucaauugccggcuggauccuggggaacccugagugcgaaaguuuguuuagcaagaaauccuggucuuauauugcagagacaccaaauucggaaaacggaaccuguuacccgggcuauuucgccgauuacgaggagcucagggaacaacugucaagcgucaguuccuuugagcgguucgaaaucuuucccaaggagucuagcuggccuaaucauacugugacaaaggguguuaccgcuuccugcucacacaaagggcgcaguagcuucuaucgaaaccugcucugguuaacggagaagaauggacuguacccaaaccuuucuaaauccuaugugaauaacaaggaaaaagaggucuuggugcuguggggcguacaucaccccucaaauauaggcgaccagcgugcaaucuaccacacugaaaacgccuacguuagcguggucaguucucauuauaacagaagguuuaccccugagauugcuaagcggccaaaggugcgcgggcaggaaggaagaaucaauuacuauuggacacuacucgagcccggugauacuauuaucuucgaggccaacggcaaucugauagcgccuugguacgcauuugcccuuuccaggggguucggaagcggcauuaucaccucgaacgcuucuauggacgaaugugaugccaaaugccagacaccacaaggugcaauuaauuccucacugccguuucagaacgugcaccccgucaccaucggggaguguccuaaguauguucggaguacgaaauugaagauggugacuggacuccgcaauaucccaagcauucagucccgaggccuguucggcgcuauagccggguuuaucgaaggagguuggacaggcaugauugacgggugguacggauaucaucaccagaacgagcaaggcucugguuacgcggccgaucagaaaagcacccagaaugcaaucaacgggauaacuaauaagguaaacucagugauugaaaagaugaauacacaguucaccgcugucggcaaagaguucaacaaguuagagaaaagaauggaaaaucugaacaagaaaguggacgauggauuucucgacaucuggacguacaacgccgagcuucugguuuugcuagaaaaugagaggacccuggacuuccacgauaguaacgugaagaaucucuaugaaaaagucaagaaccaacugaagaauaacgcuaaagagaucggcaaugggugcuuugaguucuaccauaaguguaacaaugaaugcauggaguccgugaaaaacggaacauaugacuaccccaaguauagcgaagagucuaaacuuaaucgggagaagauugaugguguaaagcuggaaucaaugggcguuuaccagaucuuggccauuuauaguacuguggcaagcucccucguccuguuagugucucugggggccauaucguuuuggaugugcagcaacggaucccuacagugucguaucugcauuuga

SEQ ID NO: 131652 - RNA, 1701 nt, Artificial Sequence
  derived and/or modified sequence opt3 from hemagglutinin__InfluenzaA__AFO64835
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaauagcuccccugcagcuugguaauuguucagucgccggcuggauccuggggaacccugagugcgaaaguuuguuuagcaaagaguccuggucuuacauugcagaaacaccagacccggagaauggaaccuguuaucccggcuacuucgccgauuaugaggaacucagggagcaacugucgucagugagcaguuuugaacgguucgagaucuuuccuaaggaguccucuuggccaaaccauacuguuacaaagggugugaccgcuagcugcucccacaaugggaaaucaaguuucuaccgcaaccugcucugguuaacgaagaaaaauggacuguaucccaaccuuagcaagucuuacgucaauaacaaagaaaaggagguguugguacuguggggcguucaucacccuuccaauauuggcgaacagcgagcaaucuaccacacugagaacgccuaugugucagucgugagcagucauuacucucguagauuuaccccagaaauagcuaagaggcccaaagugcgggaccaggaggggcgcaucaacuauuacuggacacuacucgagccuggagauacuauuaucuucgaagccaaugguaaccugauugcgccaugguaugcauuugcccuuuccagaggcuucgggagcggaaucauaaccucgaaugcuucuauggacgagugugaugccaagugccagacaccgcaaggcgcaauuaacuccucacugcccuuucagaauguccacccuguuaccaucggugaauguccaaaauacgugaggaguacgaaguugcggaugguaacugggcuccgcaacauucccagcauccagucccgaggacuguucggcgcuaucgccggcuuuauugaagggggauggacagguaugauagacggcugguauggguaccaucaccagaaugaacaaggaucuggcuacgcggccgaucagaaaagcacccagaacgcaaucaaugguauuacuaacaaggucaauucagugaucgagaaaaugaacacacaguucaccgcuguggggaaggaguucaauaaguuagaaagaaggauggagaaccugaauaaaaagguugacgauggcuuucucgacauauggacguauaacgccgaacuucugguguugcuagagaacgaacggacccuggacuuccacgauaguaaugucaaaaaccucuacgagaaggugaaaaaucaacugaagaacaaugcuaaggagauuggaaacggcugcuuugaguucuaucauaaauguaauaacgagugcauggaauccguaaagaaugggacauacgacuauccuaaauacagcgaggagucuaaacuuaaccgugaaaagaucgauggaguuaagcuggagucaauggguguguaucagaucuuggccauuuacaguacugucgcaagcucccucgugcuguuagucucucugggcgccaucucguuuuggaugugcagcaaugggucccuacagugucgcauuugcauauga

SEQ ID NO: 131653 - RNA, 1701 nt, Artificial Sequence
  derived and/or modified sequence opt3 from hemagglutinin__InfluenzaA__AFO64846
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaauagcuccccugcagcuugguaauuguucagucgccggcuggauccuggggaacccugagugcgaaaguuuguuuacaaaagagagcugguccuacauugcagaaaccccaaauccggagaacggaacuuguuaucccggcuacuucgccgacuaugaggaacucagggagcaacugucuucggugagcucauuugaacgguucgagaucuuuccuaaggagaguuccuggccaaaucauacaguuaccaagggugugacggcuucuugcagccacaacgggaaauccucauucuaccgcaaucugcucugguuaacugaaaagaacggacuguaucccaaucuuaguaaaagcuacgucaacaauaaggagaaagaaguguugguacuguggggcguucaucacccuucuaacaugggcgaucagcgagcaauuuaccacaccgagaacgccuauguguccgucgugucaagccauuacagucguagauuuacaccagaaaucgcuaagaggcccaaggugcgggggcaggagggacgcauaaauuauuacuggacucuacucgagccuggugacaccaucauuuucgaagccaacggcaaucugaucgcgccaagauaugcauuugcccuuucuaggggguucggauccggcauuaucacaagcaacgcuucgauggaugagugugacgccaaaugccagaccccgcaaggugcaauaaauucuucccugcccuuucagaacguccacccuguuacgauuggggaauguccaaaguacgugcggucaacuaaauugcgcaugguaacaggacuccgaaauauccccaguauucagagcagaggccuguucggcgcuaucgccggguuuaucgagggagguuggaccggcaugauugaugggugguauggauaccaucaccagaacgaacaaggcuccgguuacgcggccgaccagaagucuacucagaaugcaauaaacgggaucacaaauaaagugaacagcgucauugagaagaugaauacccaguucacggcugugggcaaagaguucaacaaguuagaaaggcggauggagaaucugaacaagaaaguugaugacggauuucucgauaucuggaccuauaacgccgaacuucugguguugcuagagaaugaacguacacuggacuuccacgacucaaacgucaagaaucucuacgagaaagugaagagucaacugaaaaacaaugcuaaggagauaggcaacgggugcuuugaguucuaucauaaguguaauaacgaaugcauggaauccguuaaaaauggaacuuacgauuauccuaaguacagcgaggagucuaaacuuaaccgcgaaaagauugacgguguaaaacuggagucaaugggcguguaucagaucuuggccaucuacaguaccgucgcaagcucccucgugcuguuagucucucugggggccauuucguuuuggaugugcagcaauggaucccuacaguguagaaucugcauuuga

SEQ ID NO: 131654 - RNA, 1701 nt, Artificial Sequence
  derived and/or modified sequence opt3 from hemagglutinin__InfluenzaA__AFO64857
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucagucgccggcuggauacuggggaacccugagugcgaaaguuuguuuagcaaagaguccuggucuuacaucgcagaaaccccaaauccggagaacggaacuuguuaucccggcuacuucgccgacuaugaggaacucagggagcaacugucgucagugagcaguuuugaacgguucgagauuuuuccuaaggaguccucuuggccaaaucauacaguuaccaagggugugacggcuagcugcucccacaacgggaaaucaaguuucuacaagaaucugcucugguuaacugaaaagaacggacuguaucccaaucuuagcaagucuuacgucaacaauaaagagaaggaaguguugguacuguggggcguucaucacccuuccaacaucggcgaucagcgcgcaauuuaccacaccgagaacgccuaugugucagucgugagcagucauuacucucgacguuuuacaccagaaaucgcuaagagacccaaagugagggggcaggagggacggauaaauuauuacuggacucuacucgagccuggugacaccaucauuuucgaagccaacggcaaucugaucgcgccaugguaugcauuugcccuuucccgcggguucggaagcggcauuaucacaucgaccgcuucuaugggugagugugaugccaagugccagacgccgcaaggggcaauaaacuccucacugcccuuucagaauguccacccuguuacuauuggagaauguccaaaauacgugagaaguacaaaguugaggaugguaaccggccuccggaacauccccagcauucagucccgcggccuguucggggcuaucgccggauuuaucgaggguggcuggacugggaugauugacggaugguauggcuaccaucaccagaaugaacaagguucuggguacgcggccgaucagaaaagcacacagaacgcaauagacggcaucaccaauaaggugaacucagucauugagaaaaugaauacgcaguucaccgcugugggaaaggaguucaacaaguuagaacgaagaauggagaaucugaacaaaaagguugaugacggcuuucucgauaucuggacauauaaugccgaacuucugguguugcuagagaacgggaggacucuggacuuccacgacaguaacgucaaaaaucucuacgaaaaggugaaaaaccaacugaagaauaacgcuaaggagauaggaaaugguugcuuugaguucuaucauaaauguaacaaugaaugcauggaguccguaaagaacggcaccuacgauuauccuaaauacagcgaagagucuaaacuuaaucgggagaaaauugacgggguuaagcuggaaucaaugggaguguaucagaucuuggccaucuacaguacagucgcaagcucccucgugcuguuagucucucugggcgccauuucguuuuggaugugcagcaacgguucccuacagugucguaucugcauuuga

SEQ ID NO: 131655 - RNA, 1701 nt, Artificial Sequence
  derived and/or modified sequence opt3 from hemagglutinin__InfluenzaA__AFO64868
augaaggugaaacugcucguccuucugugcgccuucaccgcuacauacgcagacacuaucuguauuggcuaucacgccaacaauagcacggauaccguugacacaguguuggagaagaacguaacugugacccauuccgucaauuuacuggaagauucucacaacgggaaacuaugcagacucaagggaacagcgccccugcagcuugguaauuguucaguggcuggcuggauacuggggaacccugagugcgaaaguuuguuuagcaaagaguccuggucuuacaucgccgaaaccccaaauccggagaacggaacuuguuaucccggcugcuucgcagacuacgaggaacucagggagcaacugucgucaguuagcaguuuugaacgguucgagauuuuuccuaaggaguccucuuggccaaaucauacagugaccaagggugucacggccagcuguucccacaacgggaaaucaaguuucuauaagaaucugcucugguuaacugaaaagaacggacuguaccccaaucuuagcaagucuuaugugaacaauaaagagaaggaaguauugguucuguggggcgugcaucacccuuccaacauccgcgaucagcgagcuauuuaccacaccgagaacgcauacgucucaguggugagcagucauuauucucguagauuuacaccagaaaucgccaagaggcccaaaguccggggccaggaggggcgcauaaauuacuauuggacucuacucgagccuggagacaccaucauuuucgaagcuaacgguaaucugaucgccccaugguacgcguuugcacuuuccagaggcuucgggagcggaauuaucacaucgaacgccucuaugggcgagugcgaugcuaagugucagaccccgcaaggugccauaaauuccucacugcccuuucagaacguucacccugugacgauuggggaaugcccaaaauauguaaggaguacuaaguugcggauggugacaggacuccgcaauauccccagcauucagucccgaggccuguucggcgcaaucgcuggguuuaucgagggagguuggaccggcaugauugacgggugguacggauaucaucaccagaacgaacaaggcucugguuacgccgcggaucagaaaagcacucagaaugccauagacgggaucacaaacaaggucaauucagugauugagaaaaugaacacccaguucacggcaguuggcaaggaguucaauaaguuagaaagaaggauggagaaccugaauaaaaagguggaugacggauuucucgauaucuggaccuacaacgcugaacuucuggucuugcuagagaacgaacggacacuggacuuccacgacaguaaugugaaaaaccucuaugagaagguuaaaaaucaacugaagaacaaugccaaggagauaggcaacggguguuuugaguucuaccauaaaugcaauaacgaaugcauggaauccguaaagaauggaacuuaugauuacccuaaauauagcgaggagucuaaacuuaaccgugagaaaauugacggugugaagcuggaaucaaugggcgucuaccagaucuuggcuaucuauaguaccguggccagcucccucguccuguuagugucucugggggcaauuucguuuuggauguguagcaauggaucccuacagugccgcaucuguauuuga

SEQ ID NO: 131656 - RNA, 1698 nt, Artificial Sequence
  derived and/or modified sequence opt3 from hemagglutinin__InfluenzaA__AFO64879
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuuuuaaagagagcugguccuacaucguggaaaccccaaauccggagaacggaacuuguuaucccggcuacuucgccgacuaugaggaacugagagagcaacugucuucgguuagcucauuugaaagguucgagauuuuuccuaaggagaguuccuggccaaaucauacagugaccggugucucugcaagcugcucccacaacgggaagucaaguuucuaccggaaucucuuauggcugacggagaaaaacggacuuuaucccaauuugagcaagucuuacgugaacaauaaagagaaggaaguacugguucuauggggcgugcaucacccuuccaacauccgcgaucagcgagccauauaccacacugagaacgcuuaugucucaguggugagcagucauuacucucguagauuuaccccagaaaucgcaaaaaggcccaagguccggggccaggaggggcgcauuaauuauuacuggacacuccuggagccuggagacacuaucauuuucgaagccaacgguaaucuuaucgcuccaugguaugccuuugcgcuguccagaggcuucgggagcggaauaauuaccucgaacgcaccgauggaugagugugacgccaagugccagacaccccaaggcgcuaucaauucuuccuugccuuuucagaacguucacccagugaccauuggugaaugucccaaauacguaaggucagccaagcuccggauggugacggggcugcgcaauaucccuaguauccagagccgaggauuauucggcgcaauugcuggcuuuauagaagggggauggacugguaugaucgauggcugguauggguaccaucaccagaacgaacaaggauccggcuacgccgcggaccagaaaucuacacagaaugccauuaacgguaucaccaauaaggucaacagcgugauagagaaaaugaauacucaguucacagcaguugggaaggaguucaacaaacuggaaagaaggauggagaaucucaacaagaagguggaugacggcuuucuugauauuuggaccuauaacgcugaacuguugguccuacuggagaaugaacggacgcucgacuuccacgacucaaacgugaaaaaucuguacgagaagguaaaaagucaacuuaagaacaaugccaaagagaucggaaacggcugcuuugaguucuaucauaaguguaauaacgaaugcauggaauccguuaagaaugggaccuacgauuauccaaaauacagcgaggagucuaagcugaaccgugagaaaaucgacggagugaaguuggaaucaaugggugucuaucagauucucgcuaucuacaguacaguggccagcucccuggucuuacuggugucucuaggcgcaauuucguuuuggaugugcagcaaugggucccuccagugucgcauaugcaucuga

SEQ ID NO: 131657 - RNA, 1698 nt, Artificial Sequence
  derived and/or modified sequence opt3 from hemagglutinin__InfluenzaA__AFO64890
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacggagaaaaacggacuuuaucccaauuugucuaaguccuacgugaacaauaaagagaaggaaguacugguucuauggggcgugcaucacccuucaaacauccgcgaucagcgagccauauaccacacugagaacgcuuaugucagcguggugaguucucauuacucccguagauucaccccagaaaucgcaaaaaggcccaagguccggggccaggaggggcgcauuaauuauuacuggacacuccuggagccuggagacacuaucauuuuugaagccaacgguaaucuuaucgcuccaugguaugccuucgcgcugagcagaggcuuugggucgggaauaauuaccucuaacgcaccgauggaugagugugacguuaagugccagacaccccaaggcgccaucaauuccucauugccuuuccagaacgugcacccaguaaccauuggugaaugucccaaauacgugaggagugcuaagcuccggauggucacggggcugcgcaauaucccuagcauccagucccgaggauuauuuggcgccauugcaggcuucauagaagggggauggacugguaugaucgauggcugguauggguaccaucaccagaacgaacaaggaucuggcuacgcugccgaccagaaaagcacacagaaugcgauuaacgguaucaccaauaaggugaacucaguuauagagaaaaugaauacucaguuuacagccguggggaaggaguucaacaaacuggaaagaaggauggagaaucucaacaagaaggucgaugacggcuuccuugauauuuggaccuauaacgcagaacuguuggugcuacuggagaaugaacggacgcucgacuuucacgacaguaacguuaaaaaucuguacgagaagguaaaaucccaacuuaagaacaaugcuaaagagaucggaaacggcugcuucgaauuuuaucauaaguguaauaacgagugcauggaaagcgugaagaaugggaccuacgauuauccaaaauacucugaggagucaaagcugaaccgugagaaaaucgacggagucaaguuggaaaguauggguguguaucagauucucgccaucuacagcacagucgcuuccucucugguguuacugguuucgcuaggcgccauuagcuucuggaugugcuccaaugggucacuccagugucgcauaugcaucuga

SEQ ID NO: 131658 - RNA, 1701 nt, Artificial Sequence
  derived and/or modified sequence opt3 from hemagglutinin__InfluenzaA__AFO64901
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaacagcuccccugcagcuugguaauuguucaauagccggcuggauccuggggaacccugagugcgaaaguuuguuuagcaaagaguccuggucuuacauugcagaaaccccaaauccggagaacggaacuuguuaucccggcuacuucgccgacuaugaggaacucagggagcaacugucgucagucagcaguuuugaacgguucgagaucuuuccuaaggaguccucuuggccaaaucauacagugaccaaggguguuacggcuagcugcucccacaacgggaaaucaaguuucuacaagaaucugcucugguuaacugaaaagaacggacuguaucccaaucuuagcaagucuuacgugaacaauaaaaagaaggaggucuuggugcuguggggcguacaucacccuuccaacauuggcgaucagcgcgcaaucuaccacaccgaaaacgccuauguuucaguggucagcagucauuacucucgacguuuuacaccagagauagcuaaaagacccaaggugaggaaucaggaagggcggaucaacuauuacuggacucuacucgagccuggagacaccauuaucuucgaggccaaugguaaccugauugcgccaugguaugcauuugcccuuucccgcggcuucgaaagcgggaucauaacaucgaaugcuucuaugggagagugugaugccaaaugccagaccccgcaaggcgcaauuaacuccucacugcccuuucagaaugugcacccugucacgaucggugaauguccaaaguacguuagaaguacuaaauugaggauggugacagggcuccggaacauucccagcauccagucccgcggacuguucggcgcuaucgccggcuuuauugaagggggauggaccgguaugauagacggcugguauggguaccaucaccagaaugaacaaggaucuggcuacgcggccgaucaaaagagcacucagaacgcaaucaaugguauuacaaacaaaguaaauucaaucauagagaagaugaacacccaguucacggcuguggggaaggaguucaauaaauuagaacgaagaauggagaaccugaacaagaaagucgacgauggcuuucucgacauuuggaccuauaaugccgaacuucugguguugcuagagaacgaaaggacacuggauuuccacgacaguaauguuaagaaccucuacgagaaagugaagaaucagcugaagaacaaugcuaaagagaucggaaacggcugcuuugaguucuaucauaaguguaauaacgagugcauggaauccgucaaaaaugggacuuacgacuauccuaaguacagcaaagagucuaaacuuaaccgggagaagaucgauggagugaaacuggaaucaauggguguauaucagauuuuggccaucuacaguaccguugcaagcucccucgugcuguuagucucucugggcgccauuucguuuuggaugugcagcaaugggucccuacagugucguauaugcaucuga

SEQ ID NO: 131659 - RNA, 1698 nt, Artificial Sequence
  derived and/or modified sequence opt3 from hemagglutinin__InfluenzaA__AFO65016
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaaagucucauuagcaaagaguccuggucuuacaucguggaaaccccaaauccggagaacggaacuuguuaucccggcuacuuugccgacuaugaggaacugagagagcaacugucgucaguuagcaguuucgaaagguuugagauuuucccuaaggaguccucuuggccaaaucauacagugaccggugucagcgcauccugcucacacaacgggaagaguagcuuuuaccggaaucucuuauggcugacgaaaaagaacggacuuuaucccaauuugucuaaauccuacgugaacaauaaggaaaaagagguacugguucuauggggcgugcaucacccuucaaacaucggcgaucagcgcacuauauaccacaccgaaaacgccuaugucagcguggugaguucucauuacucccgacguuucacaccagagaucgcuaagagacccaaggucagggaccaggaagggcggauuaauuauuacuggacucuccuggagccuggagauaccaucauuuuugaggcaaacgguaaucuuaucgccccaugguaugcuuucgcccugagccgcggcuuugggucgggaauaauuacaucuaacgcgccgauggacgaaugugaugcaaaaugccagacgccccaaggcgccaucaauuccucauugccuuuccagaacguucacccaauuaccaucggugagugucccaaguacgugagaagugcuaaacucaggaugguaacugggcugcggaauaucccuagcauucagucccgcggauuauuuggcgccauagcaggcuucaucgaagggggauggacagguaugauugacggcugguauggguaccaucaccagaacgagcaaggaucuggcuacgcugccgaucaaaagagcacccagaaugcgaucaacgguauaacuaauaaagugaacucagucauugaaaagaugaauacacaguuuaccgccguggggaaagaguucaacaaucuggagcgaagaauggaaaaccucaacaagaagguugacgauggcuuccuugacaucuggacguauaaugcagagcuguuggugcuacuggaaaacgagaggacccucgacuuucacgauaguaaugucaaaaaccuguacgaaaaggugaaaucccagcuuaagaauaacgcuaaagagaucggaaauggcugcuucgaguuuuaucauaaguguaacaaugaaugcauggagagcguaaagaacgggacauacgacuauccaaaauacucugaagagucaaagcugaaucgggagaaaauugauggaguuaaguuggaaaguauggguguguaucagauccucgccauuuacagcacugucgcuuccucucugguguuacuggucucgcuaggcgccaucagcuucuggaugugcuccaacgggucacuccagugucguauaugcauuuga

SEQ ID NO: 131660 - RNA, 1698 nt, Artificial Sequence; identical to SEQ ID NO: 124131
  derived and/or modified sequence opt3 from hemagglutinin__InfluenzaA__AFO65027

SEQ ID NO: 131661 - RNA, 1698 nt, Artificial Sequence
  derived and/or modified sequence opt3 from hemagglutinin__InfluenzaA__AFO65038
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuagcucauucgaaagguuugagauuuucccuaaggagaguuccuggccaaaucauacagugaccggugucucugcaagcugcucccacaacgggaagucaaguuuuuaccggaauuuacuguggcuuacgggaaagaacggcuuguaucccaaucugagcaugucuuacgugaacaauaaggaaaaagaggugcuaguucucuggggcgugcaucacccuccaaacaucgggaaccagcgcgcccuguaccacacugaaaaugcuuaugucuccguggugucaagccauuacagucgacguuucacccccgagauagcaaagagaccuaaagucagggaucaggaaggacggaucaacuauuacuggacacuucuggagccaggugacacuauuaucuuugaggccaauggcaacuugauugcuccgugguaugccuucgcgcucucucgcggguuuggauccggcaucauaaccagcaaugcacccauggaugaaugugacgccaagugccagacaccucaaggugcuauuaacucgucucugccauuccagaauguucaccccgugaccaucggggaguguccuaaguacguaagauccgccaaauuaaggauggugacgggacugcggaacauuccaucaauccagagucgcggccucuuuggcgcaaucgcuggguucauugaaggagguuggacuggcauggucgaugggugguauggauaccaucaccagaaugagcaaggcagcgguuacgccgcggaccagaaguccacacagaacgccauaaaugggaucaccaacaaaguaaauucuguuauugaaaagaugaacacucaguuuacagcagugggcaaagaguucaauaaacuugagcgaagaauggaaaaccugaacaaaaaggucgaugacggauucuuggauaucuggaccuauaaugcugagcuacuggugcuccuggaaaacgagaggacgcuugacuuucacgacagcaauguaaagaaccuguacgaaaaaguuaagucacaauugaaaaauaacgccaaggagauaggcaaugggugcuucgaguuuuaucauaaauguaacaaugaaugcauggagagugugaagaacggaaccuacgauuaucccaaguacuccgaagagagcaaacucaaucgggagaagauugacggugucaaacuggaaucuaugggcguguaucagaucuuagcuaucuacucaacagucgccaguagccuggugcuacucguuucccugggggcaauuucuuucuggaugugcucgaacggaagccuucagugucguaucugcauuuga

SEQ ID NO: 131662 - RNA, 1698 nt, Artificial Sequence
  derived and/or modified sequence opt3 from hemagglutinin__InfluenzaA__AFO66136
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgcgcuaugccuucgcgcucucuagaggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagguccgccaaguuacggauggugacgggacugcgcaacauuccaucaauccagagucgaggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagagaaggauggaaaaccugaacaagaaggucgaugacggauucuuggauaucuggaccuauaaugcugagcuacuggugcuccuggaaaacgagcggacgcuugacuuucacgacagcaauguuaaaaaccuguacgaaaagguaaaaucacaauugaagaauaacgccaaagagauaggcaaugggugcuucgaguuuuaucauaaguguaacaaugaaugcauggagagugugaagaacggaaccuacgauuaucccaaauacuccgaagagagcaagcucaaucgugagaaaauugacggugucaagcuggaaucuaugggcguguaucagaucuuagcuaucuacucaacagucgccaguagccuggugcuacucguuucccugggggcaauuucuuucuggaugugcucgaacggaagccuucagugucgcaucugcauuuga

SEQ ID NO: 131663 - RNA, 1701 nt, Artificial Sequence
  derived and/or modified sequence opt3 from hemagglutinin__InfluenzaA__AFO66147
augaaggccaaacugcucgugcuucugugcgcuuucaccacaacuuacgcagacacgaucuguauuggcuaucacgccaacaauagcaccgauacagucgacacuguuuuggagaagaacgugaccguaacacauuccgugaauuuacuggaagauucucacaacgggaaacuaugcagacucaagggaaccgcgccccugcagcuugguaauuguucaauagcuggcuggauccuggggaacccugagugcgaaaguuuguuuagcaaagaguccuggucuuacauugccgaaacuccaaauccgaagaacggaacauguuaucccggcuacuucgcagacuaugaggagcucagggaacaacugucgucagucagcaguuuugagcgguucgaaaucuuuccuaaggauuccucuuggccaaaucauaccgugacgaaagguguuacugccagcugcucccacaacgggaagucaaguuucuacaaaaaucugcucugguuaaccggaaagaacggccuguaucccaaucuuagcaaaucuuacgugaacaagaagggcaaagaggucuuggugcuguggggaguacaucacccuuccaauaugggggaccagcgcgcuauuuaccacaaggagaacgcauauguuucagugcuaagcagucauuacucucgacguuuuacaccagaaaucgccaaaagacccaaggucagggaucaggagggucggauaaacuauuacuggacucuccuggaaccuggcgacaccaucauuuucgaggcuaaugggaaccuuaucgccccaugguaugcguuugcacugucccgcggauucggcagcgguauuaucauaucgaaugccucuaugggggaaugugaugcuaaaugccagacaccgcaaggagccauuaacuccucauugcccuuucagaaugugcacccugugaccaucggcgaguguccaaaguacgucagaaguacgaaacucaggaugguuacuggccugcggaacgugcccagcauucagucccgcggguuauucggagcaaucgcugguuuuaucgagggcggguggacaggaaugauugacggcugguaugguuaccaucaccagaaugaacaagggucuggcuacgccgcggaucaaaagagcacccagaacgccauaaauggaaucacuaacaagguaaauucaauuaucgagaaaaugaacacacaguucaccgcagugggcaaggaguucaauaaacuggaacgaagaauggaaaaccucaauaagaaagucgacgauggguuucuugacauauggacguauaacgcugagcuguuggugcuacuggagaacgaaaggacccucgacuuccacgauaguaauguuaagaaccuguacgagaaggugaaaaaucagcuuaagaacaaugccaaagaaauuggaaacgguugcuuugaguucuaucauaaguguaauaacgaaugcauggaguccgucaaaaauggcacauacgacuauccuaaguacagcaaggagucuaaacugaaccgggaaaagaucgauggggugaaauuggagucaaugggaguauaucagauccucgcuauuuacaguacuguugccagcucccugguguuacuggucucucuaggcgcaaucucguuuuggaugugcagcaaugguucccuccagugucguauuugcauauga

SEQ ID NO: 131664 - RNA, 1698 nt, Artificial Sequence
  derived and/or modified sequence opt3 from hemagglutinin__InfluenzaA__AFO66158
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaaggaagcugguccuacaucguggagaccccaaauccggaaaacggcacuuguuaucccgguuacuuugccgacuaugaggagcugagagaacaacucucuucgguuucaucuuucgagagguuugaaauuuucccuaaggggaguuccuggccaaaucauacagugaccggagucucugcaagcugcucccacaacggcaagucaaguuuuuaccggaauuuacuguggcuuacgggcaaaaacggguuguaucccaaucugagcaugucuuacgugaacaauaaggagaaagagguacuuguucucuggggagugcaucacccuccaaacaucgguaaccagcgcgcccuguaccacacugaaaaugcuuaugucuccguggugucaagccauuacagucgacguuucacccccgagauagcaaagagaccuaaagucagggaucaggaaggccggaucaacuauuacuggacacuucuggagccaggggacacuauuaucuuugaagccaauggaaacuugauugcuccgugguaugccuucgcgcucucucgcggcuuugguuccgggaucauaaccagcaaugcacccaugggagagugugaugccaagugccagacaccucaaggcgcuauuaacucgucucugccauuccagaauguucaccccgugaccaucggcgaguguccuaaguacguaagauccgccaaauuaaggauggugacggggcugcggaacauuccaucaauccagagucgcggacucuuuggugcaaucgcuggcuucauugaagggggauggacuggcauggucgacgguugguauggguaccaucaccagaaugagcaaggcagcggauacgccgcggaucagaaguccacacagaacgccauaaauggcaucaccaacaaagugaauagcguuauugaaaagaugaacacucaguuuacagcaguggggaaagaguucaauaagcuagaacgaagaauggagaaccugaacaaaaaggucgacgauggauucuuggacaucuggaccuauaaugcugagcuacuggugcuccuggaaaacgagaggacgcuugauuuucacgacagcaauguaaagaaccuguacgaaaaaguuaagucacaauugaaaaauaacgccaaggagauagguaauggcugcuucgaauuuuaucauaaauguaacaaugagugcauggagagugugaagaacgggaccuacgacuaucccaaguacuccgaagagagcaaacucaaucgggaaaagauugauggagucaaacuggagucuaugggcguguaucagaucuuagcuaucuacucaacagucgccaguagccuggugcuacucguuucccugggugcaauuucuuucuggaugugcucgaacgggagccuucagugucguaucugcauuuga

SEQ ID NO: 131665 - RNA, 1698 nt, Artificial Sequence
  derived and/or modified sequence opt3 from hemagglutinin__InfluenzaA__AFO66169
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccucuaauccagagaacggaacuuguuauccgggcuacuuuacagacuaugaggaacugagagagcaacucucgucagugagcaguuucgaaagguuugagauuuuccccaaggaguccucuuggccuaaucauaccgucacgggugugagcgcuuccugcucacacaacgggaagaguagcuuuuacaaaaauuuacuguggcuuacuggaaagaacggcuuguauccaaaucugucuaaauccuacgccaacaauaaggaaaaagagguacuuguucucuggggcgugcaucaucccccuaacaucggggaucagcgggcacuguaccacaccgaaaacgccuaugucucaguggugagcagucacuacucucgccgauucacaccagagauagcuaagcgucccaaggucagagaccaggaaggaaggaucaauuauuacuggacucuucuggagccuggugauaccauuaucuuugaggcaaacggcaauuugauugccccacgguaugcuuucgcccucucccgcggguuuggaagcggcaucauaacaucgaacgcgccgauggacgaaugugaugcaaaaugccagacgccccacggugccauuaauucuucccugccuuuccaaaacguucauccagugaccaucggggagugucccaaguacguaagaucagcuaaauuaaggauggugacuggacugcggaauauuccuaguauccagagccgcggccucuuuggcgccaucgcaggguucauugaaggagguuggacaggcauggucgacgggugguauggauaccaccaccagaacgagcagggcuccgguuacgcugccgaucaaaagucuacccagaaugcgauaaacgggaucacuaauaaagugaacagcguuauugaaaagaugaauacacaguuuaccgccgugggcaaagaguucaacaagcuagagcgaagaauggaaaaucugaacaagaaagucgacgauggauucaucgacauauggacguauaacgcagaguugcuagugcugcucgaaaaugagaggacccuggacuuucaugauucaaacguaaagaaucuuuacgaaaaaguuaagagucagcugaaaaacaaugcuaaggagauuggcaacgggugcuucgaguuuuaucacaaguguaaugacgaaugcauggaguccgugaaaaacggaacauacgauuauccaaaguacagcgaagagucuaaauugaaucgggagaagaucgacggugucaaacucgaaucaaugggcguguaucaaauccuggccauuuacaguacugucgcuagcuccuuagugcugcuaguuucucucggggccaucucguucuggaugugcagcaacggaucccugcagugucguauuugcauauga

SEQ ID NO: 131666 - RNA, 1698 nt, Artificial Sequence
  derived and/or modified sequence opt3 from hemagglutinin__InfluenzaA__AFO66180
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuucaucuuucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucggggaucagcgcgcccuguaccacacugagaacgcuuaugucuccguggugucaagccauuacagucgacguuucacccccgaaauagcaaagagaccuaaagucaggaaucaggagggucggaucaacuauuacuggacacuucuggaaccaggcgacacuauuaucuuugaggccaaugggaacuugauugcuccgugguaugccuucgcgcucucucgcggauuuggcuccgguaucauaaccagcaaugcacccaugggggagugugaugccaagugccagacaccucaaggagcuauuaacucgucucugccauuccagaauguucaccccgugaccaucggcgaauguccuaaguacguaagauccgccaaauuaaggauggugacgggccugcggaacauuccaucaauccagagucgcgggcucuuuggagcaaucgcugguuucauugagggcggguggacuggaauggucgacggcugguaugguuaccaucaccagaaugaacaagggagcggcuacgccgcggaucagaaguccacacagaacgccauaaauggaaucaccaacaaagugaauagcguuauugagaagaugaacacucaguuuacagcagugggcaaagaguucaauaagcuagaacgaagaauggagaaccugaacaaaaaggucgacgauggguucuuggacaucuggaccuauaaugcugaacuacuggugcuccuggagaacgaaaggacgcuugauuuucacgacagcaauguaaagaaccuguacgagaaaguuaagucacaauugaaaaauaacgccaaggaaauaggaaaugguugcuucgaguuuuaucauaaauguaacaaugagugcauggaaagugugaagaacggcaccuacgacuaucccaaguacuccgaggaaagcaaacucaaucgggagaagauugauggggucaaacuggagucuaugggaguguaucagaucuuagcuaucuacucaacagucgccaguagccuggugcuacucguuucccugggcgcaauuucuuucuggaugugcucgaacgguagccuucagugucguaucugcauuuga

SEQ ID NO: 131667 - RNA, 1698 nt, Artificial Sequence
  derived and/or modified sequence opt3 from hemagglutinin__InfluenzaA__AFO66191
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugccuccugaagggaauagcgccccuucagcuggguaauuguucagucgcuggcuggaucuuggggaacccugagugcgaacuccugauuaguaaagagagcugguccuacaucguggaaaccccaaauccggagaacggaacuuguuaucccggcuacuuugccgacuaugaggaacugagagagcaacucucuucgguuucaucuuucgaaagguuugagauuuucccuaaggguaguuccuggccaaaucauacagugaccggggucucugcaagcugcucccacaacggaaagucaaguuuuuaccggaauuuacuguggcuuacgggcaaaaacggcuuguaucccaaucugagcaugucuuacgugaacaauaaggagaaagaaguacuuguucucuggggagugcaucacccuccaaacaucgggaaccagcgcgcccuguaccacacugagaaugcuuaugucuccguggugucaagccauuacagucgacguuucacccccgaaauagcaaagagaccuaaagucagggaucaggagggucggaucaacuauuacuggacacuucuggaaccaggcgacacuauuaucuuugaggccaaugggaacuugauugcuccgugguaugccuucgcgcucucucgcggauuuggcuccgguaucauaaccagcaaugcacccauggaugagugugacgccaagugccagacaccucaaggggcuauuaacucgucucugccauuccagaauguucaccccgugaccaucggagaauguccuaaguacguaagauccgccaaauuaaggauggugacgggccugcggaacauuccaucaauccagagucgcggccucuuuggggcaaucgcuggauucauugaggguggcuggacugggauggucgauggaugguauggcuaccaucaccagaaugaacaagguagcggguacgccgcggaccagaaguccacacagaacgccauaaauggcaucaccaacaaagugaauagcguuauugagaagaugaacacucaguuuacagcagugggaaaagaguucaauaagcuagaacgaagaauggagaaccugaacaaaaaggucgaugacggcuucuuggauaucuggaccuauaaugcugaacuacuggugcuccuggagaacgaaaggacgcuugacuuucacgacagcaauguaaagaaccuguacgagaaaguuaagucacaauugaaaaauaacgccaaggaaauagggaauggaugcuucgaguuuuaucauaaauguaacaaugagugcauggaaagugugaagaacgguaccuacgauuaucccaaguacuccgaggaaagcaaacucaaucgggagaagauugacggcgucaaacuggagucuauggggguguaucagaucuuagcuaucuacucaacagucgccaguagccuggugcuacucguuucccugggagcaauuucuuucuggaugugcucgaacggcagccuucagugucguaucugcauuuga

SEQ ID NO: 131668 - RNA, 1698 nt, Artificial Sequence; identical to SEQ ID NO: 122528
  derived and/or modified sequence opt3 from hemagglutinin__InfluenzaA__AFO66202

SEQ ID NO: 131669 - RNA, 1698 nt, Artificial Sequence
  derived and/or modified sequence opt3 from hemagglutinin__InfluenzaA__AFO66213
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggaaagaacggcuuguaucccaaucugagcaagucuuacgcaaacaauaaaaagaaagaagugcuaguucucuggggcgugcaucacccuccaaacaucgggaaccagcgcgcccuguaccacacugagaaugcuuaugucuccguggugucaagccauuacagucgacguuucacccccgaaauagcaaagagaccuaaggucagggaucaggagggacggaucaacuauuacuggacacuucuggaaccaggugacacuauuaucuuugaggccaauggcaacuugauugcuccgcgcuaugccuucgcgcucucuagaggguuuggauccggcaucauaaccagcaaugcacccauggaugagugugacgccaaaugccagacaccucaaggugcuauuaacucgucucugccauuccagaauguucaccccgugaccaucggggaauguccuaaguacguaagguccgccaaauuacggauggugacgggacugcgcaacauuccaucaauccagagucgaggccucuuuggcgcaaucgcuggguucauugagggagguuggacuggcauggucgaugggugguauggauaccaucaccagaaugaacaaggcagcgguuacgccgcggaccagaaguccacacagaacgccauaaaugggaucaccaacaaaguaaauucuguuauugagaagaugaacacucaguuuacagcagugggcaaagaguucaauaaacuugaaagaaggauggagaaccugaacaagaaagucgaugacggauucuuggauaucuggaccuauaaugcugaacuacuggugcuccuggagaacgaacggacgcuugacuuucacgacagcaauguaaagaaccuguacgagaaaguuaagucacaauugaaaaauaacgccaaggaaauaggcaaugggugcuucgaguuuuaucauaaguguaacgaugagugcauggaaagugugaaaaauggaaccuacgacuaucccaaguacuccgaggaaagcaaacucaaccgugagaagauugauggugucaaacuggagucuaugggcguguaucagaucuuagcuaucuacucaacagucgccaguagccuggugcuacucguuucccugggggcaauuucuuucuggaugugcucgaauggaagccuucagugucgcaucugcauuuga

SEQ ID NO: 131670 - RNA, 1698 nt, Artificial Sequence
  derived and/or modified sequence opt3 from hemagglutinin__InfluenzaA__AFO66224
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaccccaaauccggagaacggaacuuguuaucccggcuacuuugcugacuaugaggaacugagagagcaacucucuucggugagcucauucgaaagguuugagauuuucccuaaggagaguuccuggccaaaucauacagucaccggugugucugccagcugcucccacaacgggaagucaaguuuuuaccggaauuuacuguggcuuacgggcaaaaacggauuguaucccaaucugagcaagucuuacgcaaacaauaaagaaaaggaggugcuaguucucuggggcgugcaucacccuccaaacaucgggaaccagcgcgcccuguaccacacugaaaaugcuuaugucuccguggugucaagccauuacagucgacguuucacccccgagauagcaaaaagaccuaaggucagggaucaggaaggacggaucaacuauuacuggacacuucuggagccaggugacacuauuaucuuugaggccaauggcaacuugauugcuccgcgcuaugccuucgcgcucucuagaggguuuggauccggcaucauaaccagcaaugcacccauggaugaaugugacgccaagugccagacaccucaaggugcuauuaacucgucucugccauuccagaauguucaccccgugaccaucggggaguguccuaaauacguaagguccgccaaguuacggauggugacgggacugcgcaacauuccaucaauccagagucgaggccucuuuggcgcaaucgcuggguucauugaaggagguuggacuggcauggucgaugggugguauggauaccaucaccagaaugagcaaggcagcgguuacgccgcggaccagaaauccacacagaacgccauaaaugggaucaccaacaagguaaauucuguuauugaaaagaugaacacucaguuuacagcagugggcaaagaguucaauaaacuugagagaaggauggaaaaccugaacaagaaggucgaugacggauucuuggauaucuggaccuauaaugcugagcuacuggugcuccuggaaaacgagcggacgcuugacuuucacgacagcaauguuaaaaaccuguacgaaaagguaaaaucacaauugaagaauaacgccaaagagauaggcaaugggugcuucgaguuuuaucauaaguguaacgaugaaugcauggagagugugaagaauggaaccuacgacuaucccaaauacuccgaagagagcaagcucaaccgugagaaaauugauggugucaagcuggaaucuaugggcguguaucagaucuuagcuaucuacucaacagucgccaguagccuggugcuacucguuucccugggggcaauuucuuucuggaugugcucgaauggaagccuucagugucgcaucugcauuuga

SEQ ID NO: 131671 - RNA, 1698 nt, Artificial Sequence
  derived and/or modified sequence opt3 from hemagglutinin__InfluenzaA__AFO66235
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggcaaaaacggauuguaccccaaucugagcaagucuuaugcaaacaauaaagaaaaggagguucuaguacucuggggcgugcaccacccuccaaacaucgggguccagcgggcccuguaccauacggaaaacgcuuacguguccguggucucaagccacuauagucgcaaguucacucccgagauagcaaaacgaccuaagguucgugaucaggaaggaagaaucaauuacuauuggacccuucuggagccaggugacacaauuaucuuugaggccaacggcaauuugauugcuccgagguacgccuucgcgcucucucggggguuuggauccggcaucauaaacagcaaugcacccauggaugaaugugacgccaaaugccagacuccucaaggugcuauuaacucgucucugccauuccagaaugugcaucccguaaccaucggggaguguccuaaguaugugcgcuccgccaaauuaagaauggucacaggacugaggaacauuccaucaauccagagucggggccucuuuggcgcaaucgcuggguucauugaaggagguuggaccggcaugguggaugggugguacggauaucaccaccagaaugagcaaggcagcgguuacgccgcggaccagaaguccacgcagaacgccauaaaugggaucacuaacaaaguuaauucugugauugaaaagaugaacacacaguuuaccgcagucggcaaggaguucaauaaacuugagcgccgaauggaaaaccugaacaagaaaguggaugacggauucaucgauauauggacuuacaaugcugaguugcuaguacugcucgaaaacgagagaacacuggacuuucaugacagcaauguuaagaaccuuuaugaaaaagugaagucacaacugaagaauaacgccaaagagauuggcaaugggugcuucgaguuuuaccacaaguguaacgaugaaugcauggagagugucaaaaauggaaccuaugacuaccccaaguauuccgaagagagcaaauugaacagggagaagaucgauggugugaagcucgaaucuaugggcgucuaccagauccuggcuauuuauucaacgguggccaguagcuuaguucugcuagugucccucggggcaaucucuuucuggaugugcucgaauggaagccugcagugucggauuugcauauga

SEQ ID NO: 131672 - RNA, 1698 nt, Artificial Sequence
  derived and/or modified sequence opt3 from hemagglutinin__InfluenzaA__AFO66246
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuaguaaagagagcugguccuacaucguugaaaagccaaauccggagaacggaaccuguuaucccggccauuuugcugacuacgaggaacugagagagcaacucucuucggugagcucauucgaaagguuugagauuuucccuaaggagaguuccuggccaaaucacacugucacaggugugucugccagcugcucccauaacgggaaaucaaguuuuuauaagaauuuacuguggcuuaccggaaagaacggcuuguaccccaaucugagcaagucuuaugcaaacaauaaagaaaaggagguucuaguacucuggggcgugcaccacccuccaaacaucgggaaccagcgggcccuguaccauacggaaaaugcuuacgucuccguggugucaagccacuauagucgcaaguucacucccgagauagcaaaacgaccuaagguccgugaucaggaaggaagaaucaacuacuauuggacccuucuggagccaggugacacaauuaucuuugaggccaauggcaacuugauugcuccgagguacgccuucgcgcucucucggggguuuggauccggcaucauaaauagcaacgcacccauggaugaaugugacgccgagugccagacuccucaaggugcuauuaauucgucucugccauuccagaacguucaucccgugaccaucggggaauguccuaaauauguacgcuccgccaaguuaagaauggugacaggacugaggaauauuccaucaauccagagucggggccucuuuggcgcaaucgcuggguucauugagggagguuggaccggcauggucgaugggugguacggauaucaccaccagaacgaacaaggcagcgguuacgccgcggaccagaaauccacgcagaaugccauaaacgggaucacuaauaaggugaacucuguuauugagaaaaugaauacacaguuuaccgcagugggcaaggaguucaacaaacuugaacgccgaauggagaaccugaauaaaaaggucgaugacggauucaucgauauauggacuuacaacgcugaauugcuagugcugcucgagaaugaaagaacacuggacuuucaugacagcaacguuaaaaaucuuuaugagaagguaaaaucacaacugaagaacaaugccaaggagauuggcaacgggugcuucgaauuuuaccacaaauguaaugaugagugcauggaaagugugaagaacggaaccuaugacuaccccaaauauuccgaggagagcaaguugaauagggagaaaaucgauggugucaagcucgaaucuaugggcguguaccagauccuggcuauuuauucaacggucgccaguagcuuagugcugcuaguuucccucggggcaaucucuuucuggaugugcucgaacggaagccugcagugucggauuugcauauga

SEQ ID NO: 131673 - RNA, 1701 nt, Artificial Sequence
  derived and/or modified sequence opt3 from hemagglutinin__InfluenzaA__AFP33324
augaaggccaaacugcucgugcuucugugcaccuucacagcuacuuacgcagacacgaucuguauuggcuaucacgccaacaauagcaccgauacagucgacacuguuuuggagaagaacgugaccguaacacauuccgugaauuuacuggaagauucucacaacgggaaacuaugcagacucaagggaaccgcgccccugcagcuugguaauuguucaauagcuggcuggauccuggggaacccugagugcgaaaguuuguuuagcaaagaguccuggucuuacauugccgaaacuccaaauccgaagaacggaacauguuaucccggcuacuucgcagacuaugaggagcucagggaacaacugucgucagucagcaguuuugagcgguucgaaaucuuuccuaaggauuccucuuggccaaaucauaccgugacgaaagguguuacugccagcugcucccacaacgggaagucaaguuucuacaaaaaucugcucugguuaaccggaaagaacggccuguaucccaaucuuagcaaaucuuacgugaacaagaagggcaaagaggucuuggugcuguggggaguacaucacccuuccaauaugggggaccagcgcgcuauuuaccacaaggagaacgcauauguuucagugcuaagcagucauuacucucgacguuuuacaccagaaaucgccaaaagacccaaggucagggaucaggagggucggauaaacuauuacuggacucuccuggaaccuggcgacaccaucauuuucgaggcuaaugggaaccuuaucgccccaugguaugcguuugcacugucccgcggauucggcagcgguauuaucauaucgaaugccucuaugggggaaugugaugcuaaaugccagacaccgcaaggagccauuaacuccucauugcccuuucagaaugugcacccugugaccaucggcgaguguccaaaguacgucagaaguacgaaacucaggaugguuacuggccugcggaacgugcccagcauucagucccgcggguuauucggagcaaucgcugguuuuaucgagggcggguggacaggaaugauugacggcugguaugguuaccaucaccagaaugaacaagggucuggcuacgccgcggaucaaaagagcacccagaacgccauaaauggaaucacuaacaagguaaauucaauuaucgagaaaaugaacacacaguucaccgcagugggcaaggaguucaauaaacuggaacgaagaauggaaaaccucaauaagaaagucgacgauggguuucuugacauauggacguauaacgcugagcuguuggugcuacuggagaacgaaaggacccucgacuuccacgauaguaauguuaagaaccuguacgagaaggugaaaacacagcuuaagaauaacgccaaagaaauuggaaaugguugcuuugaguucuaucauaaguguaacaaugaaugcauggaguccgucaaaaacggcacuuacgacuauccuaaguacagcaaggagucuaaacugaaucgggaaaagaucgauggggugaaauuggagucaaugggaguauaucagauccucgcuauuuacaguaccguugccagcucccugguguuacuggucucucuaggcgcaaucucguuuuggaugugcagcaacgguucccuccagugucguauuugcauauga

SEQ ID NO: 131674 - RNA, 1698 nt, Artificial Sequence
  derived and/or modified sequence opt3 from hemagglutinin__InfluenzaA__AFP33325
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaagauucucacaacgggaaacuaugccuccugaagggaauagcgccccuucagcuggguaauuguucaguggccggcuggaucuuggggaacccugagugcgaacuccugauuccaaaagagaguuggagcuacaucguugaaaccccgaaucccgagaacggaacuuguuauccuggcuacuuugcugacuaugaggaacugagagagcaacucuccucugugucgucauucgaaagguuugagauuuucccaaaggagagcaguuggcccucccauacagucaccggugugucugccagcugcucccacaaugggaagucaaguuuuuaccggaacuuacuguggcuuacgggcaaaaauggauuguauccuaaccugagcaagucuuacuccaauaacaaagaaaaggagguucuaguacucuggggcgugcaucacccacccaauaucggggaucagcgcgcacuguaccacacugaaaacgccuaugucucaguggugagcagucauuacucucgacguuucaccccugagauagcuaaaagaccaaaggucaggggacaggaaggucggaucaacuauuacuggacacuucuggagccgggcgacacuauuaucuuugaggcaaaugggaacuugauugcccccugguaugcuuucgcccucucccgcggauuuggcagcgguaucauaaccucgaaugcgccuauggaugaaugugacgcaaagugccagacaccacaaggggccauuaacucuucccugcccuuccagaauguucacccugugaccaucggagaguguccaaaauacguaagaucagcuaaguuaaggauggugacgggccugcggaacauucccaguauccagagccgcggccucuuuggggccaucgcaggauucauugaagguggcuggacugggauggucgauggaugguauggcuaccaucaccagaaugagcaagguuccggguacgcugccgaccagaaaucuacacagaacgcgauaaauggcaucaccaacaaggugaauagcguuauugaaaagaugaacacucaguuuacagccgugggaaaagaguucaauaaacuugagcgaagaauggaaaaccugaauaagaaggucgaugacggcuucuuggauaucuggaccuauaacgcagagcuacuggugcuccuggaaaacgagaggacgcuugacuuucacgacucaaauguuaaaaaccuguacgaaaagguaaaaagucaauugaagaauaacgcuaaagagauagggaauggaugcuucgaguuuuaucauaaguguaacgaugaaugcauggaguccgugaagaaugguaccuacgacuauccgaaauacagcgaagagucuaagcucaaccgggagaaaauugauggcgucaagcuggaaucaauggggguguaucagaucuuagccaucuacaguacagucgcuagcucccuggugcuacucguuucucugggagccauuucguucuggaugugcagcaauggcucccuucagugucguaucugcauuuga

SEQ ID NO: 131675 - RNA, 1701 nt, Artificial Sequence
  derived and/or modified sequence opt3 from hemagglutinin__InfluenzaA__AFQ32573
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuacggugcuuguccuagauaugugaaacaaaacacacugaaacuugccaccgggaugaggaaugucccagaaaagcagacucggggaaucuucggcgcaaucgcuggcuuuauugagaacgggugggaaggaaugguugacgguugguacggcuuccgucaccagaauagugaggggcgcggacaagccgcggaucuuaagagcacacaggccgcaaucgaccagauuaacggcaaauugaacagacucauagguaagaccaaugagaaauuccaucagaucgaaaaggaguuuuccgaaguggaggggaggauucaagaucuggaaaaguauguaggcgacacgaaaaucgauuuauggucuuacaacgcugagcugcucguggcccuugagaaucagcacaccaucgaccugacagauagcgaaaugaacaaguuguucgagaaaacuaagaaacagcuacgggaaaaugcugaggacaugggaaacggcugcuuuaagauuuaucauaagugugauaaugccugcauagggucaauccgaaacggaaccuacgaccacgaugucuaucgcgacgaagcacugaauaacagauuccagauuaaagguguggagcucaagaguggcuacaaagacuggauccuguggauuuccuuugccaucagcugcuuccuucuguguguugcuuugcucggguuuauaaugugggcgugccaaaagggaaauaucagguguaacauuugcaucuga

SEQ ID NO: 131676 - RNA, 1701 nt, Artificial Sequence
  derived and/or modified sequence opt3 from hemagglutinin__InfluenzaA__AFQ37281
augaaggccauccuggugguccuccuuuacaccuucgcuacaacuaacgcagacacgcugugcauuggcuaucacgccaauaacagcaccgauacaguugacacuguguuggagaagaauguaaccgugacacauuccgucaacuuacuggaagauaagcacaaugggaaacuauguaagcucagaggaguggcgccccugcaucuugguaaaugcaacauagcuggcuggauccuggggaauccugagugugaaucuuugucaaccgccaguagcugguccuacauuguugagacuucuucgucagacaacggaacaugcuauccaggcgauuuuaucgacuacgaggagcucagggagcagcugagcaguguguccucuuucgaacgguuugagauuuucccgaagaccagcuccuggcccaaucacgauucaaacaagggugucacggcagccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaccccucaacuagcaccgaucaacagaguuuguaccagaacgccgacgcuuacguguucgucgggacaucucgcuauuccaagaaauuuaagccugagauugccauccgaccaaaagugcgugauagagagggaaggaugaauuacuauuggacucugguggaacccggugacaagauuaccuucgaggcgacaggcaaccuagucguuccucgguacgcauuugccauggaacgcaacgcugggagcggaaucauaauuucggauaccccagcccaugacugcaauacgacuugucagacaccgaaaggcgcaaucaacaccucucuccccuuccaaaaugugcacccuauuacuaucgguaagugcccaaaguauguaaaauccacaaagcugagacuugcuaccgggcugaggaacgugcccucaauccagagucggggauuguuuggcgccauugcgggcuucauagaagggggauggacggguauggucgacggcugguacggguaucaucaccagaaugaacagggaagcggcuacgccgcagaucucaaauccacccaaaacgcuaucgacaagauuacaaauaaagugaacucuguuaucgagaagaugaauacucaguuuaccgccguggguaaggaguucaaccaccuggaaaaacgcauagagaauuuaaacaagaaagucgaugacggguuccuggauauuuggacauacaaugcugaacuccuugugcuguuggagaacgaacgaacucuagacuaucaugauagcaauguaaagaaccuguacgagaaaguuagaucacagcucaagaacaaugccaaggagaucggcaacggauguuuugaguucuaucacaaaugcgacgauaaguguauggaaagugugaaaaauggcaccuacgacuauccuaaguacuccgaagaggcaaaacugaacagggaagagaucgauggggucaaacuugagagcacacggauuuaucagauccuggccauuuacucuaccgcugcgucaaguuuggugcucgucgugagccugggagcaauauccuuuuggaugugcucuaaugguucguuacaaugccguaucuguauuuga

SEQ ID NO: 131677 - RNA, 1707 nt, Artificial Sequence
  derived and/or modified sequence opt3 from hemagglutinin__InfluenzaA__AFQ55689
augaacacccagauccuggcccucauugcuugcaugcuuauaggcgcaaagggggacaaaaucugucugggacaccaugccguggcgaaugguacaaaggucaacacuuugacggagagaggcauugaaguugugaaugcuaccgagacaguagaaacugccaacaccaaaaagaucugcacacaagggaaaaggcccaccgauuuaggacaguguggccugcuagguacucucauugggccuccacagugcgaccaguuccuggaguuugaugcagaccuuaucauagaacggcgcgagggaacagauguguguuacccgggcaaguucaccaaugaggaaagccugcgacaaaucuugcguggcuccgggggaauugacaaggagucuauggguuuuacguauucaggcaucagaacuaacggggccaccagugcuugcaggcggagcggauccucuuucuacgcagaaaugaaauggcuccugucuaauucagauaacgccgcuuuuccccagaugacaaagagcuaucgcaauccuagaaacaaaccagcccugauuaucuggggcguccaccauagugguuccgcgacugagcagaccaagcucuacgggucuggaaauaaauuaauaacagugggcagcuccaaguaucagcaaucauucacccccaguccuggcgcaaggccacagguuaacgggcagagcggacggauugacuuucacuggcugcuuuuggaucccaaugacacggugacuuucacauuuaacggugccuucaucgcuccugaucgcgccucguuuuuccgaggcgaguccauugggguccagucagacgugccacuggauagcggaugugaaggcgacugcuuucauaauggugggaccaucguaaguucucuaccguuccaaaacaucaaccccagaacuguuggcaaguguccuagguacgugaaacagacaucccuccugcuugcaaccggaaugcggaaugucccagagaaccccaaggaccguaaaagccgccacagaaggacgcggggccuguucggggcuauugccggauuuauagaaaaugguugggagggcuugaucgaugggugguauggauuccgacaccagaacgcgcaaggcgaagguaccgccgcagacuacaagucgacacagucugcuauugaucagaucacugggaaacucaaucgccugauagacaagaccaaccagcaauuugaguuaauugauaaugaguucuccgaaaucgagcagcagaucggcaacgugauuaauuggacaagagacucaaugacugaaguguggaguuacaacgccgagcugcucgucgcuauggaaaaucagcauaccaucgaucuugccgacagcgagaugaacaaacuguaugagaggguucggaagcaauugcgcgaaaaugcagaggaagauggaacaggcugcuuugagauuuuccacaagugugacgaucagugcauggaauccauaagaaacaauaccuacgaccauacucaguauagggccgagucucuacagaaccguauccaaauugacccugugaaacugagcucaggguacaaggauaucauccucugguuuaguuucggagcuuccugcuuucugcuucuggcgauugcaauggguuugguauucauauguaucaaaaacggcaauaugcggugcacgauuuguaucuga

SEQ ID NO: 131678 - RNA, 1701 nt, Artificial Sequence; identical to SEQ ID NO: 130202
  derived and/or modified sequence opt3 from hemagglutinin__InfluenzaA__AFR68153

SEQ ID NO: 131679 - RNA, 1701 nt, Artificial Sequence
  derived and/or modified sequence opt3 from hemagglutinin__InfluenzaA__AFR68163
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgcuaacuuacuggaagauaagcacaaugggaaacuauguaagcucagaggagucgcaccccugcaucuugguaaaugcaacauugccggcuggauacuggggaauccugagugugaaaccuugucuacugccucaaguuggagcuacaucguggagacauccucuucggacaacggaaccugcuauccaggcgauuuuauugacuacgaagaacucagggagcagcugucaagcguuaguuccuucgaacgguuugagaucuucccgaagacgucuagcuggcccaaucacgauuccaacaagggugugacugcugcauguccucaugccggggcuaaaggauuuuauaagaaucugauuuggcucgucaaaaagggcaacucauacccaaaauuaaguaagagcuauaucaaugacaagggcaaagaagugcugguacuuugggggauacaccaccccucuaccacagccgaucaacaguccuuguaccagaacgcggacacuuacguuuucgugggaaccucacgcuauagcaagaaauuuaagccugagaucgcaauucgaccaaaaguccgugaucaggaggguagaaugaauuacuauuggacacugguggaacccggcgacaagaucaccuucgaggccacggggaaccuaguggucccuagguacgcuuuugccauggaacgggaugcaggaaguggcauuaucauaucugacacuccaguucaugacugcaacacaaccugucaaacuccgaaaggugcuauuaauacaucccuccccuuccagaacauccacccuauuaccaucgggaagugcccaaaguaugugaaaagcacgaagcugcgccuugccaccggacugagaaauguacccucgauccagucuaggggcuuguuuggcgcgauugccggguucauagagggagguuggacaggcaugguggaugggugguacggauaucaucaccagaacgaacaaggcuccgguuacgcagcugaccucaaaucaacucagaaugccaucgauaagauuaccaacaaagucaauagugugaucgagaagaugaacacacaguuuacugcuguugggaaggaguucaaucaccuggaaaaacggauagagaacuuaaauaagaaaguggacgauggcuuccuggacauuuggaccuacaacgccgaacuccuuguccuguuggagaaugaacgcacacuagauuaucaugacagcaacgugaagaaucuguacgagaaaguacgaaaccagcucaagaacaaugcaaaggagaucggaaacggcuguuuugaguucuaucacaaaugcgauaauaccuguauggaguccguuaagaacgggacuuacgacuauccuaaauacucugaagaggccaagcugaauagagaagagaucgauggagugaaacuugagagcacgaggauuuaucaaauccuggcuauuuacucaacagcggcaaguuccuugguccucguggucagccugggugccauaucuuuuuggaugugcucaaacggcaguuuacagugccggaucuguauuuga

SEQ ID NO: 131680 - RNA, 1701 nt, Artificial Sequence
  derived and/or modified sequence opt3 from hemagglutinin__InfluenzaA__AFR68173
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaggcuucuggccguauuacuguguccaccaagagaucacagcagagcguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaaaacacacugaaacuugccaccgggaugaggaaugugccagagaagcagacucggggaauuuucggcgcuaucgccggcuuuauugaaaacgggugggagggaaugguggaugguugguauggcuuccgucaccaaaauuccgaggggcgcggacaagcagcugaccugaagucuacacaggccgcgauagaucagaucaacggcaaauugaauagacucauugguaagaccaacgaaaaauuccaccagaucgagaaggaauuuagcgaggucgaagggaggauccaagaccuggagaaguacguugaggauacgaaaauugacuuauggucauauaacgccgaacugcucguggcacuugagaaucagcauaccauagaucugacagacagugaaaugaacaaguuguucgagaaaacuaagaaacagcuacgggaaaaugcugaggauaugggcaacggaugcuuuaagaucuaccacaagugugacaaugccugcauuggcuccauccgaaacgggaccuauaaucaugauguauaccgcgacgaggcucugaacaauagauuccagauuaaaggaguggaacucaagagcgguuacaaagacuggauccuguggauaucuuuugccaucucaugcuuccuucugugugucgcauugcucggcuuuauuaugugggccugccaaaaggggaacaucagguguaauauuugcaucuga

SEQ ID NO: 131681 - RNA, 1701 nt, Artificial Sequence; identical to SEQ ID NO: 124685
  derived and/or modified sequence opt3 from hemagglutinin__InfluenzaA__AFR84675

SEQ ID NO: 131682 - RNA, 1701 nt, Artificial Sequence; identical to SEQ ID NO: 125038
  derived and/or modified sequence opt3 from hemagglutinin__InfluenzaA__AFR84685

SEQ ID NO: 131683 - RNA, 1701 nt, Artificial Sequence; identical to SEQ ID NO: 124865
  derived and/or modified sequence opt3 from hemagglutinin__InfluenzaA__AFR84694

SEQ ID NO: 131684 - RNA, 1701 nt, Artificial Sequence; identical to SEQ ID NO: 124672
  derived and/or modified sequence opt3 from hemagglutinin__InfluenzaA__AFR84704

SEQ ID NO: 131685 - RNA, 1701 nt, Artificial Sequence
  derived and/or modified sequence opt3 from hemagglutinin__InfluenzaA__AFR84714
augaaggccauccuggugguccuccuuuacaccuucgcuacagcaaacgccgacacucugugcauuggcuauagagcgaauaacagcacggauaccguugacacaguguuggagaaaaauguaacugugacccacuccgucaacauauuagaagauaagcauaaugggaaacuguguaagcuaaggggaguggcuccccuccaccuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugcgggagcagcucagcaguguguccucuuucgaacgcuuugagaucuucccgaagacaagcuccuggcccaaucaugauucaaacaagggugucaccgccgcuuguccucacgcaggggccaaaaguuuuuauaagaaucugauauggcuggugaaaaagggaaacagcuacccaaaacucucuaaguccuauaucaaugacaagggcaaagaaguauuaguucuguggggcauucaucaccccucaacgagcgcugaucaacagagucuuuaccagaacgccgacgcguacguguucgucgggucuucccgauauagcaagaaauuuaagccugagaucgcaauucguccaaaagugagagaucaggagggaaggaugaauuacuauuggacuuugguggaacccggugacaagaucaccuucgaggccacaggcaaccuggucguuccucgguacgcuuuugccauggaacgcaacgcagggucgggaauaauuaucucugauacuccagugcacgacugcaauaccacaugucaaaccccgaaaggcgcuauuaacacgucccuacccuuccagaauauccauccuaucacuauugguaagugcccaaaguauguaaaaucaacaaagcucagacuggccaccgggcuuaggaacgugcccaguauacagagccggggacuguuuggcgcgaucgccggcuucauugaagggggauggacugguauggucgacggcugguacggguaucaccaucagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgagaagcgcaucgaaaaucugaacaaaaaggucgaugacggguucuuagauaucuggacauacaaugccgagcugcucgugcuucuggaaaacgagcgaacuuuggacuaucacgauucaaauguuaaaaaccuauacgagaagguaagaagucagcugaaaaacaaugcaaaggaaauuggcaacggauguuuugaguucuaucauaagugcgacaauaccuguauggaauccgugaaaaacggcacauacgauuauccuaaguacagcgaggaagccaaacucaauagggaggagaucgacggggucaagcuggaaucuacucggauuuaucaaauacuugcuaucuacucaaccguggcgaguagccuggucuuggugguuucccucggagcaauuucuuuuuggaugugcucgaacgguagccugcagugccguaucuguaucuga

SEQ ID NO: 131686 - RNA, 1701 nt, Artificial Sequence; identical to SEQ ID NO: 124865
  derived and/or modified sequence opt3 from hemagglutinin__InfluenzaA__AFR84724

SEQ ID NO: 131687 - RNA, 1701 nt, Artificial Sequence; identical to SEQ ID NO: 124865
  derived and/or modified sequence opt3 from hemagglutinin__InfluenzaA__AFR84734

SEQ ID NO: 131688 - RNA, 1701 nt, Artificial Sequence; identical to SEQ ID NO: 124865
  derived and/or modified sequence opt3 from hemagglutinin__InfluenzaA__AFR84754

SEQ ID NO: 131689 - RNA, 1701 nt, Artificial Sequence; identical to SEQ ID NO: 124865
  derived and/or modified sequence opt3 from hemagglutinin__InfluenzaA__AFR84764

SEQ ID NO: 131690 - RNA, 1701 nt, Artificial Sequence; identical to SEQ ID NO: 124865
  derived and/or modified sequence opt3 from hemagglutinin__InfluenzaA__AFR84774

SEQ ID NO: 131691 - RNA, 1701 nt, Artificial Sequence
  derived and/or modified sequence opt3 from hemagglutinin__InfluenzaA__AFR84784
augaaggccauccuggugggccuccuuuacaccuucgcuacagcaaacgccgacacucugugcauuggguaucacgcgaauaacagcacggauaccgucgacacaguuuuggagaaaaaugugacuguaacccauuccgugaacauauuagaagauaagcacaauggaaaacuguguaagcuaagaggugucgcuccccuccaucugggcaaaugcaacaucgccggguggauucuuggaaauccugagugugaaucucugucaacagcaaguagcugguccuacaucguggagaccucuucgucagacaacggcacuugcuauccaggugauuuuauugacuacgaagaguugagggagcagcucagcaguguuuccucuuucgaacgguuugagaucuucccgaagacaagcuccuggcccaaucacgauucaaacaagggggugaccgccgcuuguccucaugcaggagccaaaaguuuuuauaagaaucugauauggcuggucaaaaagggcaacagcuacccaaaacucucuaaguccuauaucaaugacaagggcaaagaaguguuaguacugugggggauucaccaccccucaacgagcgcugaucaacagagucuuuaccagaacgccgacgcguacguuuucgugggaucuucccgcuauagcaagaaauuuaagccugagaucgcaauucgaccaaaaguccgugaucaggaggguagaaugaauuacuauuggacuuugguggaacccggcgacaagaucaccuucgaggccacagggaaccugguggucccuagguacgcuuuugccauggaacggaacgcaggaucgggcauaauuaucucugauacuccaguucaugacugcaauaccacaugucaaaccccgaaaggugcuauuaacacgucccuacccuuccagaauauccacccuaucacuauugggaagugcccaaaguaugugaaaucaacaaagcuccgccuggccaccggacuuagaaacguacccaguauacagagcaggggccuguuuggcgcgaucgccggguucauugagggagguuggacuggcaugguggacgggugguacggauaucaucaccagaaugaacaaggcuccgguuacgcagcugauuugaaaucuacacagaacgccaucgacgagauaaccaauaaggucaacagcgugauugagaaaaugaauacgcaguuuaccgcuguugggaaggaguucaaccaccucgaaaagcggaucgaaaaucugaacaaaaagguggaugacggcuucuuagauaucuggacauacaaugccgagcugcucguccuucuggaaaacgagcgcacuuuggacuaucaugauucaaaugugaaaaaccuauacgagaagguacgaagucagcugaaaaacaaugcaaaggaaauuggaaacggcuguuuugaguucuaucacaagugcgacaauaccuguauggaauccguuaaaaacgggacauacgauuauccuaaguacagcgaggaagccaaacucaauagagaggagaucgacggagugaagcuggaaucuacuaggauuuaucaaauacuugcuaucuacucaaccgucgcgaguagccuggcauugguggucucccucggugccauuucuuuuuggaugugcucgaacggcagccugcagugccggaucuguaucuga

SEQ ID NO: 131692 - RNA, 1701 nt, Artificial Sequence; identical to SEQ ID NO: 124865
  derived and/or modified sequence opt3 from hemagglutinin__InfluenzaA__AFR84794

SEQ ID NO: 131693 - RNA, 1701 nt, Artificial Sequence; identical to SEQ ID NO: 124685
  derived and/or modified sequence opt3 from hemagglutinin__InfluenzaA__AFR84804

SEQ ID NO: 131694 - RNA, 1701 nt, Artificial Sequence; identical to SEQ ID NO: 124865
  derived and/or modified sequence opt3 from hemagglutinin__InfluenzaA__AFR84814

SEQ ID NO: 131695 - RNA, 1701 nt, Artificial Sequence; identical to SEQ ID NO: 124685
  derived and/or modified sequence opt3 from hemagglutinin__InfluenzaA__AFR84824

SEQ ID NO: 131696 - RNA, 1701 nt, Artificial Sequence; identical to SEQ ID NO: 124711
  derived and/or modified sequence opt3 from hemagglutinin__InfluenzaA__AFR84834

SEQ ID NO: 131697 - RNA, 1701 nt, Artificial Sequence; identical to SEQ ID NO: 129885
  derived and/or modified sequence opt3 from hemagglutinin__InfluenzaA__AFR84844

SEQ ID NO: 131698 - RNA, 1701 nt, Artificial Sequence; identical to SEQ ID NO: 124927
  derived and/or modified sequence opt3 from hemagglutinin__InfluenzaA__AFR84854

SEQ ID NO: 131699 - RNA, 1701 nt, Artificial Sequence; identical to SEQ ID NO: 124685
  derived and/or modified sequence opt3 from hemagglutinin__InfluenzaA__AFR84864

SEQ ID NO: 131700 - RNA, 1701 nt, Artificial Sequence; identical to SEQ ID NO: 124865
  derived and/or modified sequence opt3 from hemagglutinin__InfluenzaA__AFR84874

SEQ ID NO: 131701 - RNA, 1701 nt, Artificial Sequence; identical to SEQ ID NO: 124672
  derived and/or modified sequence opt3 from hemagglutinin__InfluenzaA__AFR84893

SEQ ID NO: 131702 - RNA, 1701 nt, Artificial Sequence; identical to SEQ ID NO: 124672
  derived and/or modified sequence opt3 from hemagglutinin__InfluenzaA__AFR84903

SEQ ID NO: 131703 - RNA, 1701 nt, Artificial Sequence; identical to SEQ ID NO: 124672
  derived and/or modified sequence opt3 from hemagglutinin__InfluenzaA__AFR84913

SEQ ID NO: 131704 - RNA, 1701 nt, Artificial Sequence; identical to SEQ ID NO: 124672
  derived and/or modified sequence opt3 from hemagglutinin__InfluenzaA__AFR84923

SEQ ID NO: 131705 - RNA, 1689 nt, Artificial Sequence
  derived and/or modified sequence opt3 from hemagglutinin__InfluenzaA__AFV53205
auggccaucauuuaccugauacuccuuuucgcuaccgugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccauagcgggguggcugcuuggaaauccagagugugaccggcuguugcgcguaccggaauggucuuacaucauggagaaagagaacccccgauauucacucugcuacccuggcagucugaaugauuaugaagaacugaagcaucucuuaagcuccgugcgucacuuugaaaaggucaggauucugccaaaagacagauggacucaacauaccacaaccggugauucuaaggcuugugccgugucggggaaacccucauucuuucggaacaugguuuggcuuacuaagaaaggaccugacuacccaguggcaaagggcagcuauaauaacacaaguggcgagcagauguugaucauuuggggaguccaccaccccaucgaugaggccgaacagcgcgagcuguaccagaagguggggaccuacguauccgcuucuacgagcacucuaaauaaaagauccauaccugaaauugcagccaggccagagguuaacggucuccggucacgcauggaguucaguuggacccugcuugacgugugggauacaaucaauuuugagagcacuggcaaccugauugcuccggaguauggguucaagaucucuaaacgaggauccucaggcaucaugaagaccgaagguacauuggggaauugcgagaccaaaugucaaacgccccucggagccauuaacacuacacugccuuuucauaacguccacccauuaaccauaggcgaaugccccaaguacgugaaaagcgagaagcuggugcucgcgacuggccuuagaaaugucccucagaucgaaaguagggggcuguucggagcaauugccgguuuuaucgagggcggguggcagggaaugguugacggcugguaugguuaccaucacucuaacgaucagggguccggcuaugcugccgacaaggagagcacacaaaaagcauucgacgaaauaaccaauaaggugaacucgguaauugagaaaaugaauacgcaguuugaagcugugggaaaggaguucaacaauuuggaaaaacggcuagagaaccugaauaagaagauggaggauggcuuucucgacgucuggaccuacaacgccgaacugcuugugcugauggagaaugaacguacauuggauuuccacgacucuaacguuaaaaaucucuaugagaaggugcgcaugcagcugagagauaacgucaaagaguuagggaauggauguuucgaauuuuaccauaagugcgacgaugaguguaucaacuccgugaaaaacgguacuuacgacuauccaaaguacgaagaggaaucaaagcugaaaaggaaugagaucaagggcguaaaacuaaguagcauggggguuuaucagauucucgcgaucuacgccaccguggcaggaucccugucucuugcuauuaugauggccggcaucagcuucuggaugugcucaaacgguaguuugcaaugccggaucuguauuuga

SEQ ID NO: 131706 - RNA, 1689 nt, Artificial Sequence
  derived and/or modified sequence opt3 from hemagglutinin__InfluenzaA__AFV53216
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacugagaagggcagcaacuauccuguggcaaaagggaguuacaauaacacauccggagagcagaugcuuaucauuugggguguccaccacccaaaugacgaaaccgagcagaggacguuguaucagaacgugggcacuuacguaucuguugggaccagcacacugaauaagcgguccacucccgauaucgccacccgcccuaaggugaacggacaaggcgguagaauggaauuuucauggacacuacucgacaugugggauaccauaaacuucgagaguacggggaaucugauugcuccagaauacggauuuaaaaucagcaagagggggucuuccggcauuaugaaaacugaggggacacuuggaaacugcgagaccaagugucagacuccgcugggugcaaucaauacaaccuugcccuuccauaacguccacccucucacgaucggcgaaugcccaaaauaugugaagucagagaaacugguguuagccaccgggcugcggaaugucccccagauugaaagccgcggacucuuuggcgcuauagccgguuucaucgagggcggcuggcagggaaugguugacggcugguacggguaucaucacaguaacgaucaaggaucugguuacgcggcagacaaggaauccacacagaaggccuuugacggcauuacuaauaaagugaacagcguaaucgagaagaugaauacccaguucgaggcuguggaaaaagaguuuucgaaccuugaacgaagacuggagaauuugaacaagaaaauggaagauggguuccuagacgucuggacauauaaugccgagcugcucgugcugauggagaacgaaaggacucuugauuuccacgacucuaauguuaagaaccuguacgauaaggugcggaugcaguugcgugacaacgucaaagagcucggaaauggcuguuuugaguucuaucauaagugcgaugacgaguguaugaacuccgugaaaaaugguaccuacgauuacccuaaguaugaggaagagucaaaacugaaccgcaaugaaauaaaggggguaaaguuaaguagcaugggcauuuaccaaauccuggcaaucuaugcuacaguugccggaucccuaucucucgcgauuaugauggccggcaucagcuuuuggaugugcucaaacgggagucugcagugcagaauuuguauauga

SEQ ID NO: 131707 - RNA, 1689 nt, Artificial Sequence
  derived and/or modified sequence opt3 from hemagglutinin__InfluenzaA__AFV53227
augaucauuauauaccugauccuccuuuucaccgccgugagaggcgaccagauuugcaucggguaucacgcuaacaauagcacagagaaggucgauacuauucuggaaaggaacguuacggugacccaugcaaaagacaucuuggagaagacacacaauggaaaauuauguaagcugaacgguauacccccucuagaacucggcgauugcuccaucgccggguggcugcuuggaaauccagagugugaccggcuguugcgcguaccggaauggucuuacauuauggagaaagagaacccccgauauucacucugcuacccuggcaguuuuaaugauuaugaggaacugaagcaucugcucagcuccgugaagcacuucgaaaaagucaagaucuuaccaaaagacgguuggacucaacauaagaccgaugggggaucuaaagcgugugcugugucgggcaaggccucauuuuuccguaacaugguuuggcugacaaaggagggccccaauuaccagguggcaaaaagaagcuauaacaauaccaguggggagcagaugcuuauuaucuggggaguccaccacccuaaggacgaagccgagcagauagcuuuguaccaaaaaguggguacuuacguauccgcaucuacaagcacccugaacaagagguccacgccagaaauugccgcucggcccgagguuaauggccuagggucacgcauggaauuuaguuggacucuccuggaugugugggacaccaucaacuucgagagcacaggaaaucuugucgccccugaguauggcuuuaaaauuucuaagagagguuccucagggaucaugaaaacugaaggaacccugggcaacugcgagacaaagugucagaccccauugggcgcgaucaacacgacucucccguuccauaaugugcacccccugacaauuggggaaugcccuaaguacgugaaaagcgagaaguuaguccuggcaaccggacucaggaacguuccacagauagaaagucggggucuuuuuggcgccaucgcuggguucauugagggaggcuggcaggguaugguggaugggugguauggcuaccaucacucuaaugaccaaggauccggcuaugccgcagauaaagagagcacucagaaggcuuuugaccgcaucacaaacaaaguaaauucggugauagaaaagaugaacauucaguucgaggccgucgggaaggaauuuucuaaucuggagaaacgauuggaaaaccuaaauaagaaaauggaggacggauuccuggauguguggaccuacaacgcggagcuccugguucuuauggaaaaugagagaacgcuggacuuccacgauuccaacgugaagaauuuguaugacaaagucaggaugcagcuccgggauaacgugaaggaacuggguaauggcuguuuugaguucuaccauaagugcgacgaugaguguaugaacucaguuaaaaacgggaccuacgacuaucccaaguacgaagaggaaaguaaauuaaagcguaaugagaucaaaggaguaaagcugagcuccaugggcguguaucaaauccuagccauuuacgcaacagucgcugguucucucagccuggccaucaugauugcugggauaucauuuuggaugugcaguaacggcucccuucagugccgcguguguaucuga

SEQ ID NO: 131708 - RNA, 1689 nt, Artificial Sequence
  derived and/or modified sequence opt3 from hemagglutinin__InfluenzaA__AFV53238
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuucgaaaaagucaagauuuuaccaaaagaccguuggacucaacauaccacaaccggugggucuauggcuugugccgugucgggaaagcccucauuuuucagaaacaugguuuggcugacuacaaaaggcccuaauuacccaguggcacagggcagcuauaacaauaccaguggggagcagaugcuuaucauuuggggaguccaccaccccaacgaugaggccgaacagagggcuuuguaccaaaagguggguacguacguauccgcaucuacuagcacccuguauaagcgguccaucccugagauagccgcucgcccaaaaguuaauggccuagggucaagaauggaauuuaguuggacacuccuggacaugugggauacuauuaacuucgagagcaccggaaaucuuguggccccggaauacggcuuuaagaucucuaaaagggguuccucagggauuaugaagacagagggaacccuggagaacugcgaaacgaaaugucagacucccuugggcgcgaucaacacaacccucccuuuccauaauguccacccacugacuaucggcgagugccccaaguaugugaaaagcgaaaaguuagugcuggcaacagggcuccggaacgucccucagauugagagucgcggacuuuuuggugccauagcuggcuucaucgaagggggauggcagggcaugguugacgguugguacggguaucaucacucuaaugaucaaggcuccggauacgccgcagacaaggagagcacccagaaggcuuuugauggcauuacgaacaaaguaaauucggugaucgagaaaaugaacacccaguucgaagccguggggaaggaguuuucuaaucuggaaaaacgauuggagaaccuaaauaagaagauggaagacggauuccuggacgucuggacauauaacgcggagcuccuggugcuuauggagaaugaaagaacucuggauuuccacgacuccaacguuaaaaauuuguacgauaaggugaggaugcagcuccgggacaacgucaaagagcuggguaauggcuguuuugaguucuaccauaagugcgauaacgaguguauggacucagugaaaaacgggaccuaugauuacccaaaguaugaggaagagaguaaguuaaaucguaacgaaauaaaaggaguaaagcugagcuccaugggcguuuaccaaauucuagccaucuaugcaacaguggcugguucucucagccuggccaucaugauggcugggauuucauuuuggaugugcaguaauggcucccuucagugccgcaucuguauuuga

SEQ ID NO: 131709 - RNA, 1689 nt, Artificial Sequence
  derived and/or modified sequence opt3 from hemagglutinin__InfluenzaA__AFV53249
auggccaucauuuaccugauacuccuuuucgcuaccgugagaggcgaccagaucugcauuggguaucacgcaaacaauagcacagagacugucgauacgauccuggaaaggaacguuaccgugacacaugccaaggacauuuuggagaaaacucacaauggaaaguuauguaaacugaacgguauacccccucuagaacucggcgauugcuccaucgcgggguggcugcuuggaaauccagagugugaccggcuguugcgcguaccggaauggucuuacaucauggagaaggagaacccccgauauucacucugcuacccuggcagucugaaugauuaugaagaacugaaacaucucuuaagcuccgugaagcacuuugaaaagguccguauucugccaaaagacagauggaccaaccauacaaccacuggugggucuaaggcuugugccgugucgggagagcccucauucuuuaggaauaugguuuggcuuaccaaaaagggcccuaacuacccaguggcaaaaggcagcuauaauaacacaaguggggagcaaauguugaucauuuggggaguccaccaccccaaugaugaagccgagcagcgggcucuguaccagaagguggguacguacguauccgcaucuacuagcacccuauauaagcgcuccaucccugaaauagccgcuagaccaaaaguuaacggccucgggucaaggauggaguucaguuggacacugcuuaaugugugggacacuauuaacuuugaaagcaccggaaaccuggucgccccggaguacggcuucaagaucucuaaacggggucgcuccgggauuaugaagacagagggaaccuugggcaauugcgaaacgaaaugucagacuccccucggcgcgaucaacacaacccugccuuuucauaaugugcacccauuaacuaucggggagugccccaaguaugugaaaucagaaaagcugguccucgcaacaggacuucgaaacguuccucaaauugagagcagaggucuguucggcgccauagcuggguuuaucgaaggaggcuggcaggguaugguggaugggugguacggcuaucaucacaguaaugaccagggaucuggcuacgccgcagauaaggaguccacccagaaggcuuucgacgggauuacgaacaaaguaaauagcgugaucgagaaaaugaacacccaauuugaagccgucggaaaggaguucaauaacuuggagaaaaggcuagagaaucugaacaagaagauggaagaugguuuucucgacguguggacauauaaugcggagcugcuuguucugauggagaacgaacggacuuuggacuuccacgauucgaaugugaaaaaccucuacgagaagguccguaugcagcugcgcgacaacgugaaagaauuaggcaauggguguuucgaguuuuaccauaagugcgaugacgaguguaugaacucuguuaaaaauggaaccuaugauuacccaaaguaugaagaggaauccaagcugaaaagaaacgagauaaagggcguaaaacuaucaaguauggguguguaccagauucucgccaucuaugcaacagucgcugggagccugucccuugccaucaugguggcuggcauuucuuucuggaugugcagcaauggaucauugcagugcaggaucuguauuuga

SEQ ID NO: 131710 - RNA, 1698 nt, Artificial Sequence
  derived and/or modified sequence opt3 from hemagglutinin__InfluenzaA__AFV53260
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaaagcuccccuucagcuggguaauuguaacaucgccggcuggguguuggggaauccugagugcgaaagucuccugagcaacagguccuggucuuauauugcagagaccccaaauucggaaaacggaacauguuacccgggcgauuucgccgacuaugaggagcugcgggaacaacucucaagcgucaguuccuuugagcgcuucgaaaucuuucccaaggagcgaucuuggccuaaucauaccacucguggugugacagcugcaugcccacacgccaugaaaagcuccuucuacaagaacuuaguuuggcugaccgaggcuaaugggucauaucccaaccuuaguagaagcuacgugaauaaccaggaaaaggaggucuuggugcuguggggaguacaucacccuucuaacauugaagaucagaggacgcuauaucggaaagacaaugccuacguuuccguggucucaagcaacuacaaucgcagauuuacuccagagaucgcgaagaggcccaaagugcggggccagaguggccgcauaaacuauuacuggacccuccuggaaccuggggauacaaucauuuucgaggcaacuggaaaucuuaucgccccaugguaugcuuuugcccugucucgagguccgggcuccgggauuaucaccagcaacgcacccuuggacgagugugauacaaagugccaaaccccucagggagcuauaaauucgucucucccauuccagaacauucaccccgugacgaucggcgaauguccuaaguacgucagauccacuaaacugaggaugguuacagguuuacggaauauuccaucauuucagagucgugggcuguucggagccaucgcgggcuuuaucgagggcggguggaccggaaugauggacgguugguauggcuaccaucaccaaaacgaacaggggagcggauaugccgcagaucagaaguccacucagaaugcuauuaacggcauaacaaauaaagugaacucuguaaucgagaagaugaauacccaauucacggccguggguaaagaauuuaacaagcucgagaaacgcauggagaaccuuaauaagaaggucgacgacggguuccuggauauuuggaccuacaacgcugaauugcuagugcugcucgagaaugaaagaacacuggacuuccaugauagcaacguuaaaaaucuuuacgagaaggugaaaaaccagcugaggaauaacgccaaggaauugggcaauggaugcuuugaguucuaucacaaaugugacaacgagugcauggaaucagucaagaauggcacuuacgauuaucccaaguacagugaggaauccaaacucaaccgggagaagaucgacggggugaaacuggagagcaugggaguauaucgaauauuagcaauuuacucuaccguugccucaagucuggugcuacucgucagccugggugcuaucuccuuuuggaugugcucuaauggcucgcuucagugucgcaucugcauuuga

SEQ ID NO: 131711 - RNA, 1689 nt, Artificial Sequence
  derived and/or modified sequence opt3 from hemagglutinin__InfluenzaA__AFV53271
auggccaucaccuaccugauucuccuuuucacagcugugagaggcgaccagauaugcaucggguaucacgcaaacaauagcacugagaaggucgauacgauucuggaaaggaacguuaccgugacacaugccaaagacaucuuggagaagacucacaauggaaaauuauguaagcugaacgguauucccccucuagaacucggcgauugcuccaucgcgggguggcugcuuggaaauccagagugugaccgguuucugcgcguaccggaauggucuuacauaauggagaaagagaacccccgauauucauugugcuacccuggcaguuucaaugauuaugaagaacucaagcaucugcugagcuccgugaagcacuuugaaaaagucaagauccucccaaaagacgguuggacccaacauacaaccacugggggaucuauggcuugugccgugucgggcaagcccucauucuuucguaacaugguuugguuaacagagaaaggccagaauuacccuguggcaaaggggagcuauaacaauaccaguggagagcagaugcugauuaucugggguguccaccacccaaacgaugaagccgagcagagagcucuuuaccaaaaggugggcacguacguauccgcaucuacuagcaccuugaauaaaagguccacacccgaaauugccgcucggccuaagguuaacgggcugggaucacgcauggaguucaguuggacucuacucgacaugugggauaccaucaauuuugaaagcacaggcaaccugguggccccagaguaugguuucaaaauaucuaagagaggguccucaggaauuaugaaaaccgagggcacgcuugaaaacugcgagacuaagugucagacaccgcugggcgcgaucaauaccacuuugcccuuucauaacguccacccucucacaauuggggaaugcccaaaauacgucaagagcgagaagcugguguuagcaaccggacugaggaauaucccccagaucgaaagucggggucucuucggcgccauugcuggguuuauagagggaggcuggcaggguaugguggacgggugguauggcuaccaucacucuaacgaucaaggauccggcuaugccgcagacaaagagagcacgcagaaggcuuucgaugggaucaccaauaaaguuaacucggugauugaaaagaugaauacacaguuugaggccguaggaaaagaguucucuaaccuugagaagcgccuggaaaauuugaacaagaaaauggaggacgguuuccuagacguguggacuuacaaugcggagcugcucguccugauggaaaacgagcgaacccuugauuuucacgacuccaaugugaagaaccuguaugauaaaguuagaaugcaguugagggacaaugugaaggaacucggcaacggguguuucgaguuuuaccauaaaugcgauaacgaguguauggacucagucaagaauggaacauacgauuauccuaaguacgaagaggaaaguaaacugaaccggaaugagaucaagggcgugaaauuaagcuccauggguguauaucaaauacuggccauuuacgcaacuguugcugggucucuaagccucgccaucaugauggcuggcaucucauucuggaugugcaguaacggaucccugcagugccguauuuguaucuga

SEQ ID NO: 131712 - RNA, 1689 nt, Artificial Sequence
  derived and/or modified sequence opt3 from hemagglutinin__InfluenzaA__AFV53282
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcacaaacuauccuguggcaaaggggagcuacaauaacaccaguggagagcagaugcuuaucauuugggguguccaccacccaaaugacgagacggaacagaggacuuuguaucagaacgugggcaccuacguauccguugggacaucuacucugaauaagcggagcacccccgagaucgccacacgcccuaaagugaacggacuaggcuccagaauggaauuuucauggacccuccuggauaugugggacacgauaaacuucgagaguacugguaaucuuauugcuccagaauacggguuuaagaucagcaaaaggggaucuuccggcauuaugaagacagagggcacccuggagaacugcgaaacuaaaugucaaacaccguugggggcaaucaauaccacgcuccccuuccauaacguccacccucugaccaucggagagugcccaaaguaugugaaauuagaaaagcuggugcucgccacaggucuucggaaugucccccagauugagucacgcggccuguuuggggcuauagccggauucaucgaaggcgguuggcaggggaugguugauggcugguacggauaucaucacagcaacgaccagggcaguggguacgcggcagauaaggagucuacucaaaaagccuuugacgugauuaccaauaagguaaacuccgugaucgagaaaaugaauacacaguucgaagcugucggaaaggaguuuagcaacuuggaacgaagacuagagaaucugaacaaaaagauggaagacgguuuccucgauguguggacuuauaaugccgagcugcuuguucugauggagaacgaaaggaccuuggacuuccacgauucgaaugugaagaaccucuacgacaaaguccggaugcagcugcgugauaacgugaaggaguuaggcaauggguguuuugaguucuaucauaaaugcgacgaugaguguaugaacucuguaaagaauggaacauacgacuacccuaaauaugaggaagaguccaagcugaaccgcaaugaaauaaagggcguuaaacuaucaaguauggguguguaccagauucucgcaaucuaugcuaccgucgccgggagccugucccuugcgaucaugauggccggcauuucuuuuuggaugugcagcaacggaucauugcaaugcagaaucuguauuuga

SEQ ID NO: 131713 - RNA, 1689 nt, Artificial Sequence
  derived and/or modified sequence opt3 from hemagglutinin__InfluenzaA__AFV53293
auggccaucauuuaccugauacuccuuuucaccagcgugagaggcgaccagaucugcauuggguaucacgcuaacaauuccacagagaaggucgauacuauccuggaaaggaacguuacggugacccaugccaaaaauauuuuggagaagacacacaacggaaaauuauguaagcugaaugguauacccccucuagaacucggcgacugcucuaucgcaggguggcugcuuggaaacccagagugugaucggcuguugcgcguaccggaauggucauacaucauggagaaagagaaucccaaguauagucucugcuacccuggcagcuuuaacgacuaugaggaacugaagcaucugcucuccucugugaaacacuucgaaaaggucaaaauuuuaccaaaggaugguuggacucaacauaccacaaaugggggaucgcgagcgugugcugugucaggcaaccccagcuuuuuccguaauaugguuuggcugaccaaaaagggcccuaacuacccaguggccaaggggaguuauaauaacacuuccggagagcagaugcuuaucauuugggguguccaccaccccaaugacgaggcagaacagagagccuuguaccaggaggugggcacauacguaucugcuagcaccuccacgcugaacaaaaggucaacuccugaaaucgcagcccggccaaagguuaacgggcuaggaagucgcauggaguuuagcuggacccuccuggauaugugggacacaauaaauuucgaaucuacuggcaaccuuguggcuccggaguaugguuuuaaaauuuccaagagagggucaagcggagucaugaaaaccgagggcacacuggaaaauugcgagaccaagugucaaacgcccuugggcgccaucaacacuacacucccuuuccauaaugugcacccacugaccauuggggaaugccccaaauacgugaagagugagaaguuaguccuggcgacuggacucaggaacguuccucagaucgaaucucggggucuuuuuggcgcaaucgccggguucauugagggaggcuggcaggguaugguggaugggugguauggcuaccaucacuccaaugaccagggaagcggcuaugcugccgauaaagagucgacacaaaaggcauuugacgggauaaccaacaaaguaaauucugugaucgaaaagaugaacacgcaguucgaggcugucggaaaagaauuuuccaaucuggagaagcgcuuggaaaaccuaaauaagaaaauggaggaugguuuccuggacguguggaccuacaacgccgagcuccugguucuuauggaaaaugagcgaacacuggacuuccacgauucaaacgugaagaacuuguaugacaaagucagaaugcagcucagggauaaugugaaggaacugggcaacggguguuuugaguucuaccauaaaugcgacgaugaguguauggacaguguaaagaauggaacuuacgauuauccaaaguacgaagaggaaagcaaauuaaaccggaaugagauuaagggcguuaaacuguccucuauggguguguaucagauccuagcgauauacgccaccgucgcagggagccucucacuggcuauuaugauggccggcaucaguuuuuggaugugcuccaacggaagccuucaaugccguaucuguauuuga

SEQ ID NO: 131714 - RNA, 1689 nt, Artificial Sequence
  derived and/or modified sequence opt3 from hemagglutinin__InfluenzaA__AFV53304
auggccaucauuuaccugauacuccuuuucaccgcugugagaggcgaccagaucugcauuggguaucacgcaaacaauagcacagagaaggucgauacuauccuggaacaaaacguuacggugacccaugccaaagacauuuuggagaagacacacaauggaaaauuauguaagcugaacgguauacccccucuagaacucggcgauugcuccaucgcgggguggcugcuuggaaauccagagugugacaggcuguugucuguaccggaauggucauacaucauggagaaagagaacccccgggauggccucugcuauccugguaguuuuaaugacuacgaagaacugaagcaucugcucagcuccgugaagcacuucgaaaaagucaagauuuuaccaaaagaucgcuggacucagcauaccacaaccgggggaucucgagcuugugccgugucgggcaaccccucauuuuuccguaauaugguuuggcugacuaagaaagagagcaacuauccuguggcaaagggcaguuacaauaacacauccggggagcagaugcuuaucauuuggggaguccaccacccaaaugacgaaaccgagcagagaacguuguaucaaaacguggguacuuacguaucuguuggcaccagcacacugaauaagagguccacucccaacaucgccacccggccuaaagugaacgggcuaggaucacgcauggaauuuaguuggacacuccuggauaugugggacaccauaaauuucgagagcacgggcaaccuuauugcuccagaauacgguuuuaagaucucuaaaagaggguccucaggaauuaugaagacugagggcacacuggagaauugcgaaaccaaaugucagacuccguugggcgcaaucaacacaacccuccccuuccauaauguccacccucugacgaucggggagugcccaaaguaugugaaaagcgaaaaguuagugcuggccaccggacucaggaacgucccccagauugagagucggggucuuuuuggcgcuauagccggguucaucgaaggaggcuggcaggguaugguugaugggugguacggcuaucaucacucuaaugaccaaggauccggcuacgcggcagauaaggagagcacacagaaagccuuugacgggauuacuaacaagguaaauucggugaucgagaaaaugaacacccaguucgaagcugugggaaaggaguuuucuaaucuggaacgccgauuggagaaccuaaauaaaaagauggaagacgguuuccuggaugucuggacauauaacgccgagcuccuggugcuuauggagaaugaaagaacucuggacuuccacgauuccaacguuaagaacuuguacgacaaagugaggaugcagcuccgggauaaugucaaggagcugggcaacggguguuuugaguucuaucauaaaugcgacgaugaguguaugaacucagugaagaauggaaccuacgacuacccuaaauaugaggaagagaguaaguuaaaucguaacgaaauaaagggcguaaaacugagcuccauggguguuuaccaaauucuagcaaucuaugcuacaguggccgggucucucagccuggcgaucaugauggccggcauuucauuuuggaugugcaguaauggaucccuucagugccgcaucuguauuuga

SEQ ID NO: 131715 - RNA, 1689 nt, Artificial Sequence
  derived and/or modified sequence opt3 from hemagglutinin__InfluenzaA__AFV53314
auggccaucauuuaccugauacuccuuuucaccgcugugagaggcgacaagaucugcauuggguaucacgcaaacaauagcacagagacugucgauacgauccuggaaaggaacguuaccgugacacaugccaaagacauuuuggagaagacucacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcaauggccucugcuauccugguaacuuuaaugauuacgaggaacugaagcaucugcucaguagcgugaagcacuucgaaaaagucaagauuuuaccaaaagaccgauggacccagcauacaaccacugggggaucccaggcuugugccgugucuggcaaccccucguuuuuccguaauaugguuuggcugacagagaaggagucaaacuauccuguggcaaaaggcagcuacaauaacaccaguggggaacaaaugcuuaucauuuggggaguccaccacccaaucgaugagacggaacagagaacuuuguaucagaauguggguaccuacguauccguuggcacaucuacucugaacaagaggagcacccccgagauagccaagcggccuaaagugaacgggcuaggaucccgcauggaauuuucauggacacuccuggacaugugggauaccauuacguucgagaguacuggcaaucuuaucgcuccagaguacgguuuuaagauuagcaaaagagggucuuccggaaucaugaagacagaaggcacccuggagaacugcgaaacuaaaugucaaacaccguugggcgcaaucaauaccacgcuccccuuccauaacguccacccucugaccauuggggagugcccaaaguaugugaaaucagaaaaguuagugcuggccacaggacucaggaaugucccccagauagagagccggggucuuuuuggcgcuaucgccggguucauugagggaggcuggcaggguaugguugacgggugguacggcuaucaucacaguaacgaucagggaucuggcuacgcggcagacaaggaauccacucaaaaagccuuugaugggaucaccaauaaggugaacgcuguaauagagaaaauuaauacacaguucgaagccgugggaaaggaguuuagcaaccuggaacgccgauuggagaaucuaaacaaaaagauggaggacgguuuccuggacgucuggacuuauaaugcagaacuccuggugcuuauggagaacgaaagaacccuggauuuccacgacucgaauguuaagaacuuguacgauaaagugaggaugcagcuccgggacaacgucaaggagcugggcaauggguguuuugaguucuaucauaaaugcgaugacgaauguaugaacucugugaagaauggaacauacgauuacccuaaauaugaggaagaguccaaguuaaaccguaaugaaaucaagggcguaaaacugucaaguauggguguuuaccagauccuagcuauuuaugccaccguggcggggagccucucccuggccaucaugauggcaggcauuucuuuuuggaugugcagcaacggaucacuucaaugccgcauauguaucuga

SEQ ID NO: 131716 - RNA, 1689 nt, Artificial Sequence
  derived and/or modified sequence opt3 from hemagglutinin__InfluenzaA__AFV53325
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugucuguaccggaauggucauacaucauggagaaagagaacccccgcgauggccucugcuauccugguaguuuuaaugacuacgaagaacugaagcaucugcucagcuccgugaagcacuucgaaaaagucaagauuuuaccaaaagaucgauggacucaacauaccacaaccgggggaucucgugcuugugccgugucgggcaaccccucauuuuucagaaauaugguuuggcugacuaagaaaggcagcaacuauacaguggcaaaggggaguuacaauaacaccuccggagagcagaugcuuaucauuugggguguccaccacccuaaugacgagacggaacagaggacuuuguaucagaacgugggcaccuacguaucuguuagcacauccacucugaauaagcggucaaccccagagaucgccacacgccccaaagugaacgggcuaggaaguagaauggaauuuagcuggacccuccuggauaugugggacacgauaaacuucgagucuacuggcaaucuuauugcuccugaauacgguuuuaagaucuccaaaagggggucaagcggaauuaugaagacagagggcacccuggagaacugcgaaacuaaaugucaaacaccauugggcgcaaucaauaccacgcucccguuccauaacguccacccccugaccaucggggagugcccuaaguaugugaaaagugaaaaguuagugcuggccacaggacuccggaaugucccacagauugagucucgcggucuuuuuggcgcuauagccggguucaucgaaggaggcuggcaggguaugguugaugggugguacggcuaucaucacuccaacgaccagggaagcggcuacgcggcagauaaggagucgacucaaaaagccuuugacgggauuaccaauaaggugaacucuguaaucgagaaaaugaauacacaguucgaagcugugggaaaggaguuuuccaaccuggaacgaagauuggagaaucuaaacaaaaagauggaagacgguuuccuggaugucuggacuuauaaugccgagcuccuggugcuuauggagaacgaaaggacccuggacuuccacgauucaaauguuaagaacuuguacgacaaagugcggaugcagcuccgugauaacgucaaggagcugggcaauggguguuuugaguucuaucauaaaugcgacgaugaguguaugaacagugugaagaauggaacauacgacuaccccaaauaugaggaagagagcaaguuaaaccgcaaugaaauaaagggcguaaaacuguccucuauggguguuuaccagauucuagcaaucuaugcuaccguggccgggagccucucacuggcgaucaugauggccggcauuaguuuuuggaugugcuccaacggaagccuucaaugcagaaucuguauuuga

SEQ ID NO: 131717 - RNA, 1689 nt, Artificial Sequence
  derived and/or modified sequence opt3 from hemagglutinin__InfluenzaA__AFV53336
auggccaucauuuaccugauacuccuuuucaccgcugugagaggcgaccagaucugcauuggguaucacgcaaacaauagcacagagaaggucgauacuauccuggaaaggaacguuacggugacccaugccaaagacauuuuggagaagacacacaauggaaaauuauguaagcugaacgguauacccccucuagaacucggcgauugcuccaucgcgggguggcugcuuggaaauccagagugugaccggcuguugcgcguaccggaauggucuuacaucauggagaaagagaacccccgauauucacucugcuacccuggcaguuuuaaugauuaugaagaacugaagcaucugcucagcuccgugaagcacuuagaaaaagucaagauucugccaaaagacgguuggacucaacaugagaccgaugggggaucuaaggcuugugccgugucgggcaaacccucauucuuucguaacaugguuuggcuuacaaagaagggcccuaauuacccaguggcaaaaagaagcuauaacaauaccaguggggagcagauguugaucauuuggggaguccaccaccccaacgacgaagccgagcagagggcucuguaccagaagguggguacuuacguauccgcaucuacaagcacccuaaauaaacgguccacgccugaaaucgccgcucgcccagagguuucaggccucgggaguagaauggaguucagcuggacucugcuugaugugugggacaccauaucuuuugaguccacaggaaaccuggucgccccggaguauggcuucaagauuucaaaaagggguagcagugggaucaugaagacugaaggaaccuugggcaauugcgagacaaaaugucaaacgccccucggcgcgauuaacaccacucugccuuuucauaacgugcacccauuaacaaucggggaaugccccaaguacgugaagucugagaaacugguccucgcaaccggacuucggaauguuccucagaucgaaucccgcggucuguucggcgccauugcuggguuuauagagggaggcuggcaggguaugguggaugggugguauggcuaccaucacagcaacgaccagggaucgggcuaugccgcagauaaggagucuacucaaaaggcuuucgaccgaaucacaaauaaaguaaacuccgugauugagaaaaugaauacccaguuugaagccgucgggaaggaguucucaaacuuggaaaagagacuagaaaaucugaacaaaaagauggaggacggauuucucgauguguggacguacaaugcggagcugcuuguucugauggaaaacgagaggaucuuggacuuccacgauaguaaugugaaaaaccucuaugacaagguccggaugcagcugcgugauaaugugaaagaauuagguaacggcuguuucgaguuuuaccauaagugcgacgaugaguguaugaauagcguaaagaacgggaccuacgacuauccaaaauacgaagaggaauccaagcugaaacgcaacgagauaaagggaguuaaacuaucuagcaugggcguguaucagauucucgccaucuacgcaacagucgcugguucacugagucuugccaucaugauugcugggaucuccuucuggaugugcagcaauggcucuuugcaaugcagaauuuguauauga

SEQ ID NO: 131718 - RNA, 1701 nt, Artificial Sequence
  derived and/or modified sequence opt3 from hemagglutinin__InfluenzaA__AFV68720
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccgacucaaguuucuuuagccgacugaacuggcucacucauuuaaauuuuaaguauccagcacugaacgugaccaugcccaauaacgagcaguucgauaaacuuuacauuuggggaguccaccauccuggcacagacaaggaucagaucuuuuuguaugcccaagcuagcggccguauuacuguguccaccaagagaucacagcaggccguaaucccaaacauagggagcaggccccggauucgcaauaucccuaguagaauuucuaucuacuggacaaucguuaaaccaggagacauucugcuaauaaacuccaccgguaaucucaucgcgccgaggggcuacuucaagauucggagcgggaaaucgucuaucaugcgcuccgacgcacccauaggaaaguguaacucagaaugcauuacgccuaauggcaguaucccaaacgauaagcccuuucagaaugugaaccgaaucacuuauggugccuguccuagauacgucaaacaaaauacacugaaacuugcuaccgggaugaggaacgugccagagaagcagacucggggaauuuucggcgccaucgcaggcuuuauugaaaaugggugggagggaaugguggacgguugguauggcuuccgucaccagaacagcgaggggcgcggacaagcugccgaucugaaguccacacaggcggccauagaccagaucaauggcaaauugaacagacucauugguaagaccaaugaaaaauuccaccagaucgagaaggaauuuucugaggucgaagggaggauccaagaucuggagaaguacguugaggacacgaaaauugauuuauggagcuauaacgcagaacugcucguggcucuugagaaccagcauaccauagaccugacagauucagaaaugaauaaguuguucgagaaaacuaagaaacagcuacgggaaaacgccgaggacaugggcaauggaugcuuuaagaucuaccacaagugugauaacgcuugcauuggcaguauccgaaaugggaccuauaaccaugacguauaccgcgacgaggcccugaauaacagauuccagauuaaaggaguggaacucaaguccgguuacaaagauuggauccuguggauaucuuuugcaaucucuugcuuccuucugugugucgccuugcucggcuuuauuaugugggcuugccaaaaggggaauaucagguguaacauuugcaucuga

SEQ ID NO: 131719 - RNA, 1701 nt, Artificial Sequence; identical to SEQ ID NO: 124685
  derived and/or modified sequence opt3 from hemagglutinin__InfluenzaA__AFX96347

SEQ ID NO: 131720 - RNA, 1701 nt, Artificial Sequence
  derived and/or modified sequence opt3 from hemagglutinin__InfluenzaA__AFX96359
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacgagaucaccaauaaggugaacucuguuauagagaaaaugaauacacaguuuacugccguggguaaggaguucaaccaccuggaaaagcggauugaaaauuuaaacaaaaagaucgaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaauuggcaacggauguuuugaguucuaucacaagugcgacaauacuuguauggaaaguguuaaaaacggcaccuacgauuauccuaaguacuccgaggaagcaaaacugaauagagaggagaucaacggggugaaacuugaaagcacaaggauuuaucaaauacuggccaucuacucuaccgucgcuucaaguuuggugcucgucgugagccugggagcgauuuccuuuuggaugugcucuaaugguucguuacagugccggaucuguaucuga

SEQ ID NO: 131721 - RNA, 1701 nt, Artificial Sequence
  derived and/or modified sequence opt3 from hemagglutinin__InfluenzaA__AFX96366
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugaccgcggcaaggaaguacugguucuuuggggcauccaccaccccucaacgagcgcugaucaacagaguuuguaccagaacgccgacgcguacguguucgucgggacuucucgauauuccaaaaaguuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaaaaugaauacccaguuuacagcuguggguaaggaguucaaccagcuggaaaagcgcauugagaauuuaaacaaaaaggucgaugacggguuccuggauaucuggacuuacaaugccgaacuccuugugcuguuggagaacgaacgaacccuagacuaucacgauagcaauguaaagaaccuguacgagaagguuagaucacaacucaaaaacaaugcaaaggagaucggcaacggauguuuugaguucuaucauaagugcgacaauacauguauggaaagugugaaaaacggcacuuacgauuauccuaaguacuccgaagaggccaaacugaauagggaagagauugacggggucaaacuugagagcacccggaucuaucagauucuggcuauauacucuacaguggcgucaaguuugguccucgugguuagccugggagcaaucuccuuuuggaugugcucuaacgguucguuacagugccguauuuguaucuga

SEQ ID NO: 131722 - RNA, 1701 nt, Artificial Sequence; identical to SEQ ID NO: 126185
  derived and/or modified sequence opt3 from hemagglutinin__InfluenzaA__AFX96383

SEQ ID NO: 131723 - RNA, 1701 nt, Artificial Sequence; identical to SEQ ID NO: 124685
  derived and/or modified sequence opt3 from hemagglutinin__InfluenzaA__AFX96398

SEQ ID NO: 131724 - RNA, 1701 nt, Artificial Sequence; identical to SEQ ID NO: 124685
  derived and/or modified sequence opt3 from hemagglutinin__InfluenzaA__AFX96408

SEQ ID NO: 131725 - RNA, 1701 nt, Artificial Sequence; identical to SEQ ID NO: 124685
  derived and/or modified sequence opt3 from hemagglutinin__InfluenzaA__AFX96418

SEQ ID NO: 131726 - RNA, 1701 nt, Artificial Sequence; identical to SEQ ID NO: 124685
  derived and/or modified sequence opt3 from hemagglutinin__InfluenzaA__AFX96428

SEQ ID NO: 131727 - RNA, 1701 nt, Artificial Sequence; identical to SEQ ID NO: 124685
  derived and/or modified sequence opt3 from hemagglutinin__InfluenzaA__AFX96438

SEQ ID NO: 131728 - RNA, 1701 nt, Artificial Sequence; identical to SEQ ID NO: 124685
  derived and/or modified sequence opt3 from hemagglutinin__InfluenzaA__AFX96448

SEQ ID NO: 131729 - RNA, 1701 nt, Artificial Sequence; identical to SEQ ID NO: 124685
  derived and/or modified sequence opt3 from hemagglutinin__InfluenzaA__AFX96458

SEQ ID NO: 131730 - RNA, 1701 nt, Artificial Sequence; identical to SEQ ID NO: 124685
  derived and/or modified sequence opt3 from hemagglutinin__InfluenzaA__AFX96468

SEQ ID NO: 131731 - RNA, 1701 nt, Artificial Sequence; identical to SEQ ID NO: 124685
  derived and/or modified sequence opt3 from hemagglutinin__InfluenzaA__AFX96478

SEQ ID NO: 131732 - RNA, 1701 nt, Artificial Sequence; identical to SEQ ID NO: 124685
  derived and/or modified sequence opt3 from hemagglutinin__InfluenzaA__AFX96488

SEQ ID NO: 131733 - RNA, 1701 nt, Artificial Sequence
  derived and/or modified sequence opt3 from hemagglutinin__InfluenzaA__AFX96498
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaaauaucuaaguccuauaucaaugacaagggcaaagaaguauuaguucuguggggcauucaccaccccucaacgagcgcugaucaacagagucuuuaccagaacgccgacgcguacguguucgucgggacuucucgcuauuccaagaaauuuaagccugagaucgcaauucgaccaaaagugcgugaucaggagggaagaaugaauuacuauuggaccuugguggaacccggugacaagaucacauucgaggccacuggcaaccuggucguuccuagguacgcuuuugccauggaacggaacgcagggagcggaauaauuaucucggauaccccagugcaugacugcaauacaaccugucaaacgccgaaaggcgcuauuaacacuucucuacccuuccagaauauccacccuaucacaauugguaagugcccaaaguauguaaaauccaccaagcuccgccuggccacugggcuuagaaacgugcccucaauacagaguaggggacuguuuggcgcgaucgccggcuucauugaagggggauggacagguauggucgacggcugguacggguaucaucaccagaaugaacaaggaagcggcuacgcagcugauuugaaauccacccagaacgccaucgacgagauaacgaauaaggugaacucuguuauugagaaaaugaauacccaguuuacagcuguggguaaggaguucaaccaccucgaaaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuuugaguucuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauacuugcuaucuacucuacaguggcgucaagucuggucuuggugguuagccucggagcaauuuccuuuuggaugugcucuaacgguucgcugcagugccggaucuguaucuga

SEQ ID NO: 131734 - RNA, 1701 nt, Artificial Sequence; identical to SEQ ID NO: 124685
  derived and/or modified sequence opt3 from hemagglutinin__InfluenzaA__AFX96508

SEQ ID NO: 131735 - RNA, 1701 nt, Artificial Sequence; identical to SEQ ID NO: 126185
  derived and/or modified sequence opt3 from hemagglutinin__InfluenzaA__AFX96518

SEQ ID NO: 131736 - RNA, 1701 nt, Artificial Sequence; identical to SEQ ID NO: 124685
  derived and/or modified sequence opt3 from hemagglutinin__InfluenzaA__AFX96528

SEQ ID NO: 131737 - RNA, 1701 nt, Artificial Sequence; identical to SEQ ID NO: 126185
  derived and/or modified sequence opt3 from hemagglutinin__InfluenzaA__AFX96538

SEQ ID NO: 131738 - RNA, 1701 nt, Artificial Sequence
  derived and/or modified sequence opt3 from hemagglutinin__InfluenzaA__AFX96548
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacacuuacguguucgucgggaccucucgcuauuccaagaaauuuaagccugagauugcgauccgaccaaaagugcgugaucaggagggaagaaugaauuacuauuggacacugguggaacccggugacaagauuacuuucgaggcaaccggcaaccuagucguuccuagguacgccuuugcuauggaacggaacgccgggagcggaaucauaauuucggauacaccagugcaugacugcaauaccacgugucaaacuccgaaaggcgcaaucaacacaucucuccccuuccagaauauucacccuaucaccaucgguaagugcccaaaguauguaaaauccacuaagcugcgccuugcuacagggcugagaaacgugcccucaauucagaguaggggauuguuuggcgccauagcgggcuucaucgaagggggauggaccgguauggucgacggcugguacggguaucaucaccagaaugaacaaggaagcggcuacgccgcagaucucaaauccacgcagaacgcuauugacaagaucaccaauaaagugaacucuguuauagagaagaugaauacacaguuuacugccguggguaaggaguucaaccaccuggaaaaacggauugagaauuuaaacaagaaaaucgaugacggguuccuggauaucuggaccuacaaugcugaacuccuuguccuguuggagaacgaacgcacacuagacuaucaugauagcaaugugaagaaccuguacgagaaaguacgaucacagcucaagaacaaugccaaggagauuggcaacggauguuuugaguucuaucacaaaugcgacaauacuuguauggaaaguguuaagaacggcaccuacgauuauccuaaauacuccgaagaggcaaagcugaauagagaagagaucgacggggugaaacuugagagcacaaggauuuaucaaauacuggccaucuacucuaccgucgcuucaaguuuggugcucgucgugagccugggagcgauuuccuuuuggaugugcucuaacgguucguuacagugccggaucuguaucuga

SEQ ID NO: 131739 - RNA, 1701 nt, Artificial Sequence; identical to SEQ ID NO: 124685
  derived and/or modified sequence opt3 from hemagglutinin__InfluenzaA__AFX96558

SEQ ID NO: 131740 - RNA, 1701 nt, Artificial Sequence; identical to SEQ ID NO: 125845
  derived and/or modified sequence opt3 from hemagglutinin__InfluenzaA__AFX96568

SEQ ID NO: 131741 - RNA, 1701 nt, Artificial Sequence; identical to SEQ ID NO: 125845
  derived and/or modified sequence opt3 from hemagglutinin__InfluenzaA__AFX96578

SEQ ID NO: 131742 - RNA, 1701 nt, Artificial Sequence; identical to SEQ ID NO: 124685
  derived and/or modified sequence opt3 from hemagglutinin__InfluenzaA__AFX96588

SEQ ID NO: 131743 - RNA, 1701 nt, Artificial Sequence; identical to SEQ ID NO: 124685
  derived and/or modified sequence opt3 from hemagglutinin__InfluenzaA__AFX96598

SEQ ID NO: 131744 - RNA, 1701 nt, Artificial Sequence
  derived and/or modified sequence opt3 from hemagglutinin__InfluenzaA__AFX96608
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaauccaccaagcugcgccuugccacugggcugagaaacgugcccucaauucagaguaggggauuguuuggcgcgauagccggcuucaucgaagggggauggacagguauggucgacggcugguacggguaucaucaccagaaugaacaaggaagcggcuacgcagcugaucucaaauccacccagaacgccauugacgagaucacgaauaaggugaacucuguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauagcaauguuaaaaaccuguacgagaagguacgaucacagcucaaaaacaaugcaaaggaaaucggcaacggauguuuugaguucuaucacaagugcgacaauacauguauggaaagugugaaaaacggcacuuacgauuauccuaaguacuccgaggaagccaaacugaauagagagaagauugacggggucaaacuugagagcaccaggaucuaucaaauucuggcuauauacucuacauuggcgucaagucucgugcuggucgugagcuuaggagcaaucuccuuuuggaugugcucuaacgguucgcugcagugccggauuuguaucuga

SEQ ID NO: 131745 - RNA, 1701 nt, Artificial Sequence; identical to SEQ ID NO: 124685
  derived and/or modified sequence opt3 from hemagglutinin__InfluenzaA__AFX96618

SEQ ID NO: 131746 - RNA, 1701 nt, Artificial Sequence; identical to SEQ ID NO: 125845
  derived and/or modified sequence opt3 from hemagglutinin__InfluenzaA__AFX96628

SEQ ID NO: 131747 - RNA, 1701 nt, Artificial Sequence
  derived and/or modified sequence opt3 from hemagglutinin__InfluenzaA__AFX96638
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugguguggcucguaaagaagggaaauagcuacccaaaauuaucuaaguccuauaucaacgauaagggcaaagaaguucuggugcuuuggggcauacaccaccccucaacgagcgcugaccaacagaguuuguaccagaaugccgaugcguacgucuucguggggacuucucgcuauuccaagaaauuuaagccugagaucgcaauucgaccaaaagugcgugaccaggagggaagaaugaacuacuauuggacccuggucgaacccggugauaagaucacauucgaggccacuggcaaccuaaugguuccuagguacgcuuuugccauggaacggaaugcagggagcggaauuaucauaucggacaccccagugcaugauugcaacacaaccugucaaacgccgaaaggcgcuauuaauacuucucuccccuuccagaacauccacccuauuacaaucgguaagugcccaaaguauguaaaauccaccaagcugcgccuugccacugggcugagaaaugugcccucaauccagaguaggggauuguuuggcgcgauugccggcuucauagaagggggauggacagguauggucgacggcugguacggguaucaucaccagaacgaacaaggaagcggcuacgcagcugaccucaaauccacccagaaugccaucgaugagauuacgaacaagguaaauucuguuaucgagaaaaugaacacccaguuuacagcuguggguaaggaguucaaucaccuggaaaagcggauagaaaacuuaaauaaaaaggucgacgauggguuccuggacauuuggacuuacaacgccgagcuccuugugcuguuggaaaaugagcgcacccuagauuaucaugacagcaacgugaaaaaccuguacgagaagguucgaucacagcucaaaaauaacgcaaaggaaaucggcaauggauguuuugaguucuaucacaagugcgauaacacauguauggaaagugugaaaaauggcacuuacgacuauccuaaguacuccgaggaagccaaacugaacagagaggagaucgauggggucaaacuugaaagcaccaggauuuaucaaauccuggcuauuuacucuacaguggcgucaaguuugguccucgugguuagccugggagcaauauccuuuuggaugugcucuaaugguucguuacagugccggaucuguauuuga

SEQ ID NO: 131748 - RNA, 1701 nt, Artificial Sequence; identical to SEQ ID NO: 124685
  derived and/or modified sequence opt3 from hemagglutinin__InfluenzaA__AFX96648

SEQ ID NO: 131749 - RNA, 1701 nt, Artificial Sequence; identical to SEQ ID NO: 125845
  derived and/or modified sequence opt3 from hemagglutinin__InfluenzaA__AFX96658

SEQ ID NO: 131750 - RNA, 1701 nt, Artificial Sequence
  derived and/or modified sequence opt3 from hemagglutinin__InfluenzaA__AFX96668
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcuccaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguaaagaaccuguacgagaagguucgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 131751 - RNA, 1701 nt, Artificial Sequence
  derived and/or modified sequence opt3 from hemagglutinin__InfluenzaA__AFX96678
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguagucaugcaggggccaagagcuuuuauaagaaucugaucuggcucgugaaaaagggaaacucuuacccuaaauuauccaagucauauauaaaugacaagggcaaagaaguacugguucuuuggggcauccaccacccaagcacgagugcugaucaacagucuuuguaccagaacgccgacgcguacguguucgucgggacuucccgcuauagcaagaaauuuaagcccgagauugcaauccgaccuaaagugcgugaucaggagggaagaaugaauuacuauuggacccugguggaaccaggugacaagauuacauucgaggccacuggcaaccuagucguucccagguacgcuuuugccauggaacggaacgcagggucgggaaucauaauuucugauaccccugugcaugacugcaauacaaccugucaaacgccaaaaggcgcuaucaacacuucccucccguuccagaauauucaccccaucacaaucgguaagugcccuaaguauguaaaaucaaccaagcugcgccuugccacugggcugagaaacgugccaaguauucagagcaggggauuguuuggcgcgauagccggcuucaucgaagggggauggacagguauggucgacggcugguacggguaucaucaccagaaugaacaaggauccggcuacgcagcugaucucaaaucuacccagaacgccauugacgagaucacgaauaaggugaacagcguuauagagaaaaugaauacccaguuuacagcuguggguaaggaguucaaccaccuggaaaagcggauugaaaauuuaaacaaaaaggucgaugacggguuccuggauaucuggacuuacaaugccgagcuccuugugcuguuggaaaacgagcgcacccuagacuaucaugauucaaauguuaaaaaccuguacgagaagguacgaagucagcucaaaaacaaugcaaaggaaaucggcaacggauguuuugaguucuaucacaagugcgacaauacauguauggaauccgugaaaaacggcacuuacgauuaucccaaguacagcgaggaagccaaacugaauagagaggagauugacggggucaaacuugaaucuaccaggaucuaucaaauucuggcuauauacucaacaguggcgaguagcuugguccucgugguuucccugggagcaaucucuuuuuggaugugcucgaacgguagcuuacagugccggauuuguaucuga

SEQ ID NO: 131752 - RNA, 1701 nt, Artificial Sequence
  derived and/or modified sequence opt3 from hemagglutinin__InfluenzaA__AFX96688
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugacugugagucuuugucaacagcaaguagcugguccuacauuguugaaaccucuucgucagauaacggaacuugcuauccaggcgacuuuaucgauuacgaggaacucagggagcagcugagcaguguguccucuuucgagcgguuugaaauguucccgaagacaagcuccuggcccaaucacgacucaaacaagggugucaccgccgcuuguccucaugcaggggccaaaaguuuuuauaagaaucugauuuggcucgugaaaaagggaaacagcuacccaaaauuaucuaaguccuauaucaaugauaagggcaaagagguacugguucuuuggggcauacaccaccccucaacgagcgcugaccaacagaguuuguaccagaacgccgaugcguacguguucgucgggacuucucgcuauuccaagaaauuuaagccugaaaucgcaauucgaccaaaagugcgugaccaggagggaagaaugaauuacuauuggacccugguggagcccggugauaagaucacauucgaagccacuggcaaccuagucguuccuagguacgcuuuugccauggagcggaacgacgggagcggaauuaucauaucggacaccccagugcaugauugcaauacaaccugucaaacgccgaaaggcgcaauuaacacuucucuccccuuccagaauauccacccuauuacaaucgguaagugcccaaaguauguaaaauccaccaagcugcgccuugcuacugggcugagaaacgugcccucaauccagaguaggggauuguuuggcgccauugcgggcuucauagaagggggauggacagguauggucgacggcugguacggguaucaucaccagaaugagcaaggaagcggcuacgccgcagaucucaaauccacccagaacgcuaucgacgaaauuacgaauaaggugaacucuguuaucgagaaaaugaauacccaguuuacagccguggguaaggaguucaaccaccuggaaaagcggauagagaauuuaaacaaaaaggucgaugacggguuccuggauauuuggacuuacaaugcugaacuccuugugcuguuggagaacgaacgcacccuagacuaucaugauagcaauguaaagaaccuguacgagaagguucgaucacagcucaaaaacaaugccaaggagaucggcaacggauguuuugaguucuaucacaagugcgacaauacauguauggaaagugugaaaaacggcacuuacgauuauccuaaguacuccgaagaggcaaaacugaauagagaagagaucgacggggucaaacuugagagcaccaggauuuaucaaauccuggccauuuacucuacaguggcuucaaguuugguccucgugguuagccugggagcgauauccuuuuggaugugcucuaacgguucguuacagugccggaucuguauuuga

SEQ ID NO: 131753 - RNA, 1701 nt, Artificial Sequence; identical to SEQ ID NO: 124685
  derived and/or modified sequence opt3 from hemagglutinin__InfluenzaA__AFX96698

SEQ ID NO: 131754 - RNA, 1701 nt, Artificial Sequence
  derived and/or modified sequence opt3 from hemagglutinin__InfluenzaA__AFX96718
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaaauaucuaaguccuauaucaaugacaagggcaaagaaguauuaguucuguggggcauucaccaccccucaacgagcgcugaucaacagagucuuuaccagaacgccgacacuuacguguucgucgggaccucucgcuauuccaagaaauuuaagccugagaucgcgauucgaccaaaagugcgugaucaggagggaagaaugaauuacuauuggacauugguggaacccggugacaagaucacuuucgaggcaaccggcaaccuggucguuccuagguacgccuuugcuauggaacggaacgccgggagcggaauaauuaucucggauacaccagugcaugacugcaauaccacgugucaaacuccgaaaggcgcaauuaacacaucucuacccuuccagaauauccacccuaucaccauugguaagugcccaaaguauguaaaauccacuaagcuccgccuggcuacagggcuuagaaacgugcccucaauacagaguaggggacuguuuggcgccaucgcgggcuucauugaagggggauggaccgguauggucgacggcugguacggguaucaucaccagaaugaacaaggaagcggcuacgccgcagauuugaaauccacgcagaaggcuaucgacgagauaaccaacaaaguuaauucugugauugagaagaugaacacacaguuuacugccguggguaaggaguucaaucaccucgaaaaacggaucgaaaaccugaauaagaaaaucgaugacggguucuuagauauuuggaccuacaacgcugagcugcucguccuucuggaaaaugagcgcacauuggacuaucaugauagcaacgugaagaaucuauacgagaaaguacgaucacagcugaagaacaacgccaaggaaaucggcaauggauguuuugaguucuaucacaaaugcgacaacacuuguauggaaaguguuaagaauggcaccuacgauuauccuaaauacuccgaggaagcaaagcucaacagagaggagauugacggggugaaacuggaaagcacaaggauauaucaaauccuugccauuuacucuaccgucgcuucaagucugguguuggucgugagccucggagcgaucuccuuuuggaugugcucuaaugguucgcugcagugccggaucuguauuuga

SEQ ID NO: 131755 - RNA, 1701 nt, Artificial Sequence; identical to SEQ ID NO: 131754
  derived and/or modified sequence opt3 from hemagglutinin__InfluenzaA__AFX96728

SEQ ID NO: 131756 - RNA, 1701 nt, Artificial Sequence; identical to SEQ ID NO: 125155
  derived and/or modified sequence opt3 from hemagglutinin__InfluenzaA__AFX96738

SEQ ID NO: 131757 - RNA, 1701 nt, Artificial Sequence
  derived and/or modified sequence opt3 from hemagglutinin__InfluenzaA__AFX96748
augaaggccauccuggugguccuccuuuacaccauugcuacagcaaacgccgacacucugugcauaggcuaucacgcgaauaacagcacggauaccguugacacagugaucgagaaaaauguaacugugacccauuccgucaacuuguuagaagauaagcacaaugggaaacuguguaagcuaagaggaguggcuccccuccaucuggguaaaugcaacauugccggcuggauccuugggaauccugagugugaaucucugucaacagcaaguagcugguccuacauuguugagaccucuucgucagacaacggaacuugcuauccaggcgauuucaucgacuacgaagaguugagggagcagcucagcaguguguccucuuuugaacgguucgagauguuuccgaagacaagcuccuggcccaaucacgauucaaacaagggugucaccgccgcuuguccucaugcaggggccaaaaguuucuauaagaaucugauauggcuggugaaaaagggaaacagcuacccaaaacucucuaaguccuauaucaaugacaagggcaaagaaguauuaguucuguggggcauucaccaccccucaacgagcgcugaucaacagagucuuuaccagaacgccgacgcguacguguuugucgggacuucucgcuauuccaagaaauucaagccugagaucgcaauucgaccaaaagugcgugaucaggagggaagaaugaauuacuauuggaccuugguggaacccggugacaagaucacauuugaggccacuggcaaccuggucguuccuagguacgcuuucgccauggaacggaacgcagggagcggaauaauuaucucggauaccccagugcaugacugcaauacaaccugucaaacgccgaaaggcgcuauuaacacuucucuacccuuucagaauauccacccuaucacaauugguaagugcccaaaguauguaaaauccaccaagcuccgccuggccacugggcuuagaaacgugcccucaauacagaguaggggacuguucggcgcgaucgccggcuuuauugaagggggauggacagguauggucgacggcugguacggguaucaucaccagaaugagcaaggaagcggcuacgcagcugauuugaaauccacccagaacgccaucgacgagauaacgaauaaggugaacucuguuauugagaaaaugaauacccaguucacagcuguggguaaggaauuuaaccaccucgagaagcggaucgaaaaucugaacaaaaaggucgaugacggguucuuagauaucuggacuuacaaugccgagcugcucgugcuucuggaaaacgagcgcaccuuggacuaucaugauagcaauguuaaaaaccuauacgagaagguacgaucacagcugaaaaacaaugcaaaggaaauuggcaacggauguuucgaguuuuaucacaagugcgacaauacauguauggaaagugugaaaaacggcacuuacgauuauccuaaguacuccgaggaagccaaacucaauagagaggagaucgacggggucaagcuggaaagcaccaggauuuaucaaauacuugcuaucuacucuacaguggcgucaagucuggucuuggugguuagccucggagcaauuuccuucuggaugugcucuaacgguucgcugcagugccggaucuguaucuga

SEQ ID NO: 131758 - RNA, 1701 nt, Artificial Sequence
  derived and/or modified sequence opt3 from hemagglutinin__InfluenzaA__AFX96758
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccgccgcuuguccucaugcaggggccaaaaguuuuuauaagaaucugauuuggcucgugaaaaagggaaacagcuacccaaaauuaucuaaguccuauaucaaugacaagggcaaagaaguacugguucuuuggggcauacaccaccccucaacgagcgcugaucaacagaguuuguaccagaacgccgacacuuacguguucgucgggaccucucgcuauuccaagaaauuuaagccugagaucgcgauucgaccaaaagugcgugaucaggagggaagaaugaauuacuauuggacacugguggaacccggugacaagaucacuuucgaggcaaccggcaaccuagucguuccuagguacgccuuugcuauggaacggaacgccgggagcggaauuaucauaucggauacaccagugcaugacugcaauaccacgugucaaacuccgaaaggcgcaauuaacacaucucuccccuuccagaauauccacccuauuaccaucgguaagugcccaaaguauguaaaauccacuaagcugcgccuugcuacagggcugagaaacgugcccucaauccagaguaggggauuguuuggcgccauugcgggcuucauagaagggggauggaccgguauggucgacggcugguacggguaucaucaccagaaugaacaaggaagcggcuacgccgcagaucucaaauccacgcagaacgcuaucgacgagauuaccaauaaggugaacucuguuaucgagaaaaugaauacacaguuuacugccguggguaaggaguucaaccaccuggaaaagcggauagaaaauuuaaacaaaaagauugaugacggguuccuggauaucuggaccuacaaugcugagcuccuuguccuguuggaaaacgagcgcacacuagacuaucaugauagcaaugugaaaaaccuguacgagaagguacgaucacagcucaaaaacaaugccaaggaaaucggcaacggauguuuugaguucuaucacaagugcgacaauacuuguauggaaaguguuaaaaacggcaccuacgauuauccuaaguacuccgaggaagcaaaacugaauagagaggagauugacggggugaaacuugaaagcacaaggaucuaucaaauucuggccauauacucuaccgucgcuucaaguuuggugcucgucgugagccugggagcgaucuccuuuuggaugugcucuaacgguucguuacagugccggauuuguaucuga

SEQ ID NO: 131759 - RNA, 1701 nt, Artificial Sequence
  derived and/or modified sequence opt3 from hemagglutinin__InfluenzaA__AFX96768
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaauuaguuggagcuacaucguugagaccuccucuucggacaacggaacuugcuauccaggcgauuuuauugacuacgaggagcucagggagcagcugucaagcgugaguuccuucgaacgguuugagaucuucccgaagacaucuagcuggcccaaucacgauuccaacaagggugucaccgccgcuuguccucaugcaggggccaaaucauuuuauaagaaucugauauggcucgugaaaaagggaaacaguuacccaaaauuaagcaagucuuauaucaaugacaagggcaaagaaguacugguucuuuggggcauucaccaccccuccacgucagcugaucaacagagcuuguaccagaacgccgacgcguacguguucgucgggaccagucgcuauucuaagaaauuuaagccugagaucgcaauucgaccaaaagugcgugaucaggagggaagaaugaauuacuauuggacucugguggaacccggugacaagaucacauucgaggccacuggcaaccuagucguuccuagguacgcuuuugccauggaacggaacgcaggguccggaauaauuaucagcgauaccccagugcaugacugcaauacaaccugucaaacgccgaaaggcgcuauuaacacuucgcuccccuuccagaauauccacccuaucacaauugguaagugcccaaaguauguaaaaucuaccaagcugcgccuugccacugggcugagaaacgugcccuccauacagucaaggggauuguuuggcgcgaucgccggcuucauugaagggggauggacagguauggucgacggcugguacggguaucaucaccagaaugaacaaggaaguggcuacgcagcugaucucaaaagcacccagaacgccaucgacgagauaacgaauaaggugaacuccguuauugagaaaaugaauacccaguuuacagcuguggguaaggaguucaaccaccuggaaaagcggaucgaaaauuuaaacaaaaaggucgaugacggguuccuggauaucuggacuuacaaugccgagcuccuugugcuguuggaaaacgagcgcacccuagacuaucaugauucuaauguaaagaaccuguacgagaagguucgaagccagcucaaaaacaaugcaaaggaaauuggcaacggauguuuugaguucuaucacaagugcgacaauacauguauggaaucagugaaaaacggcacuuacgauuauccuaaguacagugaggaagccaaacugaauagagaggagaucgacggggucaaacuugaauccaccaaaauuuaucaaauacuggcuaucuacagcacaguggcgucuucauugguccucgugguuagucugggagcaauuagcuuuuggaugugcuccaacgguucuuuacagugcaggaucuguaucuga

SEQ ID NO: 131760 - RNA, 1701 nt, Artificial Sequence
  derived and/or modified sequence opt3 from hemagglutinin__InfluenzaA__AFX96778
augaaggccauccuggugauucuccuuuacaccuucgcuacagcaaacgccgacacucugugcauaggcuaucacgcgaauaacagcacggauaccgucgacacaaucuuggagaaaaauguuacugugacccauuccguaaacuuacuggaagauaagcacaaugggaaacuauguaagcucagaggaguggcuccccugcaucuugguaaaugcaacauugccggcuggauccuggggaauccugagugugaaucuuugucaacagcaaguagcugguccuacauugucgagaccucuucgucagacaacggaacuugcuauccaggcgauuuuaucgacuacgaggagcucagggagcagcugagcaguguguccucuuucgaacgguuugagauauucccgaagacaagcuccuggcccaaucacgauucaaacaaggguguuaccgccgcuuguccucaugcaggggccaaaaguuuuuauaagaaucugaucuggcucgugaaaaagggaaacagcuacccaaaauuaucuaaguccuauauuaaugacaagggcaaagaaguccuggugcuuuggggcauccaccaccccucaacgagcgcugaucaacagaguuuguaccagaacgccgacgcguacguauucguugggacuucucgcuauuccaagaaauuuaagccugagauugcaauccgaccaaaagugcgugaucaggagggaagaaugaauuacuauuggacccuggucgaacccggugacaagauaacauucgaggccacuggcaaccuaguggugccuagguacgcuuuugccauggaacggaacgcagggagcggaauuaucauuucggauaccccaguccaugacugcaauacaaccugucaaacgccgaaaggcgcuaucaacacuucucuccccuuccagaauauccacccuauuacaauagguaagugcccaaaguauguuaaauccaccaagcugcgccuugccacugggcugagaaacgugcccucaauccagaguaggggauuguuuggcgcgauugccggcuucaucgaagggggauggacagguaugguagacggcugguacggguaucaucaccagaaugaacaaggaagcggcuacgcagcugaucucaaauccacccagaacgccauagacgagauuacgaauaaggugaacucugucaucgagaaaaugaauacccaguuuacagcuguggguaaggaguucaaccaccuggaaaagcggaucgaaaauuuaaacaaaaagguugaugacggguuccuggauauuuggacuuacaaugccgagcuccuugugcuguuggaaaacgagcgcacccuagacuaucaugauagcaaugucaaaaaccuguacgagaaggugcgaucacagcucaaaaacaaugcaaaggaaaucggcaacggauguuuugaguucuaucacaagugcgacaauacauguauggaaaguguaaagaacggcacuuacgauuauccuaaguacuccgaggaagccaaacugaauagagaggagauugacgggguuaaacuugaaagcaccaggauauaucaaauccuggcuauuuacucuacaguggcgucaaguuugguccucguggucagccugggagcaaucuccuuuuggaugugcucuaacgguucguuacagugccggaucuguauuuga

SEQ ID NO: 131761 - RNA, 1701 nt, Artificial Sequence
  derived and/or modified sequence opt3 from hemagglutinin__InfluenzaA__AFX96788
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggagaaaaacgcagggagcggaaucauaauuucggauaccccagugcaugacugcaauacaaccugucaaacgccgaagggcgcuaucaacacuucucuccccuuccagaauauucacccuaucacaaucgguaagugcccaaaauauguaaaguccaccaaacugcggcuugccacugggcugcgcaacgugcccucaauucagaguagaggauuguuuggcgcgauagccggcuucaucgaagggggauggacagguauggucgacggcugguacggguaucaucaccagaaugaacaaggaagcggcuacgcagcugaucucaaguccacccagaacgccauugacaaaaucacgaauaaggugaacucuguuauagagaagaugaauacccaguuuacagcuguggguaaagaguucaaccaccuggaaaagaggauugagaauuuaaacaaaaaggucgaugacggguuccuggauaucuggacuuacaaugccgaacuccuugugcuguuggagaacgaacggacccuagacuaucaugauagcaauguaaagaaccuguacgagaagguucgcucacagcucaagaacaaugcaaaagagaucggcaacggauguuuugaguucuaucacaagugcgacaauacauguauggagagugugaaaaacggcacuuacgauuauccuaaguacuccgaagaggccaaacugaaucgagaagagauugacggggucaaacuugagagcaccagaaucuaucaaauucuggcuauauacucuacaguggcgucaaguuugguccucgugguuagccugggagcaaucuccuuuuggaugugcucuaacgguucguuacagugcaggauuuguaucuga

SEQ ID NO: 131762 - RNA, 1701 nt, Artificial Sequence; identical to SEQ ID NO: 131761
  derived and/or modified sequence opt3 from hemagglutinin__InfluenzaA__AFX96798

SEQ ID NO: 131763 - RNA, 1701 nt, Artificial Sequence; identical to SEQ ID NO: 125845
  derived and/or modified sequence opt3 from hemagglutinin__InfluenzaA__AFX96808

SEQ ID NO: 131764 - RNA, 1701 nt, Artificial Sequence; identical to SEQ ID NO: 128925
  derived and/or modified sequence opt3 from hemagglutinin__InfluenzaA__AFX96818

SEQ ID NO: 131765 - RNA, 1701 nt, Artificial Sequence; identical to SEQ ID NO: 131761
  derived and/or modified sequence opt3 from hemagglutinin__InfluenzaA__AFX96828

SEQ ID NO: 131766 - RNA, 1701 nt, Artificial Sequence; identical to SEQ ID NO: 127282
  derived and/or modified sequence opt3 from hemagglutinin__InfluenzaA__AFX96838

SEQ ID NO: 131767 - RNA, 1701 nt, Artificial Sequence
  derived and/or modified sequence opt3 from hemagglutinin__InfluenzaA__AFX96856
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguacgcaugcaggggccaaaaguuuuuauaagaaucugaucuggcucgugaaaaagggaaacagcuacccuaaauuaucuaaguccuauauaaaugacaagggcaaagaaguacugguucuuuggggcauccaccacccaucaacuagcgcugaucaacagaguuuguaccagaacgccgacgcguacguguucgucgggaccucucgcuauuccaagaaauuuaagcccgagauugcaauccgaccuaaagugcgugaucaggagggaagaaugaauuacuauuggacacugguggaaccaggugacaagauuacuuucgaggccaccggcaaccuagucguucccagguacgcuuuugccauggaacggaacgcagggagcggaaucauaauuucggauacaccugugcaugacugcaauaccacgugucaaacuccaaaaggcgcuaucaacacaucucucccguuccagaauauucaccccaucaccaucgguaagugcccuaaguauguaaaauccacuaagcugcgccuugccacagggcugagaaacgugccaucaauucagaguaggggauuguuuggcgcgauagccggcuucaucgaagggggauggaccgguauggucgacggcugguacggguaucaucaccagaaugaacaaggaagcggcuacgcagcugaucucaaauccacgcagaacgccauugacgagaucaccaauaaggugaacucuguuauagagaaaaugaauacacaguuuacugcuguggguaaggaguucaaccaccuggaaaagcggauugaaaauuuaaacaaaaaggucgaugacggguuccuggauaucuggaccuacaaugccgagcuccuugugcuguuggaaaacgagcgcacacuagacuaucaugauagcaauguaaagaaccuguacgagaagguucgaucacagcucaaaaacaaugcaaaggaaaucggcaacggauguuuugaguucuaucacaagugcgacaauacuuguauggaaagugugaaaaacggcaccuacgauuaucccaaguacuccgaggaagccaaacugaauagagaggagauugacggggucaaacuugaaagcacaaggaucuaucaaauucuggcuauauacucuaccguggcgucaaguuugguccucgugguuagccugggagcaaucuccuuuuggaugugcucuaacgguucguuacagugccggauuuguaucuga

SEQ ID NO: 131768 - RNA, 1701 nt, Artificial Sequence; identical to SEQ ID NO: 131750
  derived and/or modified sequence opt3 from hemagglutinin__InfluenzaA__AFX96904

SEQ ID NO: 131769 - RNA, 1701 nt, Artificial Sequence; identical to SEQ ID NO: 126185
  derived and/or modified sequence opt3 from hemagglutinin__InfluenzaA__AFX96914

SEQ ID NO: 131770 - RNA, 1701 nt, Artificial Sequence
  derived and/or modified sequence opt3 from hemagglutinin__InfluenzaA__AFX96924
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagcgauuuaaaccugagauugcaauccguccaaaggugagagaucaggagggaaggaugaauuacuauuggacccugguggaacccggugacaaaauuacauucgaggccacuggcaaccuagucguuccucgguacgcuuuugccauggaacgcaacgcagggagcggaaucauaauuucggauaccccagugcaugacugcaauacaaccugucaaacgccgaagggcgcuaucaacacuucucuccccuuccagaauauucacccuaucacaaucgguaaaugcccaaaguauguaaaguccaccaaacugagacuugccacugggcugaggaacgugcccucaauucagagucggggauuguuuggcgcgauagccggcuucaucgaagggggauggacagguauggucgacggcugguacggguaucaucaccagaaugaacaaggaagcggcuacgcagcugaucucaaguccacccagaacgccauugacgagaucacgaauaaagugaacucuguuauagagaagaugaauacccaguuuacagcuguggguaaagaguucaaccaccuggaaaagcgcauugaaaauuuaaacaagaaagucgaugacggguuccuggauaucuggacuuacaaugccgagcuccuugugcuguuggaaaacgagcgaacccuagacuaucaugauagcaauguaaagaaccuguacgagaaaguuagaucacagcucaagaacaaugcaaaagaaaucggcaacggauguuuugaguucuaucacaagugcgacaauacauguauggaaagugugaagaacggcacuuacgauuauccuaaauacuccgaggaagccaagcugaauagggaggagauugacggggucaaacuugaaagcacccggaucuaucaaauucuggcuauauacucuacaguggcgucaaguuugguccucgugguuagccugggagcaaucuccuuuuggaugugcucuaacgguucguuacagugccguauuuguaucuga

SEQ ID NO: 131771 - RNA, 1701 nt, Artificial Sequence; identical to SEQ ID NO: 124685
  derived and/or modified sequence opt3 from hemagglutinin__InfluenzaA__AFX96934

SEQ ID NO: 131772 - RNA, 1701 nt, Artificial Sequence
  derived and/or modified sequence opt3 from hemagglutinin__InfluenzaA__AFY24097
augaaggccauccuggugguccuccuuuacaccuucgcuacagcaaacgccgacacucugugcauuggcuaucacgcggauaauagcacggacaccguugauacaguguuggagaagaacguaacugugacccauuccgucgacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgucaacugaucaacagagcuuguaccagaaugcugacgccuacguguucgucgggaccagucgcuauucuaagaaauuuaagccugagauugcgauccgaccaaaagugcgugaucaggagggaagaaugaacuacuauuggacacugguggaacccggugacaagauuacuuucgaggcaaccggcaaucuagucguuccuagguacgccuuugcuauggaacggaacgccggguccggaaucauaauuagcgacacaccagugcaugauugcaacaccacgugucaaacuccgaaaggcgcaaucaauacaucgcuccccuuccagaacauucacccuaucaccaucgguaagugcccaaaguauguaaaaucuacuaagcugcgccuugcuacagggcugagaaaugugcccuccauucagucaaggggauuguuuggcgccauagcgggcuucaucgaagggggauggaccgguauggucgacggcugguacggguaucaucaccagaacgaacaaggaaguggcuacgccgcagaucucaaaagcacgcagaaugcuauugacgagaucaccaacaagguaaauuccguuauagagaaaaugaacacacaguuuacugccguggguaaggaguucaaucaccuggaaaagcggauugaaaacuuaaauaaaaaggucgaugacggguuccuggauaucuggaccuacaacgcugagcuccuugugcuguuggaaaaugagcgcacacuagacuaucaugauucuaacgugaaaaaucuguacgagaagguucgaagccagcucaaaaacaacgccaaggaaaucggcaauggauguuuugaguucuaucacaagugcgacaacacuuguauggaaucagugaaaaauggcaccuacgauuauccuaaguacagugaggaagcaaaacugaacagagaggagauugacggggucaaacuugaauccacaaggaucuaucaaauucuggccauauacagcaccguggcuucuucauugguccucgugguuagucugggagcgaucagcuuuuggaugugcuccaaugguucuuuacagugccggauuuguaucuga

SEQ ID NO: 131773 - RNA, 1701 nt, Artificial Sequence; identical to SEQ ID NO: 122646
  derived and/or modified sequence opt3 from hemagglutinin__InfluenzaA__AFY24162

SEQ ID NO: 131774 - RNA, 1701 nt, Artificial Sequence
  derived and/or modified sequence opt3 from hemagglutinin__InfluenzaA__AFY24195
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacagguggcauuugcgacagcccacaccagauccuagauggggagaauuguacccucauagacgcucugcuuggagauccgcagugcgacggcuuucaaaacaaaaagugggaucuguucguggaaagauccaaagccuauucuaauuguuaccccuaugacgucccugauuacgcaucguugaggucacucguggccagcagugguacucuggaguuuaacaaugaauccuucaacuggacagggguuacccagaauggaacgucuagcgcuugcaagcggcgcuccaacaauucauuuuucagucgacugaacuggcucacucauuuaaaguuuaaauauccagcacugaaugugaccaugcccaacaacgagaaguucgacaaacuuuacaucuggggcguccaccauccuggcacagauaaugaccagaucuuuuuguaugcccaggcuagcgggcguauuacugugucuaccaagagaucccaacagacaguaauuccaaacaucggaucaaggccccggauacgcaauauuccuagcagaaucaguauuuacuggaccaucguuaaaccaggugauauccugcuaauuaacucuacgggcaaucucauagccccgaggggguacuucaagauccgguccggaaagagcucgauuaugcgcucugacgcgcccaucggcaaauguaacuccgagugcauaacuccuaaugguucaauuccaaacgacaagcccuuucagaaugugaaccgaaucacauauggggcauguccuagauacgucaaacagaauacccugaagcuggccacuggaaugaggaacgugccagaaaaacaaacacggggcaucuucggcgcuauugccggguuuaucgagaauggaugggaagguaugguggauggcugguauggguuccgucaccagaacagugagggaauuggccaggcagcugaccuuaagagcacccaagccgcgauaaaucagaucaacgguaaauugaaccgccucauugggaagacgaaugagaaguuccaccagaucgaaaaagaguuuuccgaagucgagggcagaauccaggaucuggaaaaguacguugaggacaccaaaauugauuuauggucuuauaacgccgagcugcucguggcacuugaaaaucaacauacaauagaccugacugauagcgagaugaacaaguuguucgaaaggaccaaaaagcagcuacgggagaaugcugaagacaugggaaacggcugcuuuaagaucuaccacaaaugugauaaugccugcauugggucaauccgaaacggaacauaugaccaugauguauaccgcgacgaggcucugaauaacagauuccagauuaaggguguggagcucaaaaguggcuacaaggacuggauccuguggauauccuuugccaucagcugcuuccuucugugugucgcauugcucggguuuauuaugugggccugccagaaaggaaauaucagguguaacauuugcaucuga

SEQ ID NO: 131775 - RNA, 1701 nt, Artificial Sequence; identical to SEQ ID NO: 122201
  derived and/or modified sequence opt3 from hemagglutinin__InfluenzaA__AFY24217

SEQ ID NO: 131776 - RNA, 1701 nt, Artificial Sequence
  derived and/or modified sequence opt3 from hemagglutinin__InfluenzaA__AGB08294
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaauaaagucuuauaucaacgauaagggcaaagaaguacugguucuuuggggcauucaucaccccuccacgucagcugaccagcagagcuuguaccagaaugccgaugcguacguguucgucgggaccaguaaguauucuaaaaaguuuaaaccugagaucgcagugcgcccaaaggugcgagaccaagagggacguaugaacuacuauuggacucuggucgaacccggugauaaaauuacauucgaggccacuggcaaccuacucguuccuagauacgcuuuugugauggaaaggaaugccggguccggaaucauaauuagcgacaccccaguacacgauugcaacacaaccugucagacgccgaagggcgcaaucaauacuucgcugcccuuccagaacauucauccuaucacaaucgguaagugcccaaaauaugugaagucuaccaaacuucggcuggcuacuggguugcgcaauauucccuccauacagucaagaggacucuuuggcgccaucgcgggcuucauugaagggggauggacagguauggucgacggcugguacggguaucaccaucaaaacgcccagggaaguggcuacgcagcugaccuuaagagcacccagaaugccaucgauaaaauaacgaacaagguaaauuccguuauugaaaagaugaacacccaguuuacagcuguggguaaagaguucaaucacuuagagaagaggaucgaaaaccugaauaaaaaggucgacgauggguuccucgacaucuggacuuacaacgccgagcuucugguguugcuagaaaaugagcggacccuggauuaucacgacucuaacgugaaaaaccucuacgaaaagguucgcagccaacugaagaauaacgcaaaagagauuggcaauggauguuuugaguucuaucauaagugcgauaacacauguauggaaucagugaaaaauggcacuuacgacuauccucgauacagugaggaagccaagcugaacagagaggaaaucgauggggucaaacuggaguccaccaggauuuaucagauauuggcuaucuacagcacaguggcgucuucacucguccuggugguuaguuuaggagcaauuagcuuuuggaugugcuccaaugguucucugcagugccggaucuguaucuga

SEQ ID NO: 131777 - RNA, 1701 nt, Artificial Sequence
  derived and/or modified sequence opt3 from hemagglutinin__InfluenzaA__AGB08295
augaaggccauccuggugguccuccuuuacaccuucgcuacagcaaacgccgacacucugugcauuggcuaucacgcgaauaacagcacggauaccguugacacagugauagagaaaaauguaacugugacccauuccgucaacuuguuagaagauaagcacaaugggaaacuguguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauuaauuacgaagaguugagggagcagcucagcaguguguccucuuucgaacgguuugagaucuucccgaagacaagcuccuggcccaaccacgacucaaauaagggugucaccgccgcuuguccucaugcaggggccaaaaguuuuuauaagaaccugauauggcuggugaaaaagggaaauagcuacccaaaacucucuaaguccuauaucaacgauaagcgcaaagaaguauuaguucuguggggcauucaccaccccucaacgacugcugaccaacagagccuuuaccagaaugccgaugcguacguguucgucggcaccagucgauauucuaagaaauuuaagccugagaucgcaauucguccaaaagugagagaccaggaggggaggaugaacuacuauuggacauugguggaacccggagauaagaucacuuucgaggccaccgguaaccuggucguuccucgguacgcuuuugccauggaacgcacagcaggcuccgggauaauuaucagcgacaccccagugcaugauugcaauacgacuugucaaacaccgaaaggagcuauuaacaccucgcuacccuuccagaauauccacccuaucacuauuggcaagugcccaaaguauguaaaaucuacaaagcucagacuggccaccggucuuaggaacauacccuccauccagucacgggggcuguuuggagcgauugccggcuucaucgagggcggguggacgggaaugguggacgguugguacggcuaucaucaccagaaugaacaagggaguggauacgcagcugacuugaaaagcacccagaacgccauagauaagauuacaaauaaagucaacuccgugaucgagaagaugaauacucaguuuaccgcuguuggcaaggaguucaaccaccucgaaaaacgcaucgagaaucugaacaagaaaguggacgaugguuucuuagacauuuggacauacaaugccgaacugcucguccuucuggagaacgaacgaacuuuggauuaucaugacucuaaugugaagaaccuauacgagaaaguaagaaaccagcugaagaauaacgcaaaggagaucgggaauggcuguuuugaguucuaucacaaaugcgauaacaccuguauggaaagcguuaagaauggaacauacgacuauccuaaauacucagaagaggccaagcucaacagggaagagauugauggcgugaaacuggagaguacccggauauaucaaauccuugcuauuuacuccacugucgcgagcucucugguguuggucgugucacucggggcaaucaguuuuuggaugugcagcaauggaucccugcagugccguaucuguauuuga

SEQ ID NO: 131778 - RNA, 1701 nt, Artificial Sequence
  derived and/or modified sequence opt3 from hemagglutinin__InfluenzaA__AGB08296
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcguggacaggaggguagaaugaacuacuauuggacacugguggaacccggcgacaagauuacuuucgaggccaccgggaaccuagucguuccuagguacgcuuuugccauggaacggacagcaggauccggcaucauaauuagcgauaccccagugcaugacugcaauacgacuugucaaacaccgaaaggugcuaucaacaccucgcuccccuuccagaauauucacccuaucacuaucgggaagugcccaaaguauguaaaaucuacaaagcugcgccuugccaccggacugagaaacgugcccuccauucagucaaggggcuuguuuggcgcgauagccggguucaucgagggagguuggacgggcauggucgaugggugguacggauaucaucaccagaaugaacaaggcagugguuacgcagcugaccucaaaagcacccagaacgccauugacaagaucacaaauaaagugaacuccguuauagagaagaugaauacucaguuuaccgcuguggggaaggaguucaaccaccuggaaaaacggauugagaauuuaaacaagaaagucgaugacggcuuccuggauaucuggacauacaaugccgaacuccuugugcuguuggagaacgaacgcacucuagacuaucaugauucuaauguaaagaaccuguacgagaaaguucgaaaccagcucaagaauaacgcaaaggagaucggaaauggcuguuuugaguucuaucacaaaugcgacaacaccuguauggagagcgugaagaaugggacauacgauuauccuaaauacucagaagaggccaagcugaacagagaagagauugacggagucaaacuugagaguaccaggaucuaucaaauucuggcuauauacuccacuguggcgagcucuuugguccucgugguuucacugggugcaaucaguuuuuggaugugcagcaauggcuccuuacagugccggauuuguaucuga

SEQ ID NO: 131779 - RNA, 1701 nt, Artificial Sequence
  derived and/or modified sequence opt3 from hemagglutinin__InfluenzaA__AGB08297
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucugaauccuauauaaacgauaagggcaaggagguacugguucuuuggggcauccaccaccccucaacgacugcugaccaacagagcuuguaccagaaugccgaugcguacguguucgucgggaccagucgcuauucuaaaaaguuuaaaccugagauugcaauccgaccaaaggugcgugaccaggaaggaagaaugaacuacuauuggacacugguggagcccggugauaaaauuacuuucgaagccaccggcaaccuagucguuccuagguacgcuuuugccauggagcggacagcaggguccggaaucauaauuagcgacaccccagugcaugauugcaauacgacuugucaaacaccgaagggcgcuaucaacaccucgcuccccuuccagaauauucacccuaucacuaucgguaaaugcccaaaguauguaaagucuacaaaacugcgccuugccaccgggcugagaaacgugcccuccauucagucaaggggauuguuuggcgcgauagccggcuucaucgaagggggauggacggguauggucgacggcugguacggguaucaucaccagaaugagcaaggaaguggcuacgcagcugaccucaagagcacccagaacgccauugauaaaaucacaaauaaggugaacuccguuauagagaaaaugaauacucaguuuaccgcuguggguaaggaguucaaccaccuggagaagcggauugaaaauuuaaacaaaaaggucgacgauggguuccuggacaucuggacauacaaugccgagcuccuugugcuguuggaaaacgagcgcacucuagauuaucaugacucuaauguaaagaaccuguacgagaagguucgaaaccagcucaaaaauaacgcaaaggaaaucggcaauggauguuuugaguucuaucacaagugcgauaacaccuguauggaaagcgugaaaaauggcacauacgacuauccuaaguacucagaggaagccaaacugaacagagaggagauugauggggucaaacuugaaaguaccaggaucuaucaaauucuggcuauauacuccacuguggcgagcucuuugguccucgugguuucacugggagcaaucaguuuuuggaugugcagcaaugguuccuuacagugccggauuuguaucuga

SEQ ID NO: 131780 - RNA, 1701 nt, Artificial Sequence
  derived and/or modified sequence opt3 from hemagglutinin__InfluenzaA__AGB08298
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaauagcuccccugcaucuugguaaaugcaacaucgccggcuggauucuggggaauccugagugugaaucuuugucaacagcaaguagcugguccuacaucguggagaccucuucgucagacaacggaacuugcuauccaggcgauuuuauuaauuacgaggagcucagggagcagcugagcaguguuuccucuuucgaacgguuugagaucuucccgaagacaagcuccuggcccaaccacgacucaaauaagggugugaccgccgcuuguccucaugcaggggccaaaaguuuuuauaagaaccugauauggcucgucaaaaagggaaauagcuacccacgcuuaucuaaauccuauaucaacgauaagggcaaggaagugcugguacuuuggggcauucaccaccccucaacgacugcugaccaacagagcuuguaccagaaugccgaugcguacguuuucguggggaccagucgauauucuaaaaaguuuaaaccugagaucgcaauucguccaaaggucagagaccaggagggaaggaugaacuacuauuggacacugguggaacccggugauaaaaucacuuucgaggccaccggcaaccuaguggucccucgguacgcuuuugccauggaacgcacagcaggguccggaauaauuaucagcgacaccccaguucaugauugcaauacgacuugucaaacaccgaagggcgcuauuaacaccucgcuccccuuccagaauauccacccuaucacuauugguaaaugcccaaaguaugugaagucuacaaaacugagacuugccaccgggcugaggaacguacccuccauacagucacggggauuguuuggcgcgaucgccggcuucauugaagggggauggacggguaugguggacggcugguacggguaucaucaccagaaugaacaaggaaguggcuacgcagcugaccucaagagcacccagaacgccaucgauaaaauaacaaauaaggucaacuccgugauugagaaaaugaauacucaguuuaccgcuguugguaaggaguucaaccagcuggaaaagcgcaucgagaauuuaaacaaaaagguggacgauggguuccuggacaucuggacauacaaugccgaacuccuuguccuguuggagaacgaacgaacucuagauuaucacgacucuaaugugaaaaaccuguacgagaagguaagaaaccaacucaaaaauaacgcaaaggagauuggcaauggauguuuugaguucuaucauaagugcgauaacaccuguauggaaagcguuaaaaauggcacauacgacuauccuaaguacucagaagaggccaaacugaacagggaagagaucgauggggugaaacuugagaguacccggauuuaucagauacuggcuaucuacuccacugucgcgagcucuuuggugcucgucgugucacugggagcaauuaguuuuuggaugugcagcaaugguuccuuacagugccguaucuguaucuga

SEQ ID NO: 131781 - RNA, 1701 nt, Artificial Sequence
  derived and/or modified sequence opt3 from hemagglutinin__InfluenzaA__AGB08301
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacagucgugaagccaggagauauucugcuaaucaacucuaccgguaaucucaucgcgccgaggggcuacuucaaaauucgguccggaaagagcucgauaaugcgcucugacgcacccaucgggaaauguaacuccgccugcauuacgccuaauggcucaaucccaaacgacaagcccuuucagaaugugaaccgaauaacuuacggugcuuguccuagauaugucaagcaaaauacacugaaacuugccaccgggaugaggaacguuccagagaagcagacucggggaauuuucggcgcaaucgcuggcuuuaucgaaaaugggugggagggaaugguggaugguugguacggcuuccgucaccagaacagugaggggcgcggacaagccgcggaccugaaaagcacacaggccgcaauugaucagaucaauggcaaguugaacagacucauugguaaaaccaacgaaaaguuccaucagauagagaaagaauuuuccgagguagaagggaggauccaagaccuggagaaguauguggaggauacgaagauugacuuauggucuuacaaugcugaacugcucgucgcccuugagaaccagcacaccaucgaucugacagacagcgaaaugaauaaauuguucgagaagacuaaaaagcagcuacgggaaaacgcugaggauaugggcaauggaugcuuuaaaaucuaucauaagugugacaacgccugcauuggcucaauacgaaaugggaccuacgaucacaacguguaucgcgacgaggcacugaauaacagauuccagaucaagggaguugaacucaaaagugguuacaaggacuggauucuguggaucuccuuugccauuagcugcuuccuucuguguguggcuuugcucggcuuuaucaugugggcgugccaaaaagggaauauaagguguaacaucugcauuuga

SEQ ID NO: 131782 - RNA, 1701 nt, Artificial Sequence
  derived and/or modified sequence opt3 from hemagglutinin__InfluenzaA__AGB08343
augaagaccaucauugcccugagcuacauauucugccucgugcuugcucaggaccugcccggcaacgauaauuccacagcaacuuuguguuuagggcaccaugccgucccuaacggaacgcugguuaaaaccaucacaaaugaccaaauugaggugacuaacgcgaccgaacuuguacagucuucaaguacagguagaaucugcaauaacccacacaggauucucgauggcaucaauuguacccugauagacgcccuucugggggauccgcauugcgacggauuucagaacaagaaaugggauuuguucguggagcggagcaaggcuuuuuccaauuguuaucccuacgacgucccugauuaugcaucucuccgcucgcugguggccucaagcggcacucuggaguucaucaacgaagguuuuaauuggacagggguuacccagaacggaggcaguuacgcuugcaaacgaggcccagacaauggguucuuuucccgucucaacugguuauauaagucugaaagcacguaccccgugcugaaugucacuaugccuaacaacgauaauuucgacaagcuauauauuuggggagugcaccauccauccaccgauaaagagcaaacaaacuuguacguacaggcaucagguagaguuacugugaguaccaagaggagccagcagacaaucauucccaaugucggcucucggccuugggugcgcgggcuguccucaagaaucagcauauacuggaccauugugaaaccaggagacauccuagucauuaacaguaauggcaaccucaucgccccgagggguuauuuuaagauccggaaugggaaaucuuccauuaugcgcagcgacgcucccauaggaacguguucgucugagugcaucacuccuaacggcuccauuccaaaugauaagcccuuccaaaacguuaauaagaucacauacggcgccuguccuaaauaugugaagcagaacacccugaaacuugcgacugggaugcgaaauguaccagaaaagcagacaagaggaauauuuggugcaauugccggcuucaucgagaacgggugggaaggaaugaucgacggcugguacgguuuuaggcaccaaaauucagaggggaccggccaggcugccgaucugaaaaguacgcaggcagcuauugaccagaucaacggaaaguugaaccgggugauugagaaaaccaaugaaaaguuccaccaaauagagaaggaguucagcgaagucgaaggccguauccaggaucucgagaaauauguggaggacacaaagauugaucugugguccuacaacgccgaauuacugguugcgcucgagaaucagcauacuaucgaccuuaccgauucugaaaugaacaaacuguuugagaagacacgcagacaguugagggaaaaugccgaggacauggggaacggaugcuucaaaaucuaucacaagugugauaaugcaugcauugguagcauacggaacggcacuuacgaccaugacguguaccgagaugaggcucuaaauaaccgcuuucaaaucaagggggucgaacugaaaucaggauauaaggacuggauucucuggaucaguuucgccauuuccugcuuucugcuuugugugguacuguugggcuucaucaugugggcuugccagaaagguaauauaagauguaacaucugcauuuga

SEQ ID NO: 131783 - RNA, 1701 nt, Artificial Sequence
  derived and/or modified sequence opt3 from hemagglutinin__InfluenzaA__AGB08362
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucaacuguacccugauagaugcucuacugggagacccgcauugcgauguauuucaggacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcgugcaccauccaucaacaaaucaagagcagaccaguuuguacguacaggcaagcgggcguguuacggugucuacuagaaggucccagcaaacaaucauucccaacaucggaucacggccuuggguccgcggccugagcaguagaauaucuauuuauuggaccaucgugaagccaggugacgugcuagucauuaacuccaaugggaaccucaucgccccgaggggauacuuuaaaaugcggacuggcaagagcucgaucaugcgcucugacgcucccauugauacauguauauccgagugcaucaccccuaauggcucaauuccaaacgacaaacccuuccagaauguuaacaagaucacguacggggccuguccuaaauaugugaagcagaauacccugaaacuugcgacaggaaugcgaaacguaccagaaaagcagacuagaggucuguuuggcgcaauagccggguucauugagaauggaugggaaggcaugaucgaugguugguacggguuuaggcaccaaaacagugagggcaccggacaggcugccgaccuuaagagcacacaggcagcuaucgaucaaauuaauggcaaacucaaccgggugaucgagaagacuaaugaaaaauuccaccagauugagaaggaguucuccgaagucgaagggcguauacaggaccuggagaaauauguggaggauaccaagaucgacuuauggucuuacaacgccgaacugcucguugcgcuugagaaucagcauacaauugaucugaccgacagcgaaaugaacaaguuguuugauaaaacucgcagacaacuaagggagaacgccgaagacaugggaaaugguugcuucaagaucuaucacaaaugugacaacgcaugcaucgagucaauucggaauggcacguacgaucaugacguguaucgagaugaggcucugaacaaucgcuuucagauaaagggggucgaacucaaaaguggauacaaggacuggauccuguggauuuccuucgccaucagcugcuuucuucugugugugguauugcucggcuucauuaugugggcuugccagagagguaacaucagguguaauauaugcaucuga

SEQ ID NO: 131784 - RNA, 1701 nt, Artificial Sequence; identical to SEQ ID NO: 128838
  derived and/or modified sequence opt3 from hemagglutinin__InfluenzaA__AGB12986

SEQ ID NO: 131785 - RNA, 1701 nt, Artificial Sequence; identical to SEQ ID NO: 129102
  derived and/or modified sequence opt3 from hemagglutinin__InfluenzaA__AGB13006

SEQ ID NO: 131786 - RNA, 1701 nt, Artificial Sequence
  derived and/or modified sequence opt3 from hemagglutinin__InfluenzaA__AGB13016
augaaggccauccuggugguccuccuuuacaccauugcuacagcaaacgccgacacucugugcauaggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacaucgccggcuggauucuggggaauccugagugugaaucuuugucaacagcaaguagcugguccuacaucguugagaccucuucgucagacaacggaacuugcuauccaggcgauuucauuaauuacgaggagcucagggagcagcugagcaguguguccucuuuugaacgguucgagaucuuuccgaagacaagcuccuggcccaaccacgacucaaauaagggugucaccgccgcuuguccucaugcaggggccaaaaguuucuauaagaaccugauauggcucgugaaaaagggaaauagcuacccaaaauuaucuaaguccuauaucaacgauaagggcaaagaaguacugguucuuuggggcauucaccaccccucaacgacugcugaccaacagagcuuguaccagaaugccgaugcguacguguuugucgggaccagucgcuauucuaagaaauucaagccugagaucgcaauucgaccaaaagugcgugaccaggagggaagaaugaacuacuauuggacacugguggaacccggugauaagaucacuuuugaggccauaggcaaccuagucguuccuagguacgcuuucgccauggaaaagaaugcaggguccggaauuaucauuagcgacaccccagugcaugauugcaacacaaccugucaaacgccgaagggcgcuaucaauacuucgcuccccuuucagaacauccacccuauuacaauagguaagugcccaaaauauguaaagucuaccaaacugcggcuugccacugggcugcgcaaugugcccuccauccagucaagaggauuguucggcgcgauugccggcuuuaucgaagggggauggacagguauggucgacggcugguacggguaucaucaccagaacgaacaaggaaguggcuacgcagcugaccucaagagcacccagaaugccauagauaaaauuacgaacaagguaaauuccguuaucgagaagaugaacacccaguucacagcuguggguaaagaguuuaaucaccuggaaaagaggaucgagaacuuaaauaaaaaggucgacgauggguuccuggacauuuggacuuacaacgccgaacuccuugugcuguuggagaaugaacggacccuagauuaucaugacucuaacgugaaaaaccuguacgagaagguucgcaaucagcucaagaacaaugcaaaagagaucggcaacggauguuucgaauuuuaucacaagugcgauaauacauguauggagagcgugaaaaacggcacuuacgacuauccuaaguacucagaagaggccaaacugaaucgagaagagauugauggggucaaacuugagagugcuagaguguaucaaauacuggcgaucuacuccaccgucgcaagcucuuuggugcucguugugucacugggagccauuaguuucuggaugugcagcaacgguuccuuacagugcaggaucuguaucuga

SEQ ID NO: 131787 - RNA, 1701 nt, Artificial Sequence; identical to SEQ ID NO: 128883
  derived and/or modified sequence opt3 from hemagglutinin__InfluenzaA__AGB13026

SEQ ID NO: 131788 - RNA, 1701 nt, Artificial Sequence; identical to SEQ ID NO: 128825
  derived and/or modified sequence opt3 from hemagglutinin__InfluenzaA__AGB13036

SEQ ID NO: 131789 - RNA, 1701 nt, Artificial Sequence
  derived and/or modified sequence opt3 from hemagglutinin__InfluenzaA__AGB13048
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcgauaauacuuguauugaaagcgugaagaacggcaccuacgacuauccuaaauacucagaagaggccaagcugaauagagaagagaucgauggggucaaacuugagaguacaaggauuuaucaaauacuggcuaucuacuccaccguggcgagcucuuugguccucgugguuucacugggagcaauuaguuuuuggaugugcagcaacgguuccuuacagugccggaucuguaucuga

SEQ ID NO: 131790 - RNA, 1701 nt, Artificial Sequence
  derived and/or modified sequence opt3 from hemagglutinin__InfluenzaA__AGB13066
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggacuucucgcuauuccaagaaauuuaagccugagauugcaauccgaccaaaagugcgugaucaggagggaagaaugaauuacuauuggacccugguggaacccggugacaagauuacauucgaggccacuggcaaccuagucguuccuagguacgcuuuugccauggaacggaacgcagggagcggaaucauaauuucggauaccccagugcaugacugcaauacaaccugucaaacgccgaaaggcgcuaucaacacuucucuccccuuccagaauauucacccuaucacaaucgguaagugcccaaaguauguaaaagggaccaagcugcgccuugccacuggacugagaaacgugcccuccauucagucaaggggcuuguuuggcgcgauagccggguucaucgagggagguuggacaggcauggucgacgggugguacggauaucaucaccagaaugaacaaggcagugguuacgcagcugaucucaaaagcacccagcacgccauugacgagaucacgaacaagguaaauuccguuauagagaaaaugaacacccaguuuacagcuguggggaaggaguucaaucaucuggagaagcggauugaaaacuuaaauaaaaaggucgaugacggcuuccuggauaucuggacuuacaacgccgagcuccuugugcuguuggaaaaugagcgcacccuagacuaucacgauucuaacgugaaaaaucuguacgagaagguucgaagccagcucaaaaacaacgcaaaggaaaucggaaauggcuguuuugaguucuaucauaagugcgacaacacauguauggaaucagugaaaaaugggacuuacgauuauccuaaguacagugaggaagccaaacugaacagagaggagauugacggagucaaacuugaauccaccaggaucuaucaaauucuggcuauauacagcacaguggcgucuucauugguccucgugguuagucugggugcaaucagcuuuuggaugugcuccaauggcucuuuacagugccggauuuguaucuga

SEQ ID NO: 131791 - RNA, 1701 nt, Artificial Sequence; identical to SEQ ID NO: 128925
  derived and/or modified sequence opt3 from hemagglutinin__InfluenzaA__AGB13082

SEQ ID NO: 131792 - RNA, 1701 nt, Artificial Sequence; identical to SEQ ID NO: 128825
  derived and/or modified sequence opt3 from hemagglutinin__InfluenzaA__AGB13105

SEQ ID NO: 131793 - RNA, 1701 nt, Artificial Sequence; identical to SEQ ID NO: 128883
  derived and/or modified sequence opt3 from hemagglutinin__InfluenzaA__AGB13125

SEQ ID NO: 131794 - RNA, 1701 nt, Artificial Sequence; identical to SEQ ID NO: 128883
  derived and/or modified sequence opt3 from hemagglutinin__InfluenzaA__AGB13130

SEQ ID NO: 131795 - RNA, 1701 nt, Artificial Sequence
  derived and/or modified sequence opt3 from hemagglutinin__InfluenzaA__AGB13140
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaagucucuggagcuacauuguugagaccuccucuucggacaacggaacuugcuauccaggcgauuuuaucgacuacgaggagcugagggagcagcugucaagcgugaguuccuucgaacgguuugagauuuucccgaagacaucuagcuggcccaaucacgauuccaacaagggugucaccgccgcuuguccucaugcaggggccaaaucauuuuauaagaaucucaucugguuagugaaaaagggaaacaguuacccaaaacugagcaagucuuauauaaaugacaagggcaaagaaguacuuguuuuguggggcauccaccaccccuccacgacugcugaucaacagucacuguaccagaacgccgacaccuacguguucgucgggacaagccgcuauaguaagaaauuuaagccugagauugcgauccgaccaaaagugcgugaucaggagggaagaaugaauuacuauuggacucuaguggaacccggugacaagauuaccuucgaggcaacaggcaaccucgucguuccuagguacgccuuugcuauggaacggaacgccgggucuggaaucauaauuuccgauaccccagugcaugacugcaauacgacuugucaaacaccgaaaggcgcaaucaacaccagccugcccuuccagaauauucacccuaucacuaucgguaagugcccaaaguauguaaaaucgacaaaacuucgccuggcuaccggguugagaaacgugcccucuauucaguccaggggacucuuuggcgccauagcgggcuucaucgaagggggauggacggguauggucgacggcugguacggguaucaucaccagaaugaacaaggaucaggcuacgccgcagaucugaagaguacccagaacgcuauugacaagaucacaaauaaagugaacagcguuauagagaagaugaauacucaguuuaccgccguggguaaggaguucaaccacuuagaaaaacggauugagaaucugaacaagaaagucgaugacggguuccucgauaucuggacauacaaugcugaacuucugguguugcuagagaacgaacgcacucuggacuaucaugauuccaauguaaagaaccucuacgagaaaguucgaaaccagcugaagaauaacgccaaggagaucggcaauggauguuuugaguucuaucacaaaugcgacaacaccuguauggaaucugugaagaauggcacauacgauuauccuaaauacagcgaagaggcaaaacuuaacagagaagagauugacggggucaagcuggagucaaccaggaucuaucaaauuuuggccauauacaguacuguggcuuccagccucguccuggugguuucuuuaggagcgaucucauuuuggaugugcaguaaugguagccugcagugccggauuuguaucuga

SEQ ID NO: 131796 - RNA, 1701 nt, Artificial Sequence
  derived and/or modified sequence opt3 from hemagglutinin__InfluenzaA__AGB13159
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuucucuccaucuggguaaaugcaacauagccggcuggauccuugggaaucccgagugugaaucacugaguacagcaagcuccuggucuuacauuguugagaccucgucaagcgacaacggaacuugcuauccuggcgauuuuaucgacuacgaagaguugagggagcagcucaguuccgugucuagcuucgaacgguuugagauuuucccaaagacauccucauggccgaaucacgauaguaacaagggugucaccgccgcuuguccccaugcaggggccaaaggauuuuauaagaaucugaucuggcuggugaaaaagggcaacagcuacccuaaacucucuaaguccuauauaaaugacaagggcaaagaaguauuaguucugugggggauccaccacccaucaacgacugcugaucaacagagccuuuaccagaacgccgacaccuacguguucgucggaacaagucgcuauucuaagaaauuuaagcccgagauugcgauccgaccuaaagugcgugaucaggaggguagaaugaauuacuauuggacuuugguggaaccaggcgacaagauuaccuucgaggcaacagggaaccuggucguucccagguacgccuuugcuauggaacggaacgccggauccggcaucauaauuagcgauaccccugugcaugacugcaauacgacuugucaaacaccaaaaggugcaaucaacaccucgcuaccguuccagaauauucaccccaucacuaucgggaagugcccuaaguauguaaaaucuacaaagcuccgccuggcuaccggacuuagaaacgugccauccauucagucaaggggccuguuuggcgccauagcgggguucaucgagggagguuggacgggcauggucgacgggugguacggauaucaucaccagaaugaacaaggcagugguuacgccgcagauuugaaaagcacccagaacgcuauugacaagaucacaaauaaagugaacuccguuauagagaagaugaauacucaguuuaccgccguggggaaggaguucaaccaccucgaaaaacggauugagaaucugaacaagaaagucgaugacggcuucuuagauaucuggacauacaaugcugaacugcucgugcuucuggagaacgaacgcacuuuggacuaucaugauucuaauguaaagaaccuauacgagaaaguucgaaaccagcugaagaauaacgccaaggagaucggaaauggcuguuuugaguucuaucacaaaugcgacaacaccuguauggaaagcgugaagaaugggacauacgauuaucccaaauacucagaagaggcaaagcucaacagagaagagauugacggagucaaacuggagaguaccaggaucuaucaaauucuugccauauacuccacuguggcuagcucucuggucuuggugguuucacucggugcgaucaguuuuuggaugugcagcaauggcucccugcagugccggauuuguaucuga

SEQ ID NO: 131797 - RNA, 1701 nt, Artificial Sequence; identical to SEQ ID NO: 128840
  derived and/or modified sequence opt3 from hemagglutinin__InfluenzaA__AGB13170

SEQ ID NO: 131798 - RNA, 1701 nt, Artificial Sequence
  derived and/or modified sequence opt3 from hemagglutinin__InfluenzaA__AGB13180
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaucggugcaugauugcaacaccacgugucaaacuccaaaaggcgcuaucaauacaucucucccguuccagaacauucaccccaucaccaucgguaagugcccuaaguauguaaaauccacuaagcugcgccuugccacagggcugagaaaugugccaucaauucagaguaggggauuguuuggcgcgauagccggcuucaucgaagggggauggaccgguauggucgacggcugguacggguaucaucaccagaacgaacaaggaagcggcuacgcagcugaccucaaauccacgcagaaugccauugauaagaucaccaacaaaguuaauucugugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacagcaacguaaagaaccuguacgagaaaguucgaaaucagcucaagaacaaugcaaaggagaucggcaacggauguuuugaguucuaucacaaaugcgauaauacuuguauggaaucagugaagaacggcaccuacgacuaucccaaauacagugaagaggccaagcugaauagagaagagauugauggggucaaacuugaguccacaaggaucuaucaaauucuggcuauauacagcaccguggcgucuucauugguccucgugguuagucugggagcaaucagcuuuuggaugugcuccaacgguucuuuacagugccggauuuguaucuga

SEQ ID NO: 131799 - RNA, 1701 nt, Artificial Sequence; identical to SEQ ID NO: 128883
  derived and/or modified sequence opt3 from hemagglutinin__InfluenzaA__AGB13190

SEQ ID NO: 131800 - RNA, 1701 nt, Artificial Sequence
  derived and/or modified sequence opt3 from hemagglutinin__InfluenzaA__AGB13200
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggugaaaaguuuuuauaagaaccugaucuggcucguaaagaagggaaauagcuacccaaaauuaucuaaguccuauauaaacgauaagggcaaagaaguucuggugcuuuggggcauccaccaccccucaacgacuaccgaccaacagagcuuguaccagaaugccgaugcuuacgucuucguggggacaaguaaguauucuaaaaaguuuaaaccugagauugccauccgcccaaaggugcgagaccaggagggacguaugaacuacuauuggacucuggucgaacccggugauaaaauuaccuucgaggcgacaggcaaccuaguugugccuagauacgcauuugccauggaaaggaaugcuggguccggaaucauaauuagcgacaccccaguacaugauugcaacacgacuugucaaacaccgaagggcgccaucaauaccucgcuccccuuccagaacauucacccuaucacuaucgguaagugcccaaaauaugugaagucuacaaaacugcggcuugcaaccgggcugcgcaauguccccuccauucagucaagaggauuguuuggcgcuauagccggcuucaucgaagggggauggacggguaugguggacggcugguacggguaucaucaccagaacgaacaaggaaguggcuacgcggccgaccucaagagcacccagaaugcaauugauaaaaucacaaacaagguuaauuccgugauagagaagaugaacacucaguuuaccgcugucgguaaagaguucaaucaccuggaaaagaggauugagaacuuaaauaaaaagguggacgauggguuccuggacaucuggacauacaacgccgaacuccuuguacuguuggagaaugaacggacucuagauuaucaugacucuaacguuaaaaaccuguacgagaaggugcgcaaucagcucaagaacaaugcuaaagagaucggcaacggauguuuugaguucuaucacaagugcgauaauaccuguauggaaagcgucaaaaacggcacauacgacuauccuaaguacucagaagaggccaaacugaaucgagaagagauugauggggugaaacuugagaguaccagaaucuaucaaauucuggcaauauacuccacugucgccagcucuuuggugcucguugugucacugggagcuaucaguuuuuggaugugcagcaacgguuccuuacagugcaggauuuguaucuga

SEQ ID NO: 131801 - RNA, 1701 nt, Artificial Sequence
  derived and/or modified sequence opt3 from hemagglutinin__InfluenzaA__AGB13210
augaaggccacccuggugguccuccuuuacacauucgcuacugcaaacgccgacacgcugugcaucggcuaucacgcgaauaacagcaccgauacaguugacacuguguuggagaaaaauguaaccgugacacauuccgucaacuuacuggaagauaagcacaaugggaaacuauguaagcucagaggaguggcuccccugcaucuugguaaaugcaacauugccggcuggauacuggggaauccugagugugaaucuuugucaaccgcaaguagcugguccuacaucguugagacuucuucgucagacaacggaacaugcuauccaggcgauuuuauuaauuacgaggagcucagggagcagcugagcaguguguccucuuucgaacgguuugagaucuucccgaagaccagcuccuggcccaaccacgacucaaauaagggugucacggccgcuuguccucaugcaggggccaaaaguuuuuauaagaaccugauuuggcucgugaaaaagggaaauagcuacccaaaauuaucuaaguccuauaucaacgauaagggcaaagaaguacugguucuuuggggcauacaccaccccucaacuagcgcugaccaacagaguuuguaccagaaugccgaugcguacguguucgucgggaccucuaaguauuccaaaaaguuuaaaccugagaucgcagugcgcccaaaggugcgagaccaggagggacguaugaacuacuauuggacacuggucgaacccggugauaaaauuacuuucgaggccaccggcaaccuacucguuccuagauacgcuuuugccauggaaaggaaugcagggagcggaaucauuaucucggacacaccagugcaugauugcaacaccacgugucaaacuccgaagggcgcuauaaauacaucucugcccuuccagaacauucacccuaucaccauugguaagugcccaaaauauguaaaguccacuaaacuucggcuggccacaggguugcgcaaugugcccucaauccagaguagaggacucuuuggcgcgaucgccggcuucauugaagggggauggaccgguauggucgacggcugguacggguaucaucaccagaacgaacaaggaagcggcuacgcagcugaccugaaguccacgcagaaugccauagauaaaaucaccaacaagguaaauucuguuauugagaagaugaacacacaguuuacugcuguggguaaagaguucaaucacuuagaaaagaggaucgagaaccugaauaaaaaggucgacgauggguuccucgacauauggaccuacaacgccgaacuucugguguugcuagagaaugaacggacacuggauuaucaugacagcaacgugaaaaaccucuacgagaagguucgcucacagcugaagaauaacgcaaaagagauuggcaauggauguuuugaguucuaucacaagugcgauaacacuuguauggaaagugugaaaaauggcaccuacgacuauccuaaguacuccgaagaggccaaacuuaaccgagaagagaucgauggggucaagcuggagagcacaagaaucuaucaaauuuuggcuaucuacucuaccguggcgucaagucucguccuggugguuagcuuaggagcaauuuccuuuuggaugugcucuaaugguucgcugcagugcaggauauguaucuga

SEQ ID NO: 131802 - RNA, 1701 nt, Artificial Sequence
  derived and/or modified sequence opt3 from hemagglutinin__InfluenzaA__AGB13220
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaucucggacaacggaacuugcuauccaggcgauuuuauuaauuacgaggagcucagggagcagcugucaagcgugaguuccuucgaacgguuugagaucuucccgaagacaucuagcuggcccaaccacgacuccaauaagggugucaccgccgcuuguccucaugcaggggccaaaucauuuuauaagaaccugauauggcucgugaaaaagggaaauaguuacccaaaauuaagcaagucuuauaucaacgauaagggcaaagaaguacugguucuuuggggcauucaccaccccuccacgacugcugaccaacagucauuguaccagaaugccgaugcguacguguucgucgggaccagcaaguauaguaaaaaguuuaaaccugagaucgcaauucgcccaaaggugcgagaccaggagggacguaugaacuacuauuggacacugguggaacccggugauaaaaucacuuucgaggccaccggcaaccuagucguuccuagauacgcuuuugccauggaaaggaaugcagggucuggaauaauuaucuccgacacaccagugcaugauugcaacaccacgugucaaacuccgaagggcgcuauuaauacaagccuccccuuccagaacauccacccuaucaccauugguaagugcccaaaauauguaaagucgacuaaacugcggcuugccacagggcugcgcaaugugcccucuauacaguccagaggauuguuuggcgcgaucgccggcuucauugaagggggauggaccgguauggucgacggcugguacggguaucaucaccagaacgaacaaggaucaggcuacgcagcugaccucaagaguacgcagaaugccaucgauaaaauaaccaacaaggugaauagcguuauugagaagaugaacacacaguuuacugcuguggguaaagaguucaaucaccuggaaaagaggaucgagaacuuaaauaaaaaggucgacgauggguuccuggacaucuggaccuacaacgccgaacuccuugugcuguuggagaaugaacggacacuagauuaucaugacuccaacguaaagaaccuguacgagaagguucgcaaucagcucaagaacaaugcaaaagagauuggcaacggauguuuugaguucuaucacaagugcgauaauacuuguauggaaucugugaaaaacggcaccuacgacuauccuaaguacagcgaagaggccaaacugaaucgagaagagaucgauggggucaaacuugagucaacaagaauuuaucaaauacuggcuaucuacaguaccguggcguccagcuugguccucgugguuucucugggagcaauuucauuuuggaugugcaguaacgguagcuuacagugcaggaucuguaucuga

SEQ ID NO: 131803 - RNA, 1701 nt, Artificial Sequence
  derived and/or modified sequence opt3 from hemagglutinin__InfluenzaA__AGB13230
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaaucacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucaacuacgaggagcucagggagcagcugagcaguguguccucuuucgaacgguuugagauuuucccgaaaacaagcuccuggcccaaucacgacucaaacaagggugucaccgccgcuuguccucaugcaggggccaagaguuuuuauaaaaaucugaucuggcucgugaagaaaggaaacagcuacccaaaguuaucuaaauccuauauaaaugauaagggcaaggaaguacugguucuuuggggcauccaccaccccucaacgacugcugaccaacagagcuuguaccagaacgccgaugcguacguguucgucgggaccagucgcuauucuaaaaaguuuaaaccugagauugcaauccgaccaaaggugcgugaccaggagggaagaaugaacuacuauuggacacugguggaacccggugauaaaauuacuuucgaggccaccggcaaucuagucguuccuagguacgcuuuugccauggaacggaacgcaggguccggaaucauaauuagcgacacaccagugcaugauugcaauaccacgugucaaacuccgaagggcgcuaucaacacaucgcuccccuuccagaauauucacccuaucaccaucgguaaaugcccaaaguauguaaagucuacuaaacugcgccuugccacagggcugagaaacgugcccuccauucagucaaggggauuguuuggcgcgauagccggcuucaucgaagggggauggaccgguauggucgacggcugguacggguaucaucaccagaaugaacaaggaaguggcuacgcagcugaccucaagagcacgcagaacgccauugauaaaaucaccaauaaggugaacuccguuauagagaaaaugaauacacaguuuacugcuguggguaaggaguucaaccggcuggaaaagcgcauugagaauuuaaacaaaaaggucgacgauggguuccuggacaucuggaccuacaaugccgaacuccuugugcuguuggagaacgaacgaacacuagauuaucacgacucuaacguaaagaaucuguacgagaagguuagaaaccagcucaaaaauaacgcaaaggagaucggcaauggauguuuugaguucuaucauaagugcgauaacacuuguauggaaagcgugaaaaauggcaccuacgacuauccuaaguacucagaagaggccaaacugaacagggaagagauugauggggucaaacuugagaguacacggaucuaucaaauucuggcuauauacuccaccguggcgagcucuuugguccucgugguuucacugggagcaaucaguuuuuggaugugcagcaaugguuccuuacagugccguauuuguaucuga

SEQ ID NO: 131804 - RNA, 1701 nt, Artificial Sequence; identical to SEQ ID NO: 128883
  derived and/or modified sequence opt3 from hemagglutinin__InfluenzaA__AGB13240

SEQ ID NO: 131805 - RNA, 1701 nt, Artificial Sequence; identical to SEQ ID NO: 128883
  derived and/or modified sequence opt3 from hemagglutinin__InfluenzaA__AGB13250

SEQ ID NO: 131806 - RNA, 1701 nt, Artificial Sequence
  derived and/or modified sequence opt3 from hemagglutinin__InfluenzaA__AGB13260
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcugggaguaagagcuuuuauaagaaucugaucuggcucgugaaaaagggaaacucuuacccaaaauuauccaagucauauauaaaugacaagggcaaagaaguacugguucuuuggggcauccaccaucccccuacuagcgcagaucaacagaguuuguaccagaacgccgacgcuuacguguucgucgggaccucucgcuauuccaagaaauuuaagccagagauugccauccgacccaaagugcgugaucaggagggaagaaugaauuacuauuggacacugguggaaccuggugacaagauuacuuucgaggcgaccggcaaccuagucguuccaagguacgcauuugccauggaacggaacgcugggagcggaaucauaauuucggauacaccggugcacgacugcaauaccacgugucaaacucccaaaggcgccaucaacacaucucucccuuuccagaauguacacccaauuaccaucgguaagugccccaaguaugugaaauccacuaagcugcgccuugcaacagggcugagaaacgucccuucaauccagaguaggggauuguuuggcgcuauugccggcuucauagaagggggauggaccgguaugguggacggcugguacggguaucaucaccagaaugaacaaggaagcggcuacgcggccgaucucaaauccacgcagaacgcaaucgacgagauuaccaauaagguuaacucugugaucgagaaaaugaauacacaguuuacugcugucgguaaggaguucaaccaccuggaaaagcggauagaaaauuuaaacaaaaagguggaugacggguuccuggauauuuggaccuacaaugccgagcuccuuguacuguuggaaaacgagcgcacacuagacuaucaugauagcaauguuaaaaaccuguacgagaaggugcgaucacagcucaaaaacaaugcuaaggaaaucggcaacggauguuuugaguucuaucacaagugcgacaauacuuguauggaaaguaucaaaaacggcaccuacgauuauccaaaguacuccgaggaagccaaacugaauagagaggagauugacggggucaaacuugaaagcacaaggaucuaucaaauucuggcaauauacucuaccguggccucaaguuugguccucgugguuagccugggagcuaucuccuuuuggaugugcucuaacgguucguuacagugccggauuuguaucuga

SEQ ID NO: 131807 - RNA, 1701 nt, Artificial Sequence
  derived and/or modified sequence opt3 from hemagglutinin__InfluenzaA__AGB13270
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccagaacauccacccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaucaccagaacgaacaaggaagcggcuacgcagcugaccugaaguccacccagaaugccaucgauaaaauuacgaacaagguaaauucuguuaucgagaagaugaacacccaguuuacagcuguggguaaagaguucaaucacuuagaaaagaggauagagaaccugaauaaaaaggucgacgauggguuccucgacauuuggacuuacaacgccgaacuucugguguugcuagagaaugaacggacccuggauuaucaugacagcaacgugaaaaaccucuacgagaagguucgcucacagcugaagaauaacgcaaaagagaucggcaauggauguuuugaguucuaucacaagugcgauaacacauguauggaaagugugaaaaauggcacuuacgacuauccuaaguacuccgaagaggccaaacuuaaccgagaaaagaucgauggggucaagcuggagagcaccagaauuuaucaaaucuuggcuauuuacucuacaguggcgucaagucucguccuggugguuagcuuaggagcaauauccuuuuggaugugcucuaaugguucgcugcagugcaggaucuguauuuga

SEQ ID NO: 131808 - RNA, 1701 nt, Artificial Sequence
  derived and/or modified sequence opt3 from hemagglutinin__InfluenzaA__AGB13280
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgaaugcugaccaacagagcuuguaccagaacgccgaugcguacguguucgucgggacuagcaaguauucuaaaaaguuuaaaccugagauugcagugcgcccaaaggugcgagaccaggagggacguaugaacuacuauuggacccuggucgaacccggugauaaaaucacauucgaggccacuggcaaucuacucguuccuagauacgcuuuugccauggaaaggaacgcaggguccggaauuaucauaagcgacaccccagugcaugauugcaauacaaccugucaaacgccgaagggcgcuauuaacacuucgcugcccuuccagaauauccacccuauuacaaucgguaagugcccaaaauauguaaagucuaccaaacuucggcuggccacuggguugcgcaacgugcccuccauccagucaagaggacucuuuggcgcgauugccggcuucauagaagggggauggacagguauggucgacggcugguacggguaucaucaccagaauggacaaggcagugguuacgcagcugaccugaaaagcacccagaacgccaucgauaaaauuacgaauaaggugaacuccguuaucgaaaagaugaauacccaguuuacagcuguggggaaagaguucaaccacuuagagaagaggauagaaaaucugaacaaaaaggucgacgauggcuuccucgacauuuggacuuacaaugccgagcuucugguguugcuagaaaacgagcggacccuggauuaucaugacucuaacguaaagaaucucuacgaaaagguucgcagccagcugaagaacaaugcaaaagagaucggaaacggcuguuuugaguucuaucacaagugcgauaauacauguauggaaucagugaaaaacgggacuuacgacuauccuaaguacagugaggaagccaaacuuaaucgagaggaaaucgauggagucaagcuggaguccaccagaauuuaucaaaucuuggcuauuuacagcacaguggcgucuucacucguccuggugguuaguuuaggugcaauaaguuuuuggaugugcuccaacggcucucugcagugcaggaucuguauuuga

SEQ ID NO: 131809 - RNA, 1701 nt, Artificial Sequence
  derived and/or modified sequence opt3 from hemagglutinin__InfluenzaA__AGB13290
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagugaagcacaaugggaaacuauguaagcucagaggaguugcuccccugcaucuugguaaaugcaacauagccggcuggauccuggggaauccugagugugaaucuuugucaacagcaaguagcugguccuacauuguggagaccucuucgucagauaacggaacuugcuauccaggcgacuuuaucaauuacgaggagcucagggagcagcugagcagugucuccucuuucgaacgguuugagauuuucccgaagacaagcuccuggcccaaccacgauucaaauaagggugugaccgccgcuuguccucaugcaggggccaaaaguuuuuauaagaaccugaucuggcucguuaaaaagggaaauagcuacccaaaauuaucuaaguccuauauaaacgacaagggcaaagaaguacuggugcuuuggggcauccaccaccccucaacgacugcugaucaacagagcuuguaccagaaugccgacgcguacgucuucguggggaccagucgcuauucuaagaaauuuaagccugagauugcaauccgaccaaaagugcgugaucaggagggaagaaugaacuacuauuggacacuggucgaacccggugacaagauuacuuucgaggccaccggcaaccuaguugugccuagguacgcuuuugccauggaacggaaugcaggguccggaaucauaauuagcgauacaccaguacaugacugcaacaccacgugucaaacuccgaaaggcgcuaucaauacaucgcuccccuuccagaacauucacccuaucaccaucgguaagugcccaaaguaugugaaaucuacuaagcugcgccuugccacagggcugagaaauguccccuccauucagucaaggggauuguuuggcgcgauagccggcuucaucgaagggggauggaccgguaugguggauggcugguacggguaucaucaccagaacgaacaaggaaguggcuacgcagcugaccucaaaagcacgcagaaugccauugacaagaucaccaacaaaguuaauuccgugauagagaagaugaacacacaguuuacugcugucgguaaggaguucaaucaccuggaaaaacggauugagaacuuaaauaagaaaguggaugacggguuccuggauaucuggaccuacaacgccgaacuccuuguacuguuggagaaugaacgcacacuagacuaucaugauucuaacguuaagaaccuguacgagaaagugcgaaaucagcucaagaacaaugcaaaggagaucggcaacggauguuuugaguucuaucacaaaugcgacaauacuuguauggaaagcgucaagaacggcaccuacgauuauccuaaauacucagaagaggccaagcugaauagagaagagauugacggggugaaacuugagaguacaaggaucuaucaaauucuggcuauauacuccaccgucgcgagcucuuuggugcucguugugucacugggagcaaucaguuuuuggaugugcagcaacgguuccuuacagugccggauuuguaucuga

SEQ ID NO: 131810 - RNA, 1701 nt, Artificial Sequence; identical to SEQ ID NO: 128883
  derived and/or modified sequence opt3 from hemagglutinin__InfluenzaA__AGB13300

SEQ ID NO: 131811 - RNA, 1701 nt, Artificial Sequence
  derived and/or modified sequence opt3 from hemagglutinin__InfluenzaA__AGB13310
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcgugcaccaccccucaacgagcgcugaucaacagaguuuguaccagaacgccgacgcguacgucuucguggggacuucucgcuauuccaagaaauuuaagccugagaucgcaauucgaccaaaagugcgugaucaggagggaagaaugaauuacuauuggacccuggucgaacccggugacaagaucacauucgaggccacuggcaaccuaguugugccuagguacgcuuuugccauggaacggaacgcagggagcggaauuaucauaucggauaccccaguacaugacugcaauacaaccugucaaacgccgaaaggcgcuauuaacacuucucuccccuuccagaauauccacccuauuacaaucgguaagugcccaaaguaugugaaauccaccaagcugcgccuugccacugggcugagaaacguccccucaauccagaguaggggauuguuuggcgcgauugccggcuucauagaagggggauggacagguaugguggacggcugguacggguaucaucaccagaaugaacaaggaagcggcuacgcagcugaucucaaauccacccagcacgccaucgacgagauuacgaacaagguuaauucugugaucgagaaaaugaacacccaguuuacagcugucgguaaggaguucaaucaucuggaaaagcggauagaaaacuuaaauaaaaagguggaugacggguuccuggauauuuggacuuacaacgccgagcuccuuguacuguuggaaaaugagcgcacccuagacuaucacgauagcaacguuaaaaaucuguacgagaaggugcgaucacagcucaaaaacaacgcaaaggaaaucggcaauggauguuuugaguucuaucauaagugcgacaacacauguauggaaagugucaaaaauggcacuuacgauuauccuaaguacuccgaggaagccaaacugaacagagaggagaucgacggggugaaacuugaaagcaccaggauuuaucaaauccuggcuauuuacucuacagucgcgucaaguuuggugcucguugugagccugggagcaauauccuuuuggaugugcucuaaugguucguuacagugccggaucuguauuuga

SEQ ID NO: 131812 - RNA, 1701 nt, Artificial Sequence
  derived and/or modified sequence opt3 from hemagglutinin__InfluenzaA__AGB13320
augaaggccauccuggugguccuccuuuacaccauugcuacagcaaacgccgacacucugugcauaggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacaucgccggcuggauucuggggaauccugagugugaaucuuugucaacagcaaguagcugguccuacaucguugagaccucuucgucagacaacggaacuugcuauccaggcgauuucauuaauuacgaggagcucagggagcagcugagcaguguguccucuuuugaacgguucgagaucuuuccgaagacaagcuccuggcccaaccacgacucaaauaagggugucaccgccgcuuguccucaugcaggggccaaaaguuucuauaagaaccugauauggcucgugaaaaagggaaauagcuacccaaaauuaucuaaguccuauaucaacgauaagggcaaagaaguacugguucuuuggggcauucaccaccccucaacgacugcugaccaacagagcuuguaccagaaugccgaugcguacguguuugucgggaccagucgcuauucuaagaaauucaagccugagaucgcaauucgaccaaaagugcgugaccaggagggaagaaugaacuacuauuggacacugguggaacccggugauaagaucacuuuugaggccaccggcaaccuagucguuccuagguacgcuuucgccauggaaaagaaugcaggguccggaauaauuaucagcgacacaccagugcaugauugcaacaccacgugucaaacuccgaagggcgcuauuaauacaucgcuccccuuucagaacauccacccuaucaccauugguaagugcccaaaauauguaaagucuacuaaacugcggcuugccacagggcugcgcaaugugcccuccauacagucaagaggauuguucggcgcgaucgccggcuuuauugaagggggauggaccgguauggucgacggcugguacggguaucaucaccagaacgaacaaggaaguggcuacgcagcugaccucaagagcacgcagaaugccaucgauaaaauaaccaacaagguaaauuccguuauugagaagaugaacacacaguucacugcuguggguaaagaguuuaaucaccuggaaaagaggaucgagaacuuaaauaaaaaggucgacgauggguuccuggacaucuggaccuacaacgccgaacuccuugugcuguuggagaaugaacggacacuagauuaucaugacucuaacgugaaaaaccuguacgagaagguucgcaaucagcucaagaacaaugcaaaagagauuggcaacggauguuucgaauuuuaucacaagugcgauaauacuuguauggagagcgugaaaaacggcaccuacgacuauccuaaguacucagaagaggccaaacugaaucgagaagagaucgauggggucaaacuugagagugcuagaguguaucaaauucuggcgauauacuccacagucgcaagcucuuuggugcucguugugucacugggagccaucaguuucuggaugugcagcaacgguuccuuacagugcaggauuuguaucuga

SEQ ID NO: 131813 - RNA, 1701 nt, Artificial Sequence
  derived and/or modified sequence opt3 from hemagglutinin__InfluenzaA__AGB13330
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcaagucuuauuccaaugacaagggcaaagaaguauuaguucugugggggauacaccaccccucaacgacugcugaucaacagagccuuuaccagaacgccgacaccuacguguucgucggaacaagucgcuauucuaagaaauuuaagccugagaucgcgauucgaccaaaagugcgugaucaggaggguagaaugaauuacuauuggacuuugguggaacccggcgacaagaucaccuucgaggcaacagggaaccuggucguuccuagguacgccuuugcuauggaacggaacgccggauccggcauuaucauaagcgauaccccagugcaugacugcaauacgacuugucaaacaccgaaaggugcaauuaacaccucgcuacccuuccagaauauccacccuauuacuaucgggaagugcccaaaguauguaaaaucuacaaagcuccgccuggcuaccggacuuagaaacgugcccuccauccagucaaggggccuguuuggcgccauugcgggguucauagagggagguuggacgggcauggucgacgggugguacggauaucaucaccagaaugaacaaggcagugguuacgccgcagauuugaaaagcacccagaacgcuaucgacaagauuacaaauaaagugaacuccguuaucgagaagaugaauacucaguuuaccgccguggggaaggaguucaaccaccucgaaaaacggauagagaaucugaacaagaaagucgaugacggcuucuuagauauuuggacauacaaugcugaacugcucgugcuucuggagaacgaacgcacuuuggacuaucaugauucuaauguaaagaaccuauacgagaaaguucgaaaccagcugaagaauaacgccaaggagaucggaaauggcuguuuugaguucuaucacaaaugcgacaacaccuguauggaaagcgugaagaaugggacauacgauuauccuaaauacucagaagaggcaaagcucaacagagaagagaucgacggagucaaacuggagaguaccaggauuuaucaaauccuugccauuuacuccacuguggcuagcucucuggucuuggugguuucacucggugcgauaaguuuuuggaugugcagcaauggcucccugcagugccggaucuguauuuga

SEQ ID NO: 131814 - RNA, 1701 nt, Artificial Sequence; identical to SEQ ID NO: 128883
  derived and/or modified sequence opt3 from hemagglutinin__InfluenzaA__AGB13340

SEQ ID NO: 131815 - RNA, 1701 nt, Artificial Sequence
  derived and/or modified sequence opt3 from hemagglutinin__InfluenzaA__AGB13350
augaaggccauccuggugguccuccuuuacaccuucgcuacagcaaacgccgacacucugugcauuggcuaucacgcgaauaacagcacggagaccguugauacaguguuggagaaaaauguaacugugacccauuccgucaacuuacuggaagacaagcacaaugggaaacuauguaagcucagaggaguggcuccccugcaucuugguaaaugcaacauagccggcuggauccuggggaauccugaaugugagucuuugucaacagcaaguagcugguccuacauuguugaaaccucuucgucagauaacggaacuugcuauccaggcgacuuuaucaauuacgaggagcucagggaacagcugagcaguguguccucuuucgagcgguuugaaauuuucccgaagacaagcuccuggcccaaccacgauucaaauaagggugucaccgccgcuuguccucaagcaggggccaaaaguuuuuauaagaaccugaucuggcucgugaaaaagggaaauagcuacccaaaauuaucuaaguccuauauaaacgacaagggcaaagagguacugguucuuuggggcauccaucaccccucaacgagcgcugaucagcagaguuuguaccagaaugccgacgcguacguguucgucgggacuucuaaguauuccaaaaaguuuaaaccugagauugcagugcgcccaaaggugcgagaucaagaaggacguaugaacuacuauuggacccuggucgagcccggugacaaaaucacauucgaagccacuggcaaccuacucguuccuagauacgcuuuugccauggagaggaaugcagggagcggaauuaucauaucggauaccccagugcacgacugcaacacaaccugucagacgccgaagggcgcuauuaauacuucucugcccuuccagaacauccauccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgauggcugguacggguaucaccaucaaaacgcacagggaagcggcuacgcugccgaccugaaguccacccagaaugcuaucgacaaaauuacgaacaagguaaauucuguuaucgagaagaugaacacccaguuuacagccguggguaaagaguucaaucacuuagaaaagaggauagagaaccugaauaaaaaggucgaugacggguuccucgauauuuggacuuacaacgcagaacuucugguguugcuagagaaugaacggacccuggacuaucacgauagcaacgugaaaaaccucuacgagaagguucgcucacaacugaagaauaacgccaaagagaucggcaauggauguuuugaguucuaucauaagugcgacaacacauguauggaaagugugaaaaauggcacuuacgauuauccuaaguacuccgaagaggcuaaacuuaaccgagaagagaucgacggggucaagcuggagagcaccagaauuuaucagaucuuggcgauuuacucuacaguggcaucaagucucguccuggugguuagcuuaggagccauauccuuuuggaugugcucuaaugguucgcugcagugcaggaucuguauuuga

SEQ ID NO: 131816 - RNA, 1701 nt, Artificial Sequence
  derived and/or modified sequence opt3 from hemagglutinin__InfluenzaA__AGB13360
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccagaacauccacccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaucaccagaacgaacaaggaagcggcuacgcagcugaccugaaguccacccagaaugccaucgauaaaauuacgaacaagguuaauucugugaucgagaagaugaacacccaguuuacagcuguggguaaagaguucaaucacuuagaaaagaggauagagaaccugaauaaaaaggucgacgauggguuccucgacauuuggacuuacaacgccgaaaugcuugugcuguuggagaaugaaaagacccuagauuaucaugacagcaacguaaagaaccuguacgagaagguucggucacagcucaaaaauaacgcaaaggagaucggcaauggauguuuugaguucuaucacaaaugcgauaacacauguauggaaagugugaagaauggcacuuacgacuauccuaaauacuccgaagaggccaagcugaaccgcgaagagaucgauggggucaaacuugagagcacccgaauuuaucaaauccuggcuauuuacucuacaguggcgucaaguuugguccucgugguuagccugggagcaauauccuuuuggaugugcucuaaugguucguuacagugcagaaucuguauuuga

SEQ ID NO: 131817 - RNA, 1701 nt, Artificial Sequence
  derived and/or modified sequence opt3 from hemagglutinin__InfluenzaA__AGB13380
augaaggccauccuggugguccuccuuuacaccuucgcuacagcaaaagccgacacucugugcauuggcuaucacgcgaacaauagcacggauaccguugacacaguguuggagaagaacguaacugugacccauuccgucaauuuacuggaagauaaacacaacgggaagcuauguaaacucagaggaguggcuccccugcaucuugguaagugcaauauagccggcuggauccuggggaacccugagugugaaucuuugucaacagcaaguagcugguccuacauuguugagaccucuucgucagacaauggaacuugcuauccaggcgauuuuaucaacuacgaggagcucagggagcagcugagcaguguguccucuuucgaacgguuugagauuuucccgaagacaagcuccuggcccaaucacgacucaaacaaaggugucaccgccgcuuguccucaugcaggggccaagaguuuuuauaaaaaucugaucuggcucgugaagaaaggaaacagcuacccaaaguuaucuaaguccuauauaaaugauaaaggcaaggaaguacugguucuuuggggcauccaccaccccucaacgacugcugaccaacagagcuuguaccagaacgccgaugcguacguguucgucgggaccagucgcuauucuaaaaaguuuaaaccugagauugcaauccgaccaaaggugcgugaccaggagggaagaaugaauuacuauuggacacugguggaacccggugauaaaauuacuuucgaggccaccggcaaccuagucguuccuagguacgcuuuugccauggaacggaacccaggguccggaaucauaauuagcgacacaccggugcaugauugcaauaccacgugucaaacucccaagggcgcaaucaacacaucgcucccuuuccagaauauucacccaaucaccaucgguaagugccccaaauauguaaagucuacuaaacugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaccucaagagcacgcagaacgcuauugauaaaaucaccaauaaggugaacuccguuauagagaagaugaauacacaguuuacugccguggguaaagaguucaaccaccuggaaaagcggauugagaauuuaaacaaaaaggucgacgauggguuccuggacaucuggaccuacaaugcugaacuccuugugcuguuggagaacgaacgcacacuagauuaucaugacucuaauguaaagaaccuguacgagaagguucgaaaccagcucaagaauaacgccaaagagaucggcaauggauguuuugaguucuaucacaagugcgauaacacuuguauggaaagcgugaaaaauggcaccuacgacuauccaaaguacucagaagaggcaaaacugaacagagaagagauugauggggucaaacuugagaguacaaggaucuaucaaauucuggccauauacuccaccguggcuagcucuuugguccucgugguuucacugggagcgaucaguuuuuggaugugcagcaaugguuccuuacagugccggauuuguaucuga

SEQ ID NO: 131818 - RNA, 1701 nt, Artificial Sequence; identical to SEQ ID NO: 128451
  derived and/or modified sequence opt3 from hemagglutinin__InfluenzaA__AGB13390

SEQ ID NO: 131819 - RNA, 1701 nt, Artificial Sequence; identical to SEQ ID NO: 129058
  derived and/or modified sequence opt3 from hemagglutinin__InfluenzaA__AGB13400

SEQ ID NO: 131820 - RNA, 1701 nt, Artificial Sequence; identical to SEQ ID NO: 128451
  derived and/or modified sequence opt3 from hemagglutinin__InfluenzaA__AGB13410

SEQ ID NO: 131821 - RNA, 1701 nt, Artificial Sequence; identical to SEQ ID NO: 128470
  derived and/or modified sequence opt3 from hemagglutinin__InfluenzaA__AGB13420

SEQ ID NO: 131822 - RNA, 1701 nt, Artificial Sequence
  derived and/or modified sequence opt3 from hemagglutinin__InfluenzaA__AGB13430
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauguucccgaagacaagcuccuggcccaaucacgauucaaacaagggugucaccacggccuguccucaugcuggggcaaaaaguuuuuauaagaaucugauuuggcucgugaaaaagggaaacagcuacccaaaauuaucuaaguccuauaucaaugacaagggcaaagaaguacugguucuuuggggcauacaccaucccccuacuucagccgaucaacagagcuuguaccagaacgcugacgccuacguguucgucgggaccagucgcuauucuaagaaauuuaagccagagaucgcgauucgacccaaagugcgugaucaggagggaagaaugaauuacuauuggacacugguggaaccuggugacaagaucacuuucgaggcaaccggcaaccuagucguuccaagguacgccuuugcuauggaacggaacgccggguccggaauuaucauaagcgauacaccggugcacgacugcaauaccacgugucaaacucccaaaggcgcaauuaacacaucgcucccuuuccagaauauccacccaauuaccaucgguaagugccccaaguauguaaaaucuacuaagcugcgccuugcuacagggcugagaaacgugccuuccauccagucaaggggauuguuuggcgccauugcgggcuucauagaagggggauggaccgguauggucgacggcugguacggguaucaucaccagaaugaacaaggaaguggcuacgccgcagaucucaaaagcacgcagaacgcuaucgacgguauuaccaauaaggugaacuccguuaucgagaaaaugaauacacaguuuacugccguggggaaggaguucaaccaccuggaaaagcggauagagaauuuaaacaaaaaggucgaugacggcuuccuggauauuuggaccuacaaugcugaacuccuugugcuguuggagaacgaacgcacacuagacuaucaugauucuaauguaaagaaccuguacgagaagguucgaagccagcucaaaaacaaugccaaggagaucggaaacggcuguuuugaguucuaucacaagugcgacaauacuuguauggaaucagugaaaaacgggaccuacgauuauccaaaguacagugaagaggcaaaacugaauagagaagagaucgacggagucaaacuugaguccacaaugauuuaucaaauccuggccauuuacagcaccguggcuucuucauugguccucgugguuagucugggugcgaucagcuuuuggaugugcuccaacggcucuuuacagugcaggauauguauuuga

SEQ ID NO: 131823 - RNA, 1701 nt, Artificial Sequence; identical to SEQ ID NO: 129058
  derived and/or modified sequence opt3 from hemagglutinin__InfluenzaA__AGB13440

SEQ ID NO: 131824 - RNA, 1701 nt, Artificial Sequence; identical to SEQ ID NO: 128470
  derived and/or modified sequence opt3 from hemagglutinin__InfluenzaA__AGB13450

SEQ ID NO: 131825 - RNA, 1701 nt, Artificial Sequence; identical to SEQ ID NO: 128451
  derived and/or modified sequence opt3 from hemagglutinin__InfluenzaA__AGB13460

SEQ ID NO: 131826 - RNA, 1701 nt, Artificial Sequence; identical to SEQ ID NO: 128883
  derived and/or modified sequence opt3 from hemagglutinin__InfluenzaA__AGB13470

SEQ ID NO: 131827 - RNA, 1701 nt, Artificial Sequence; identical to SEQ ID NO: 128470
  derived and/or modified sequence opt3 from hemagglutinin__InfluenzaA__AGB13480

SEQ ID NO: 131828 - RNA, 1701 nt, Artificial Sequence; identical to SEQ ID NO: 128883
  derived and/or modified sequence opt3 from hemagglutinin__InfluenzaA__AGB13490

SEQ ID NO: 131829 - RNA, 1701 nt, Artificial Sequence
  derived and/or modified sequence opt3 from hemagglutinin__InfluenzaA__AGB13500
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcaauuuuaucgauuacgaagaacucagggagcagcugagcaguguguccucuuucgaacgguuugagauuuucccgaagacaagcuccuggcccgaccacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgucagcugaucaacagagcuuguaccagaacgccgacgcguacguguucgucggaaccagucgcuauucuaagaaauuuaagccugagauugcaauccgaccaaaagugcgugaucaggaggguagaaugaauuacuauuggacucugguggaacccggcgacaagauuacauucgaggccacugggaaccuagucgcuccuagguacgccuuugcaauggaacggaacgcuggauccggcaucauaauuagcgauaccccaguucaugacugcaauacaaccugucaaacgccgaaaggugccaucaacacuucgcuccccuuccagaauauucacccuaucacaaucgggaagugcccaaaguaugugaaaucuaccaagcugcgccuugcgacuggacugagaaacguacccuccauucagucaaggggcuuguuuggcgccauagcaggguucaucgagggagguuggacaggcaugguggacgggugguacggauaucaucaccagaaugaacaaggcagugguuacgcugccgaucucaaaagcacccagaacgcuauugacaagaucacgaauaaagucaacuccgugauagagaagaugaauacccaguuuacagccguugggaaggaguucaaccaccuggaaaaacggauugagaauuuaaacaagaaaguggaugacggcuuccuggauaucuggacuuacaaugcagaacuccuuguccuguuggagaacgaacgcacccuagacuaucaugauucuaaugugaagaaccuguacgagaaaguacgaagccagcucaagaacaaugccaaggagaucggaaacggcuguuuugaguucuaucacaaaugcgacaauacauguauggagucaguuaagaacgggacuuacgauuauccuaaauacagugaagaggcuaagcugaauagagaagagauugacggagugaaacuugaguccaccaggaucuaucaaauucuggcgauauacagcacagucgcaucuucauuggugcucgucgugagucugggugccaucagcuuuuggaugugcuccaacggcucuuuacagugccggauuuguaucuga

SEQ ID NO: 131830 - RNA, 1701 nt, Artificial Sequence; identical to SEQ ID NO: 129088
  derived and/or modified sequence opt3 from hemagglutinin__InfluenzaA__AGB13520

SEQ ID NO: 131831 - RNA, 1701 nt, Artificial Sequence
  derived and/or modified sequence opt3 from hemagglutinin__InfluenzaA__AGB13530
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaaauaagucuuauauaaacgacaagggcaaagaaguacugguucuuuggggcauccaccaccccuccacgacugcugaucaacagucauuguaccagaaugccgacgcguacguguucgucgggaccagccgcuauaguaagaaauuuaagccugagauugcaauccgaccaaaagugcgugaucaggagggaagaaugaacuacuauuggacacugguggaacccggugacaagauuacuuucgaggccaccggcaaccuagucguuccuagguacgcuuuugccauggaacggaaugcagggucuggaaucauaauuuccgauacaccagugcaugacugcaacaccacgugucaaacuccgaaaggcgcuaucaauacaagccuccccuuccagaacauucacccuaucaccaucgguaagugcccaaaguauguaaaaucgacuaagcugcgccuugccacagggcugagaaaugugcccucuauucaguccaggggauuguuuggcgcgauagccggcuucaucgaagggggauggaccgguauggucgacggcugguacggguaucaucaccagaacgaacaaggaucaggcuacgcagcugaucucaaaaguacgcagaaugccauugacaagaucaccaacaaagugaauagcguuauagagaagaugaacacacaguuuacugcuguggguaaggaguucaaucaccuggaaaaacggauugagaacuuaaauaagaaagucgaugacggguuccuggauaucuggaccuacaacgccgaacuccuugugcuguuggagaaugaacgcacacuagacuaucaugauuccaacguaaagaaccuguacgagaaaguucgaaaucagcucaagaacaaugcaaaggagaucggcaacggauguuuugaguucuaucacaaaugcgacaauacuuguauggaaucugugaagaacggcaccuacgauuauccuaaauacagcgaagaggccaagcugaauagagaagagauuaacggggucaaacuugagucaacaaggaucuaucaaauucuggcuauauacaguaccguggcguccagcuugguccucgugguuucucugggagcaaucucauuuuggaugugcaguaaugguagcuuacagugccggauuuguaucuga

SEQ ID NO: 131832 - RNA, 1701 nt, Artificial Sequence; identical to SEQ ID NO: 129102
  derived and/or modified sequence opt3 from hemagglutinin__InfluenzaA__AGB13540

SEQ ID NO: 131833 - RNA, 1701 nt, Artificial Sequence; identical to SEQ ID NO: 129066
  derived and/or modified sequence opt3 from hemagglutinin__InfluenzaA__AGB13550

SEQ ID NO: 131834 - RNA, 1701 nt, Artificial Sequence; identical to SEQ ID NO: 129066
  derived and/or modified sequence opt3 from hemagglutinin__InfluenzaA__AGB13560

SEQ ID NO: 131835 - RNA, 1701 nt, Artificial Sequence; identical to SEQ ID NO: 128883
  derived and/or modified sequence opt3 from hemagglutinin__InfluenzaA__AGB13570

SEQ ID NO: 131836 - RNA, 1701 nt, Artificial Sequence
  derived and/or modified sequence opt3 from hemagglutinin__InfluenzaA__AGB13580
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugguggaacccggugauaagauuacuuucgaggccaccggcaaccuagucguuccuagguacgcuuuugccauggaacggaaugcaggguccggaaucauaauuagcgacacaccagugcaugauugcaacaccacgugucaaacuccgaaaggcgcuaucaauacaucgcuccccuuccagaacauucacccuaucaccaucgguaagugcccaaaguauguaaaaucuacuaagcugcgccuugccacagggcugagaaaugugcccuccauucagucaaggggauuguuuggcgcgauagccggcuucaucgaagggggauggaccgguauggucgacggcugguacggguaucaucaccagaacgaacaaggaaguggcuacgcagcugaccucaaaagcacgcagaaugccauugauaagaucaccaacaaaguuaauuccgugauagagaagaugaacacacaguuuacugcuguggguaaggaguucaaucaccuggaaaaacggauugagaacuuaaauaagaaagucgacgauggguuccuggacaucuggaccuacaacgccgaacuccuugugcuguuggagaaugaacgcacacuagauuaucaugacucuaacguaaagaaccuguacgagaaaguucgaaaucagcucaagaacaaugcaaaggagaucggcaacggauguuuugaguucuaucacaaaugcaauaacacuuguauggaaagcgugaagaauggcaccuacgauuauccuaaauacucagaagaggccaagcugaacagagaagagauugacggggucaaacuugagaguacaaggaucuaucaaauucuggcuauauacuccaccguggcgagcucuuugguccucgugguuucacugggagcaaucaguuuuuggaugugcagcaaugguuccuuacagugccggauuuguaucuga

SEQ ID NO: 131837 - RNA, 1701 nt, Artificial Sequence
  derived and/or modified sequence opt3 from hemagglutinin__InfluenzaA__AGB13590
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuugccauggaacggaaugcaggguccggaaucauaauuagcgacacaccagugcaugauugcaacaccacgugucagacuccgaagggcgcuaucaauacaucgcuccccuuccagaacauucacccuaucaccaucgguaaaugcccaaaguauguaaagucuacuaaacugcgccuugccacagggcugagaaaugugcccuccauucagucaaggggauuguuuggcgcgauagccggcuucaucgaagggggauggaccgguauggucgacggcugguacggguaucaucaccaaaacgaacagggaaguggcuacgcagcugaccucaagagcacgcagaaugccauugauaaaaucaccaacaagguaaauuccguuauagagaaaaugaacacacaguuuacugcuguggguaaggaguucaaucaccuggaaaagcggauugagaacuuaaauaaaaaggucgacgauggguuccuggacaucuggaccuacaacgccgaacuccuugugcuguuggagaaugaacgcacacuagauuaucaugacucuaacgugaaaaaccuguacgagaagguucgaaaucaacucaaaaacaaugcaaaggagaucggcaacggauguuuugaguucuaucacaagugcgauaauacuuguauggaaagcgugaaaaacggcaccuacgacuauccuaaguacucagaagaggccaaacugaauagagaagagauugauggggucaaacuugagaguacaaggaucuaucagauucuggcuauauacuccaccguggcgagcucuuugguccucgugguuucacugggagcaaucaguuuuuggaugugcagcaacgguuccuuacagugccggauuuguaucuga

SEQ ID NO: 131838 - RNA, 1701 nt, Artificial Sequence
  derived and/or modified sequence opt3 from hemagglutinin__InfluenzaA__AGB13600
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaaacaagucuuauauaaaugauaagggcaaagaaguacugguucuuuggggcauccaccaccccuccacgacugcugaccaacagucauuguaccagaacgccgaugcguacguguucgucgggaccagccgcuauaguaagaaauuuaagccugagauugcaauccgaccaaaagugcgugaccaggagggaagaaugaacuacuauuggacacugguggaacccggugauaagauuacuuucgaggccaccggcaaucuagucguuccuagguacgcuuuugccauggaacggaacgcagggucuggaaucauaauuuccgacacaccagugcaugauugcaauaccacgugucaaacuccgaaaggcgcuaucaacacaagccuccccuuccagaauauucacccuaucaccaucgguaagugcccaaaguauguaaaaucgacuaagcugcgccuugccacagggcugagaaacgugcccucuauucaguccaggggauuguuuggcgcgauagccggcuucaucgaagggggauggaccgguauggucgacggcugguacggguaucaucaccagaaugaacaaggaucaggcuacgcagcugaccucaaaaguacgcagaacgccauugauaagaucaccaauaaagugaacagcguuauagagaagaugaauacacaguuuacugcuguggguaaggaguucaaccaccuggaaaaacggauugagaauuuaaacaagaaagucgacgauggguuccuggacaucuggaccuacaaugccgaacuccuugugcuguuggagaacgaacgcacacuagauuaucaugacuccaacguaaagaaucuguacgagaaaguucgaaaccagcucaagaauaacgcaaaggagaucggcaauggauguuuugaguucuaucacaaaugcgauaacacuuguauggaaucugugaagaauggcaccuacgacuauccuaaauacagcgaagaggccaagcugaacagagaagagauugauggggucaaacuugagucaacaaggaucuaucaaauucuggcuauauacaguaccguggcguccagcuugguccucgugguuucucugggagcaaucucauuuuggaugugcaguaaugguagcuuacagugccggauuuguaucuga

SEQ ID NO: 131839 - RNA, 1701 nt, Artificial Sequence; identical to SEQ ID NO: 128883
  derived and/or modified sequence opt3 from hemagglutinin__InfluenzaA__AGB13610

SEQ ID NO: 131840 - RNA, 1701 nt, Artificial Sequence; identical to SEQ ID NO: 129102
  derived and/or modified sequence opt3 from hemagglutinin__InfluenzaA__AGB13620

SEQ ID NO: 131841 - RNA, 1701 nt, Artificial Sequence; identical to SEQ ID NO: 128470
  derived and/or modified sequence opt3 from hemagglutinin__InfluenzaA__AGB13630

SEQ ID NO: 131842 - RNA, 1701 nt, Artificial Sequence
  derived and/or modified sequence opt3 from hemagglutinin__InfluenzaA__AGB13640
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgguaucaccaauaaggugaacuccguuauagagaaaaugaauacacaguuuacugccguggggaaggaguucaaccaccuggaaaagcggauugagaauuuaaacaaaaaggucgaugacggcuuccuggauaucuggaccuacaaugcugaacuccuugugcuguuggagaacgaacgcacacuagacuaucaugauucuaauguaaagaaccuguacgagaagguucgaagccagcucaaaaacaaugccaaggagaucggaaacggcuguuuugaguucuaucacaagugcgacaauacuuguauggaaucagugaaaaacgggaccuacgauuauccaaaguacagugaagaggcaaaacugaauagagaagagauugacggagucaaacuugaguccacaaugaucuaucaaauucuggccauauacagcaccguggcuucuucauugguccucaucgugagucugggugcgauuagcuuuuggaugugcuccaacggcucuuuacagugcaggaucuguaucuga

SEQ ID NO: 131843 - RNA, 1701 nt, Artificial Sequence
  derived and/or modified sequence opt3 from hemagglutinin__InfluenzaA__AGB13650
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcgugaucaggagggaagaaugaauuacuauuggacacugguggaaccuggugacaagauuacuuucgaggcaaccggcaaccuagucguuccaagguacgccuuugcuauggaacggaacgccggguccggaaucauaauuagcgauacaccggugcacgacugcaauaccacgugucaaacucccaaaggcgcaaucaacacaucgcucccuuuccagaauauucacccaaucaccaucgguaagugccccaaguauguaaaaucuacuaagcugcgccuugcuacagggcugagaaacgugccuuccauucagucaaggggauuguuuggcgccauagcgggcuucaucgaagggggauggaccgguauggucgacggcugguacggguaucaucaccagaaugaacaaggaaguggcuacgccgcagaucucaaaagcacgcagaacgcuauugacgguaucaccaauaaggugaacuccguuauagagaaaaugaauacacaguuuacugccguggggaaggaguucaaccaccuggaaaagcggauugagaauuuaaacaaaaaggucgaugacggcuuccuggauaucuggaccuacaaugcugaacuccuuauccuguuggagaacgaacgcacacuagacuaucaugauucuaaugugaaaaaccuguacgagaagguacgaagccagcucaaaaacaaugccaaggagauuggaaacggcuguuuugaguucuaucacaagugcgacaauacuuguauggaaucaguuaaaaacgggaccuacgauuauccaaaguacagugaagaggcaaaacugaauagagaagagaucgacggagugaaacuugaguccacaaugauuuaucaaauacuggccaucuacagcaccgucgcuucuucauuggugcucauugucagucugggugcgaucagcuuuuggaugugcuccaacggcucuuuacagugcaggaucuguauuuga

SEQ ID NO: 131844 - RNA, 1701 nt, Artificial Sequence; identical to SEQ ID NO: 128840
  derived and/or modified sequence opt3 from hemagglutinin__InfluenzaA__AGB13660

SEQ ID NO: 131845 - RNA, 1701 nt, Artificial Sequence; identical to SEQ ID NO: 128451
  derived and/or modified sequence opt3 from hemagglutinin__InfluenzaA__AGB13721

SEQ ID NO: 131846 - RNA, 1701 nt, Artificial Sequence; identical to SEQ ID NO: 128883
  derived and/or modified sequence opt3 from hemagglutinin__InfluenzaA__AGB13731

SEQ ID NO: 131847 - RNA, 1701 nt, Artificial Sequence
  derived and/or modified sequence opt3 from hemagglutinin__InfluenzaA__AGB51356
augaaggccauccugcucgugcuucugugcaccuucgcugcaacaaacgccgacacuuuguguauuggcuaccacgcgaauaacagcacggauaccgucgacacaguuuuagagaaaaaugugacuguaacccauuccgugaaccugcuagaagauagacacaaugggaagcucugcaaacugggagguauagcuccccuucaucugggcaaguguaacaucgccgggugguugcucggaaauccugagugcgaacugcugcucacagucucuucauggaguuauauuguggagaccagcaacuccgacaauggcacuuguuacccaggugauuuuaucaacuaugaagaguuaagggagcagcugucuucgguuaguagcuucgaacgguuugagauuuucccgaaaacaaguuccuggcccaaucacgaaaccaaccgcggggugacggcagccugcccuuacgcuggagcaaauucuuuuuaucgaaaccuuaucugguuggucgagaagggcaauagcuacccaaagcuguccaaaucauaugugaacaacaagggcaaagaggugcuaguucucugggggauacaucaucccccuacuucaaccgaccaacagagccuguaccagaaugccgaugcuuacguguucgucggaucuuccaaguauaaccguaaauuuaagccagaaaucgccgcgagacccaaggugaggggucaggcaggccggaugaauuacuauuggacacuuauugagccuggggacacuaucaccuucgaagccacaggaaaccugguggucccacgcuacgcuuuugccaugaauagaggcucagguagcgggauuaucauaagugaugcaccgguucacgacuguaacaccaaaugccaaacgcccaagggagcuauuaauacuucuuugccuuuccagaacauccacccagugacaauuggcgagugucccaaauauguaaaguccaccaaacucaggauggccacuggccugcggaauaucccuagcauccagucgcgcggguuauuuggagcgauugccgguuucauagaaggcggguggacaggaaugaucgauggcugguacgguuaucaccaucagaacgagcaagggucuggcuacgcagcugaccagcgauccacccagaaugccauugauggaaucacgaacaagguaaauucagucauagagaaaaugaacacccaguuuacagcugugggcaaggaguucaaucaccuggaaaagagaauugaaaaccucaacaaaaagguugacgacggguuccuugauaucuggacuuacaaugccgagcuguuggugcuacuggaaaacgagaggacccucgacuuucacgauaguaaugucaaaaaccuguaugagaaggugcggagccaacuucguaauaacgcaaaagaaaucggaaaugguugcuucgaguuuuaccauaagugugacgauacaugcauggaauccguaaagaacggcacuuaugacuacccaaaauauucugaggaaagcaagcugaaucgcgaggagauugaugggguuaaauuggaaucaaccagaaucuaccagauucucgccauauauaguacaguggcuuccagccuggucuuacuggugucucuaggagcgaucucauucuggaugugcaguaacggcagccuccaguguaggauuugcaucuga

SEQ ID NO: 131848 - RNA, 1701 nt, Artificial Sequence
  derived and/or modified sequence opt3 from hemagglutinin__InfluenzaA__AGB97269
augaaggccauccuggugguccuccuuuacaccuucgcuacagcaaacgccgacacucugugcauuggcuaucacgcgaauaacagcacggauaccguugacacaguguuggagaaaaauauaacuguaacccauuccgugaacuuacuggaagauaagcacaaugggaaacuauguaagcucagaggagucgcuccccugcaucuugguaaaugcaacaucgccggcuggauucuggggaauccugagugugaaacauugucuaccgcaucaaguuggagcuacaucguggagacuuccucuucggacaacggaacaugcuauccaggcgauuuuauugacuacgaagaacucagggagcagcugucaagcguuaguuccuucgaacgguuugagaucuucccgaagaccucuagcuggcccaaucacgauuccaacaagggugugacggccgcuuguccucaugcaggggccaaaggauuuuauaagaaucugauauggcucgucaaaaagggcaacucauacccaaaauuaaguaagagcuauaucaaugacaagggcaaagaagugcugguacuuugggggauucaccaccccucuacuaccgcugaucaacaguccuuguaccagaacgccgacacauacguuuucgugggaacuucacgcuauagcaagaaauuuaagccugagaucgcgauucgaccaaaaguccgugaucaggaggguagaaugaauuacuauuggacccugguggaacccggcgacaagaucacauucgaggcaaccgggaaccuaguggucccuagguacgccuuugcuauggaacgggaugccggaaguggcauaauuaucucugacacgccaguucaugacugcaacacuacaugucaaaccccgaaaggugcaauuaauacuucccuccccuuccagaacauccacccuaucacaauugggaagugcccaaaguaugugaaaagcaccaagcugcgccuugcuacgggacugagaaauguacccucgauacagucuaggggcuuguuuggcgccaucgcgggguucauugagggagguuggaccggcaugguggaugggugguacggauaucaucaccagaacgaacaaggcuccgguuacgccgcagaccucaaaucaacacagaaugcuaucgauaagauaacuaacaaagucaauagugugauugagaagaugaacacccaguuuacagccguugggaaggaguucaaucaccuggaaaaacggaucgagaacuuaaauaagaaaguggacgauggcuuccuggacaucuggacuuacaacgcugaacuccuuguccuguuggagaaugaacgcacccuagauuaucaugacagcaacgugaagaaucuguacgagaaaguacgaaaccagcucaagaacaaugccaaggagauuggaaacggcuguuuugaguucuaucacaaaugcgauaauacauguauggaguccguuaagaacgggaccuacgacuauccuaaauacucugaagaggcaaagcugaauagagaagagaucgauggagugaaacuugagagcacuaggauuuaucaaauacuggccaucuacucaacggcugcgaguuccuugguccucguggucagccugggugcaauuucuuuuuggaugugcucaaacggcaguuuacagugccggaucuguaucuga

SEQ ID NO: 131849 - RNA, 1701 nt, Artificial Sequence; identical to SEQ ID NO: 130202
  derived and/or modified sequence opt3 from hemagglutinin__InfluenzaA__AGB97273

SEQ ID NO: 131850 - RNA, 1701 nt, Artificial Sequence
  derived and/or modified sequence opt3 from hemagglutinin__InfluenzaA__AGB97288
augaagaccaucauugcccugggcuacauacucugccuuguguucgcucagaaacugcccgggaacgacaauagcacagcaacuuuguguuuaggacaccaugccgucccuaacgguacgaucguuaagaccauuacaaaugauagaaucgaggugacuaacgcgaccgaacugguacaaaauuccucuauuggcgagaucugcgacucaccacaccagauacuagaugggaaaaacuguacacucaucgacgcucugcuuggagauccgcagugcgacggcuuucagaauaagaaaugggaucuguucauugaaaggaguaaggccuauagcaacuguuaccccuaugacgugccugauuacgcauccuugcggucucucgucgccucgucagguacccuggaguuuaauaacgagagcuucaauuggacuggggugacacaaaacggaaccaguuccgcuugcauccgccgaucuaauagcuccuuuuucucacgucugaacuggcucacgcauuuaaauuuuaaguauccagcacugaacguuacuaugcccaacaaugaacaguucgacaaacuuuacauuuggggcgugcaccauccuggcaccgauaaggaccagaucuuuuuguaugccaaaaguagcgggagaauaacagucucuacuaagaggucccagcaagcugugauuccaaacaucggaucacggccccgcauuagaaauaucccuagcaggaucaguauuuacuggaccauaguaaaaccaggugauauccugcuaauuaacucuacaggcaaucucaucgccccgcggggguacuucaagauacgcuccggaaagagcucgauuaugcgaucugacgcgcccaucggcaaauguaaguccgagugcaucaccccuaacgguucaauuccaaaugacaaacccuuucagaacguuaauagaaucacguauggggcauguccuagguacgugaagcagaguacucugaaacuugccacaggaaugcggaacgucccagaaaagcagacccguggcauuuucggcgcuauagccggguuuaucgagaauggaugggaagguaugguggauggcugguauggguuccgccaccaaaacagcgagggaagaggccaggcagcugaccugaaauccacucaggccgcgauugaucaaaucaaugguaaguugaacaggcucaucgggaagacaaaugagaaauuccaccagauugaaaaggaguuuucugaaguggagggccggauacaggaccuggaaaaauacgucgaggauaccaagaucgacuuauggagcuauaacgccgagcugcucguugcacuugaaaaccagcauacgauugaucugaccgacucagagaugaauaaauuguucgaaaagacaaagaaacaacuacgagagaacgcugaagauaugggaaauggcugcuuuaagaucuaccacaaaugugacaacgccugcauugggaguauccgcaauggaacuuaugaucauaacguguacagagacgaggcucugaauaacagguuccagauaaaggguguagagcucaaauccggcuacaaggacuggauccuguggauuagcuuugccaucucuugcuuccuucuguguguggcauugcucggguuuauuaugugggccugccagaagggaaauauccgguguaacauaugcauuuga

SEQ ID NO: 131851 - RNA, 1701 nt, Artificial Sequence
  derived and/or modified sequence opt3 from hemagglutinin__InfluenzaA__AGB97292
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugcgcucugacgcacccauugggaaauguaacuccgccugcaucacgccuaauggcucaauaccaaacgacaagcccuuucagaaugugaaccgaauuacuuacggugcuuguccuagauaugugaagcaaaauacacugaaacuugccaccgggaugaggaacgucccagagaagcagacucggggaaucuucggcgcaaucgcuggcuuuauugaaaaugggugggagggaaugguugaugguugguacggcuuccgucaccagaacagugaggggcgcggacaagccgcggaccugaaaagcacacaggccgcaaucgaucagauuaauggcaaguugaacagacucauagguaaaaccaacgaaaaguuccaucagaucgagaaagaauuuuccgagguggaagggaggauucaagaccuggagaaguauguagaggauacgaagaucgacuuauggucuuacaaugcugaacugcucguggcccuugagaaccagcacaccaucgaucugacagacagcgaaaugaauaaauuguucgagaagacuaaaaagcagcuacgggaaaacgcugaggauaugggcaauggaugcuuuaaaauuuaucauaagugugacaacgccugcauaggcucaauccgaaaugggaccuacgaucacgacgucuaucgcgacgaggcacugaacaauagauuccagauuaagggaguggaacucaaaagugguuacaaggauuggauccuguggauuuccuuugccaucagcugcuuccuucuguguguugcuuugcucggcuuuauaaugugggcgugccaaaaagggaacaucagguguaauauuugcaucuga

SEQ ID NO: 131852 - RNA, 1701 nt, Artificial Sequence
  derived and/or modified sequence opt3 from hemagglutinin__InfluenzaA__AGB97300
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacacgaaaacagcuacgcgaaaacgcugaggauaugggcaauggaugcuuuaagauuuaccacaagugugacaacgccugcaucggcuccauuagaaaugggacuuaugaucaugacguauacagggacgaggcucugaacaaucgguuccagaucaaaggaguggaacucaagagcgguuacaaagauuggauacuguggaucucuuuugccauuucaugcuuccuucugugugucgcauugcucggcuuuaucaugugggccugccagaaggggaacauucgcuguaauaucugcauauga

SEQ ID NO: 131853 - RNA, 1701 nt, Artificial Sequence
  derived and/or modified sequence opt3 from hemagglutinin__InfluenzaA__AGE89267
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccguggauuuacuggaagacaagcacaacgggaaacuauguaagcucagaggagucgcuccccugcaucuugguaaaugcaauaucgccggcuggauucuggggaacccugagugugaaucuuugucaacagcaaguagcugguccuacaucguggagaccucuucgucagauaauggaacuugcuauccaggcgacuuuauugauuacgaagaacucagggagcagcugagcaguguuuccucuuucgaacgguuugagaucuucccgaagacaagcuccuggcccaaccacgacucaaauaagggugugaccgccgcuuguccucaugcaggggaaaagaguuuuuauaagaaccugauauggcucgucaaaaagggaaauagcuacccaaaauuaaacaagucuuauaucaaugauaagggcaaagaggugcugguacuuuggggcauucaccaccccuccacgucaacugaccaacagagcuuguaccagaacgccgaugcuuacguuuucguggggaccagucgcuauucuaagaaauuuaagccugagaucgccauucgaccaaaaguccgugaccaggaaggaagaaugaauuacuauuggacacugguggagcccggugauaagaucacuuucgaagcgaccggcaaccuaguggucccuagguacgcauuugccauggagcggaacgcuggguccggaauaauuaucagcgacacaccaauucaugacugcaauaccacgugucaaacuccgaaaggcgccaucaacacaucgcuccccuuccagaauauccacccuauuaccauagguaagugcccaaaguauguuaaaucuacuaagcugcgccuugcaacagggcugagaaacgugcccuccauccagucaaggggauuguuuggcgcuauugccggcuucaucgaagggggauggaccgguaugguagauggcugguacggguaucaucaccagaaugagcaaggaaguggcuacgcggccgaccucaaaagcacgcagaacgcaauagaugagauuaccaauaaggugaacuccgucaucgagaaaaugaauacacaguuuacugcuguggguaaggaguucaaccaccuggaaaagcggaucgagaauuuaaacaaaaagguugacgauggguuccuggacauuuggaccuacaaugccgaacuccuugugcuguuggagaacgagcgcacacuagauuaucaugacucuaaugucaaaaaccuguacgaaaaggugaaaagccagcucaagaacaaugcuaaggagaucggcaacggauguuuugaguucuaucacaaaugcgauaauacuuguauggaaucaguaaagaacggcaccuacgacuauccuaaauacagugaagaggccaagcugaaucgagagaaaauugaugggguuaaacuugaauccacaagaauauaucaaauccuggcaauuuacagcaccguggccucuucauugguccucguggucagucugggagcuaucagcuuuuggaugugcuccaacgguucuuuacagugcaggaucuguauuuga

SEQ ID NO: 131854 - RNA, 1701 nt, Artificial Sequence
  derived and/or modified sequence opt3 from hemagglutinin__InfluenzaA__AGE89277
augaaggccauccugauugugcuccuuuacaccuucgcuacagcaaacgccgacacucugugcauaggcuaucacgcgaauaacagcacggauaccgucgacacaguuuuggagaaaaaugugacuguaacccauuccguggauuuacuggaagacaagcacaacgggaaacuauguaagcucagaggagucgcuccccugcaucuugguaaaugcaauaucgccggcuggauucuggggaacccugagugugaaucuuugucaacagcaaguagcugguccuacaucguggagaccucuucgucagauaauggaacuugcuauccaggcgacuuuauugauuacgaagaacucagggagcagcugaacagcguuaguuccuucgaacgguuugagaucuucccgaagacaucuagcuggcccaaucacgacuccaacaagggugugaccgccgcuuguccucaugcaggggaaaaaucauuuuauaagaaucugauauggcucgucaaaaagggaaacaguuacccaaaauuaaauaagagcuauaucaacgauaagggcaaagaggugcugguacuuuggggcauucaccaccccucuacguccacugaccaacagucauuguaccagaaugccgaugcuuacguuuucguggggaccagccgcuauaguaagaaauuuaagccugagaucgccauucgaccaaaaguccgugaccaggaaggaagaaugaacuacuauuggacacugguggagcccggugauaagaucacuuucgaagcgaccggcaaccuaguggucccuagguacgcauuugccauggagcggaaugcugggucuggaauaauuaucuccgacacaccaauucaugacugcaacaccacgugucaaacuccgaaaggcgccaucaauacaagccuccccuuccagaacauccacccuauuaccauagguaagugcccaaaguauguuaaaucgacuaagcugcgccuugcaacagggcugagaaaugugcccucuauccaguccaggggauuguuuggcgcuauugccggcuucaucgaagggggauggaccgguaugguagauggcugguacggguaucaucaccagaacgagcaaggaucaggcuacgcggccgaccucaaaaguacgcagaaugcaauagaugagauuaccaacaaggugaauagcgucaucgaaaagaugaacacacaguuuacugcuguggguaaggaguucaaucaccuggaaaagcggaucgagaacuuaaauaaaaagguugacgauggguuccuggacauuuggaccuacaacgccgaacuccuugugcuguuggagaaugagcgcacacuagauuaucaugacuccaacgucaaaaaccuguacgaaaaggugaaaucucagcucaagaauaacgcuaaggagaucggcaauggauguuuugaguucuaucacaaaugcgauaacacuuguauggagagcguaaagaauggcaccuacgacuauccuaaauacucagaagaggccaagcugaaccgagagaaaauugaugggguuaaacuugaaaguacaagaauauaucaaauccuggcaauuuacuccaccguggccagcucuuugguccucguggucucacugggagcuaucaguuuuuggaugugcagcaaugguuccuuacagugcaggaucuguauuuga

SEQ ID NO: 131855 - RNA, 1701 nt, Artificial Sequence; identical to SEQ ID NO: 130372
  derived and/or modified sequence opt3 from hemagglutinin__InfluenzaA__AGE89287

SEQ ID NO: 131856 - RNA, 1701 nt, Artificial Sequence
  derived and/or modified sequence opt3 from hemagglutinin__InfluenzaA__AGE89298
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccaaggagaucggaaauggcuguuuugaguucuaucacaaaugcgacaacaccuguauggagucugugaagaaugggacauacgauuauccuaaauacagcgaagaggcaaagcugaacagagaagagauugacggagucaaacuugagucaaccaggaucuaucaaauucuggccauauacaguacuguggcuuccagcuugauccucgucgugucucugggugcgauuucauuuuggaugugcaguaauggcagcuuacagugccggaucuguaucuga

SEQ ID NO: 131857 - RNA, 1701 nt, Artificial Sequence; identical to SEQ ID NO: 128925
  derived and/or modified sequence opt3 from hemagglutinin__InfluenzaA__AGE89308

SEQ ID NO: 131858 - RNA, 1701 nt, Artificial Sequence; identical to SEQ ID NO: 130367
  derived and/or modified sequence opt3 from hemagglutinin__InfluenzaA__AGE89318

SEQ ID NO: 131859 - RNA, 1701 nt, Artificial Sequence
  derived and/or modified sequence opt3 from hemagglutinin__InfluenzaA__AGE89329
augaagaccaucauugcccugagcuacauacucugccuuguguucgcucagaaacugcccggcaacgacgauuccacagcaacuuuguguuuagggcaccaugccgucccuaauggaacgaucguuaagaccauuacaaacgaccaaaucgaggugacuaaugcgaccgaacugguacagucuucaaguacaggugagauuugcaacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgacaagcuguauauuuggggaguccaucacccuggcacagauaaagaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaaaccaggagauauccugcuaaucaacucuaccgguaaucucauugcgccgaggggcuacuucaagauacgguccgggaaaagcucgaucaugcgcucugacgcacccauuggaaaguguaacuccgccugcaucacgccuaauggcucaauaccaaacgacaagcccuuucagaaugugaaccgaauuacuuacggugcuuguccuagauaugugaaacaaaauacacugaaacuugccaccgggaugaggaacgucccagaaaaacagacucggggaaucuucggcgcaaucgcuggcuuuauugagaaugggugggaaggaaugguugaugguugguacggcuuccgucaccagaacagugaggggcgcggacaagccgcggaccuuaagagcacacaggccgcaaucgaucagauuaauggcaaauugaacagacucauagguaagaccaacgagaaauuccaucagaucgaaaaggaguuuuccgaaguggaggggaggauucaagaccuggaaaaguauguagaggauacgaaaaucgacuuauggucuuacaaugcugagcugcucguggcccuugaaaaccagcacaccaucgaucugacagacagcgagaugaauaaguuguucgaaaagacuaagaaacagcuacgggagaacgcugaagauaugggcaauggaugcuuuaagauuuaucauaagugugacaacgccugcauaggcucaauccgaaaugggaccuacgaucacgacgucuaucgcgacgaggcacugaacaauagauuccagauuaaaggaguggagcucaagagugguuacaaagauuggauccuguggauuuccuuugccaucagcugcuuccuucuguguguugcuuugcucggcuuuauaaugugggcgugccaaaaggggaacaucagguguaauauuugcaucuga

SEQ ID NO: 131860 - RNA, 1701 nt, Artificial Sequence; identical to SEQ ID NO: 128470
  derived and/or modified sequence opt3 from hemagglutinin__InfluenzaA__AGE89340

SEQ ID NO: 131861 - RNA, 1701 nt, Artificial Sequence; identical to SEQ ID NO: 130370
  derived and/or modified sequence opt3 from hemagglutinin__InfluenzaA__AGE89350

SEQ ID NO: 131862 - RNA, 1701 nt, Artificial Sequence
  derived and/or modified sequence opt3 from hemagglutinin__InfluenzaA__AGE89361
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacuaccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugguggaacccggugauaagauuaccuucgaggcaacaggcaaccuagucguuccuagguacgccuuugcuauggaacggaaugccggguccggaaucauaauuagcgacaccccagugcaugauugcaacacgacuugucaaacaccgaaaggcgcaaucaauaccucgcuccccuuccagaacauucacccuaucacuaucgguaagugcccaaaguauguaaaaucuacaaagcugcgccuugcuaccgggcugagaaaugugcccuccauucagucaaggggauuguuuggcgccauagcgggcuucaucgaagggggauggacggguauggucgacggcugguacggguaucaucaccagaacgaacaaggaaguggcuacgccgcagaccucaaaagcacccagaaugcuauugauaagaucacaaacaaaguuaauuccgugauagagaagaugaacacucaguuuaccgccguggguaaggaguucaaucaccuggaaaaacggauugagaacuuaaauaagaaagucgacgauggguuccuggacaucuggacauacaacgcugaacuccuugugcuguuggagaaugaacgcacucuagauuaucaugacucuaacguaaagaaccuguacgagaaaguucgaaaucagcucaagaacaaugccaaggagaucggcaacggauguuuugaguucuaucacaaaugcgauaauaccuguauggaaagcgugaagaacggcacauacgacuauccuaaauacucagaagaggcaaagcugaauagagaagagauugauggggucaaacuugagaguaccaggaucuaucaaauucuggccauauacuccacuguggcuagcucuuugguccucgugguuucacugggagcgaucaguuuuuggaugugcagcaacgguuccuuacagugccggauuuguaucuga

SEQ ID NO: 131863 - RNA, 1701 nt, Artificial Sequence; identical to SEQ ID NO: 130367
  derived and/or modified sequence opt3 from hemagglutinin__InfluenzaA__AGE89371

SEQ ID NO: 131864 - RNA, 1701 nt, Artificial Sequence
  derived and/or modified sequence opt3 from hemagglutinin__InfluenzaA__AGE89382
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucaaacccggugauaagaucacauucgaagccacuggcaaccuacucguuccuagauacgcuuuugccauggagaggaaugcagggagcggaauuaucauaucggacaccccagugcaugauugcaacacaaccugucaaacgccgaagggcgcuauuaauacuucucugcccuuccagaacauccacccuauuacaaucgguaaaugcccaaaguauguaaaauccaccaaacuucggcuggccacuggguugcgcaaugugcccucaauccagaguagaggacucuuuggcgcgauugccggcuucauagaagggggauggacagguauggucgacggcugguacggguaucaucaccagaacgagcaaggaagcggcuacgcagcugaccugaaauccacccagaaugccaucgauaagauuacgaacaagguuaauucugugaucgaaaagaugaacacccaguuuacagcuguggguaaggaguucaaucacuuagagaaaaggauagaaaaccugaauaagaaagucgacgauggguuccucgacauuuggacuuacaacgccgagcuucugguguugcuagaaaaugagcggacccuggauuaucaugacagcaacguaaagaaccucuacgaaaagguucgcucacagcugaaaaauaacgcaaaggagaucggcaauggauguuuugaguucuaucacaaaugcgauaacacauguauggaaagugugaagaauggcacuuacgacuauccuaaauacuccgaggaagccaaacuuaaccgagaggaaaucgauggggucaagcuggagagcaccagaauuuaucaaaucuuggcuauuuacucuacaguggcgucaagucucguccuggugguuagcuuaggagcaauauccuuuuggaugugcucuaaugguucgcugcagugcaggaucuguauuuga

SEQ ID NO: 131865 - RNA, 1701 nt, Artificial Sequence
  derived and/or modified sequence opt3 from hemagglutinin__InfluenzaA__AGE89392
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguuaucccuacgaugucccugacuaugcaucguugaggucacucguggccagcaguggcacucuggaguuuaauaacgaguccuucaauuggacagguguuacccagaacgggacgucuagcgcuugcauccggcgcuccaauaacucauuuuucagucgacugaauuggcucacucacuuaaacuuuaaauacccagcacugaacgugaccaugcccaauaacgaacaguucgauaaacuuuauauuuggggaguccaucacccuggcacagacaaggaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaagccaggagacauccugcuaaucaauucuaccgguaaccucauugcgccgaggggcuacuucaaaauacgguccggaaagagcucgaucaugcgcucugaugcacccauugggaaauguaauuccgccugcaucacgccuaacggcucaauaccaaaugacaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugacgguugguacggcuuccgucaccagaauagugaggggcgcggacaagccgcggaucugaaaagcacacaggccgcaaucgaccagauuaacggcaaguugaacagacucauagguaaaaccaaugaaaaguuccaucagaucgagaaagaauuuuccgagguggaagggaggauucaagaucuggagaaguauguagaggacacgaagaucgauuuauggucuuacaacgcugaacugcucguggcccuugagaaucagcacaccaucgaccugacagauagcgaaaugaacaaauuguucgagaagacuaaaaagcagcuacgggaaaaugcugaggacaugggcaacggaugcuuuaaaauuuaucauaagugugauaaugccugcauaggcucaauccgaaacgggaccuacgaccacgaugucuaucgcgacgaggcacugaauaacagauuccagauuaagggaguggaacucaaaagugguuacaaggacuggauccuguggauuuccuuugccaucagcugcuuccuucuguguguugcuuugcucggcuuuauaaugugggcgugccaaaaagggaauaucagguguaacauuugcaucuga

SEQ ID NO: 131866 - RNA, 1701 nt, Artificial Sequence; identical to SEQ ID NO: 131853
  derived and/or modified sequence opt3 from hemagglutinin__InfluenzaA__AGE89422

SEQ ID NO: 131867 - RNA, 1701 nt, Artificial Sequence; identical to SEQ ID NO: 130350
  derived and/or modified sequence opt3 from hemagglutinin__InfluenzaA__AGE89719

SEQ ID NO: 131868 - RNA, 1701 nt, Artificial Sequence
  derived and/or modified sequence opt3 from hemagglutinin__InfluenzaA__AGE89730
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccagaacauccacccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaucaccagaacggacaaggcagcgguuacgcagcugaccugaaguccacccagaaugccaucgauaaaauuacgaacaagguaaauucuguuaucgaaaagaugaacacccaguuuacagcuguggggaaagaguucaaucacuuagagaagaggauagaaaaccugaauaaaaaggucgacgauggcuuccucgacauuuggacuuacaacgccgagcuucugguguugcuagaaaaugagcggacccuggauuaucaugacagcaacgugaaaaaccucuacgaaaagguucgcucacagcugaagaauaacgcaaaagagaucggaaauggcuguuuugaguucuaucacaagugcgauaacacauguauggaaagugugaaaaaugggacuuacgacuauccuaaguacuccgaggaagccaaacuuaaccgagaggaaaucgauggagucaagcuggagagcaccagaauuuaucaaaucuuggcuauuuacucuacaguggcgucaagucucguccuggugguuagcuuaggugcaauauccuuuuggaugugcucuaauggcucgcugcagugcaggaucuguauuuga

SEQ ID NO: 131869 - RNA, 1701 nt, Artificial Sequence; identical to SEQ ID NO: 130367
  derived and/or modified sequence opt3 from hemagglutinin__InfluenzaA__AGE89740

SEQ ID NO: 131870 - RNA, 1701 nt, Artificial Sequence
  derived and/or modified sequence opt3 from hemagglutinin__InfluenzaA__AGE89751
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuggugagauuugcgacagcccacaccauauccuagauggcgaaaauuguacacucauagacgcccugcuuggggauccgcagugcgacggauuucagaacaaaaagugggaucuguucguggagagauccagggcauauucuaauuguuaccccuaugacgucccugauuacgccucguugcggucacucguggcuagcaguggcacccuggaauuuaacaaugaguccuucaacuggacugguguuacacaaaaugggaccucuagcgcaugcauccgccgauccaacaauucauuuuucagucgucugaacuggcucacgcacuuaaauuuuaaauauccagcccugaacgugacuaugcccaacaaugagcaguucgacaaacuuuacauuuggggaguccaucacccuggcaccgauaaggaccagaucuuuuuguaugcucaggccagcggcagaauuacagugucuacuaaaaggucccaacaggcgguaaucccaaacauagggucacggccccgcguuagaaauauuccuagcaggaucaguauuuacuggaccaucgugaagccaggagauauccugcuaauuaacucuacagguaaucucauagcaccgcggggcuacuucaaaauccgcuccggaaagagcucgauuaugcgaucugacgcccccaucgggaaauguaacuccgaaugcauaaccccuaauggcucaauuccaaacgacaagcccuuucagaaugucaacagaaucacguauggugcuuguccuagguacgugaagcagaguacucugaaacuugccacagggaugcggaaugugccagagaagcaaacccguggaaucuucggcgcaauugcuggcuuuaucgaaaacgggugggagggaaugauggaugguugguauggcuuccgccaccagaauagcgaggggagaggacaggccgcggaccugaaauccacucaagccgcaauugaucagauaaacggcaaguugaauaggcucaucgguaaaacaaacgaaaaguuccaucagauugagaaagaauuuucugaggucgaagggcggauccaggaccuggagaaguacguugaggauaccaagaucgacuuauggagcuauaacgcugaacugcucguggccauggagaaucaacacacgauugaucuuaccgacucagaaaugaacaaacuguucgagaagacaaagaagcaguugcgagaaaaugcugaggauaugggcaacggaugcuuuaaaauauaccauaagugugacaaugccugcaucggcaguauucgcaacgggacuuaugaucacgacguauacagagacgaggcacuauccaauagguuccagaucaagggaguggaacugaaaagcgguuacaaggauuggauucucuggaucucuuuugccauaucaugcuuccugcuuugugucgcucuguugggcuuuaucaugugggcgugccagaaagggaacauucgguguaauaucugcauuuga

SEQ ID NO: 131871 - RNA, 1701 nt, Artificial Sequence; identical to SEQ ID NO: 130370
  derived and/or modified sequence opt3 from hemagglutinin__InfluenzaA__AGE89762

SEQ ID NO: 131872 - RNA, 1701 nt, Artificial Sequence
  derived and/or modified sequence opt3 from hemagglutinin__InfluenzaA__AGF44891
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugauugaacccggugauaagaucacuuucgaggccaccggcaaccuaguggucccuagguacgcuuuugccauggaacggaaugcaggguccggaauaauuaucagcgacacaccaguucaugauugcaacaccacgugucaaacuccggagggcgcuauuaauacaucgcuccccuuccagaacauccacccuaucaccauugguaaaugcccaaaguaugugaagucuacuaaacugcgccuugccacagggcugagaaauguacccuccauacagucaaggggauuguuuggcgcgaucgccggcuucauugaagggggauggaccgguaugguggacggcugguacggguaucaucaccagaacgagcaaggaaguggcuacgcagcugaccucaagagcacgcagaaugccgucgauaaaaucaccaacaagguaaauuccguuauagagaaaaugaacacacaguuuacugcuguggguaaggaguucaaucaccuggagaagcggauugaaaacuuaaauaaaaaggucgacgauggguuccuggacaucuggaccuacaacgccgagcuccuugugcuguuggaaaaugagcgcacacuagauuaucaugacucuaacgugaaaaaccuguacgagaagguucgaaaucagcucaaaaacaaugcaaaggaaaucggcaacggauguuuugaguucuaucacaagugcgauaauacuuguauggaaagcgugaaaaacggcaccuacgacuauccuaaguacucagaggaagccaaacugaauagagagaagauugauggggucaaacuugagaguacaaggaucuaucaaauucuggcuauauacuccaccguggcgagcucuuugguccucgugguuucacugggagcaaucaguuuuuggaugugcagcaacgguuccuuacagugccggauuuguaucuga

SEQ ID NO: 131873 - RNA, 1701 nt, Artificial Sequence; identical to SEQ ID NO: 131872
  derived and/or modified sequence opt3 from hemagglutinin__InfluenzaA__AGF44892

SEQ ID NO: 131874 - RNA, 1701 nt, Artificial Sequence
  derived and/or modified sequence opt3 from hemagglutinin__InfluenzaA__AGF44895
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaaggacuggauacuguggaucucuuuugccauuucaugcuuccuucugugugucgcauugcucggcuuuaucaugugggccugccagaaagggaauauucgguguaacaucugcauauga

SEQ ID NO: 131875 - RNA, 1701 nt, Artificial Sequence; identical to SEQ ID NO: 131851
  derived and/or modified sequence opt3 from hemagglutinin__InfluenzaA__AGF44896

SEQ ID NO: 131876 - RNA, 1701 nt, Artificial Sequence
  derived and/or modified sequence opt3 from hemagglutinin__InfluenzaA__AGF44897
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcaugcggcgcuccaacaauucauuuuucagucgacugaacuggcucacucacuuaaauuuuaaauacccagcacugaacgugaccaugcccaacaaugaacaguucgacaaguuguauaucuggggaguccaucacccuggcacagauaaggaccagauuuuucuuuacgcccaagcuagcggccguaucacugugucuaccaaaagaucccagcaggccguaauuccaaacaucgggucaaggccccggguucgcaauauaccuagcagagugaguauuuauuggacaaucgucaagccaggagauauucugcuaaucaacucuaccgguaaucucaucgcgccgaggggcuacuucaaaauucaguccggaaagagcucgauaaugcggucugacgcacccaucgggaaauguaacuccgccugcauuacgccuaauggcucaaucccaaacgacaagcccuuucaaaaugugaaccgcauaacuuacggugcuuguccucgauaugugaagcagaauacacugaaacuugccaccgggaugagaaacgucccagagaagcagacuaggggaauuuucggcgcaaucgcuggcuuuaucgaaaaugggugggagggaaugguugaugguugguacggcuuccggcaccaaaacagugaggggcguggacaggccgcggaccugaaaagcacacaggccgcaauugaucagaucaauggcaaguugaaccgccucauugguaaaaccaacgaaaaguuccaucaaauagagaaagaauuuuccgagguggaagggagaauccaggaccuggagaaguauguagaggauacgaagauugacuuauggucuuacaaugcugaacugcucguggcccuugagaaccagcacaccaucgaucugacagacagcgaaaugaauaaauuguucgagaagacuaaaaagcagcuaagggaaaacgcugaggauaugggcaauggaugcuuuaaaaucuaucauaagugugacaacgccugcauuggcucaauacggaaugggaccuacgaucacgacgucuaucgagacgaggcacugaacaaucgcuuccaaaucaagggaguggaacucaaaagugguuacaaggauuggauucuguggaucuccuuugccauuagcugcuuccuucuguguguugcuuugcucggcuuuaucaugugggcgugccagaaagggaacauaagauguaauaucugcauuuga

SEQ ID NO: 131877 - RNA, 1701 nt, Artificial Sequence; identical to SEQ ID NO: 131874
  derived and/or modified sequence opt3 from hemagglutinin__InfluenzaA__AGF44900

SEQ ID NO: 131878 - RNA, 1701 nt, Artificial Sequence; identical to SEQ ID NO: 131874
  derived and/or modified sequence opt3 from hemagglutinin__InfluenzaA__AGF44901

SEQ ID NO: 131879 - RNA, 1701 nt, Artificial Sequence; identical to SEQ ID NO: 131874
  derived and/or modified sequence opt3 from hemagglutinin__InfluenzaA__AGF44902

SEQ ID NO: 131880 - RNA, 1701 nt, Artificial Sequence; identical to SEQ ID NO: 131874
  derived and/or modified sequence opt3 from hemagglutinin__InfluenzaA__AGF44903

SEQ ID NO: 131881 - RNA, 1701 nt, Artificial Sequence; identical to SEQ ID NO: 131874
  derived and/or modified sequence opt3 from hemagglutinin__InfluenzaA__AGF44904

SEQ ID NO: 131882 - RNA, 1701 nt, Artificial Sequence
  derived and/or modified sequence opt3 from hemagglutinin__InfluenzaA__AGF44905
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaaacacguauggugcauguccuagguacgucaagcagagcacucugaaacuugccacagggaugcggaaugugccagagaagcaaacccguggaauuuucggcgcuaucgccggcuuuauugaaaacgggugggagggaaugguggaugguugguauggcuuccgccaccaaaauuccgaggggagaggacaggcagcugaccugaaaucuacucaggccgcgauagaucagaucaacggcaaguugaauaggcucauugguaaaacaaacgaaaaguuccaccagaucgagaaggaauuuagcgaggucgaagggcggauccaggaccuggagaaauacguugaggauaccaagauugacuuauggucauauaacgccgaacugcucguggcacuugagaaucaacauacgauagaucugaccgacagugaaaugaacaaauuguucgagaagacaaagaagcagcuacgagaaaaugcugaggauaugggcaacggaugcuuuaagaucuaccacaaaugugacaaugccugcauuggcuccauccgcaacgggacuuaugaucauaauguauacagagacgaggcucugaacaauagguuccagauuaagggaguggaacucaaaagcgguuacaaggacuggauccuguggauaucuuuugccaucucaugcuuccuucugugugucgcauugcucggcuuuauuaugugggccugccagaaagggaacauccgguguaauauuugcaucuga

SEQ ID NO: 131883 - RNA, 1701 nt, Artificial Sequence; identical to SEQ ID NO: 131874
  derived and/or modified sequence opt3 from hemagglutinin__InfluenzaA__AGF44906

SEQ ID NO: 131884 - RNA, 1701 nt, Artificial Sequence
  derived and/or modified sequence opt3 from hemagglutinin__InfluenzaA__AGF44908
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugauggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgagguggaaggcaggauucaggaccuggagaaauacgucgaggauacaaagauagacuuauggucauauaacgcagaacugcucguugcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguguaccgcgacgaggcccugaacaauagauuccagaucaaggguguagaacucaaaagcggcuacaaggauuggauacuguggaucucuuuugcaauuucaugcuuccuucuguguguggccuugcucggguuuaucaugugggcuugccagaaaggaaacauuagguguaauaucugcauauga

SEQ ID NO: 131885 - RNA, 1701 nt, Artificial Sequence; identical to SEQ ID NO: 131874
  derived and/or modified sequence opt3 from hemagglutinin__InfluenzaA__AGF44909

SEQ ID NO: 131886 - RNA, 1701 nt, Artificial Sequence; identical to SEQ ID NO: 131874
  derived and/or modified sequence opt3 from hemagglutinin__InfluenzaA__AGF44910

SEQ ID NO: 131887 - RNA, 1701 nt, Artificial Sequence
  derived and/or modified sequence opt3 from hemagglutinin__InfluenzaA__AGF44911
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaacuucaugcuuccuucugugugucgccuugcucggguuuauuaugugggcuugccagaaaggaaacaucagguguaauauuugcaucuga

SEQ ID NO: 131888 - RNA, 1701 nt, Artificial Sequence; identical to SEQ ID NO: 131874
  derived and/or modified sequence opt3 from hemagglutinin__InfluenzaA__AGF44912

SEQ ID NO: 131889 - RNA, 1701 nt, Artificial Sequence; identical to SEQ ID NO: 131874
  derived and/or modified sequence opt3 from hemagglutinin__InfluenzaA__AGF44913

SEQ ID NO: 131890 - RNA, 1701 nt, Artificial Sequence
  derived and/or modified sequence opt3 from hemagglutinin__InfluenzaA__AGF44914
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauaagauuacguauggugcauguccuagauacgucaaacagagcacucugaaacuugccacagggaugaggaacgugccagagaagcaaacccggggaaucuucggcgcuauugccggcuuuauagaaaaugggugggagggaaugguggaugguugguauggcuuccgucaccagaacuccgaggggcgcggacaggcagcugaccugaagucuacucaagccgcgaucgaucagauuaauggcaaauugaacagacucaucgguaagacaaaugaaaaguuccaccagaucgagaaagaauuuagcgaggucgaagggaggauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaagcagcuacgggaaaacgcugaggauaugggcaauggaugcuuuaaaauuuaccacaagugugacaacgccugcaucggcuccauucgaaaugggacuuaugaucauaacguauaccgcgacgaggcucugaauaacagauuccagaucaaaggaguggaacucaagagcgguuacaaagacuggauacuguggaucucuuuugccauuucaugcuuccuucugugugucgcauugcucggcuuuaucaugugggccugccagaaggggaauauuagguguaacaucugcauauga

SEQ ID NO: 131891 - RNA, 1701 nt, Artificial Sequence; identical to SEQ ID NO: 131851
  derived and/or modified sequence opt3 from hemagglutinin__InfluenzaA__AGF44916

SEQ ID NO: 131892 - RNA, 1701 nt, Artificial Sequence
  derived and/or modified sequence opt3 from hemagglutinin__InfluenzaA__AGF44917
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugagcaaauugaagugacuaacgcgaccgaguuaguacagucuucaaguacaggugaaaucugcaauagcccacaccagauacuggauggcgagaacuguacccuaaucgacgcucuccugggggauccgcagugcgacggauuucaaaauaaaaagugggaucuuuucguggaaagauccaaagccuauucuaacuguuaccccuaugacgucccugauuacgcaucgcugaggucauugguggccagcaguggcacucucgaguuuaauaacgaguccuucaauuggacagguguuacccagaacgggacgucuagcgcuugcauucggggauccgacucaaguuucuuuagccgccugaauuggcugacucaucucaacuuuaaguauccagcauuaaaugugaccaugcccaacaacgaacaguucgauaagcuguacaucuggggcguccaccauccuggcacagacaaagaucagauuuuucuuuaugcccaggcuucugggcgaaucacuguguccaccaagcguucacaacaggccguaauaccaaauauuggaagcagacccaggauccggaacauuccuagucgcaucucuaucuacuggacaauuguuaaaccaggugacauauugcugaucaauuccaccggcaaccuaauugcgccgagaggguacuucaagaucaggagcggaaaaucgucuauaaugcgguccgaugcacccauuggcaaguguaauucagagugcaucacgccuaacgguaguaucccaaaugacaagcccuuucagaacgugaaucgcauuacuuauggggccuguccucgauacgucaaacaaaacacacucaagcuggcuaccggaaugagaaaugugccagaaaaacagacuaggggcaucuucggcgccauugcaggguuuauagagaacggaugggaggguaugauggacggcugguauggguuccggcaccagaauagcgaaggacguggccaagcugccgaucuuaaguccacacaggcggccaucgaccagauuaacgguaaacugaaucgcuugaucgggaagaccaacgagaaauuccaccagaucgaaaaggaguuuucugaaguggagggcaggauucaagaucucgagaaguacgucgaagacacgaaaauagaucuguggagcuauaacgcagaguuacugguugcucucgaaaaucagcauaccaucgaccuuacagauucagagaugaacaagcuguucgagaaaacuaagaaacaguugagagaaaaugccgaggacaugggaaacggcugcuuuaagauuuaccacaagugugauaaugcuugcaucgggaguauucggaacggaaccuauaaucaugacguguaccgagaugaagcccuaaacaaucgcuuccagaucaaagguguagagcugaaguccggcuacaaagacuggauacucuggaucagcuuugcaauuucuugcuuccugcuuuguguggcccuguugggguuuaucaugugggcuugccaaaagggaaacauuagauguaauaucugcauauga

SEQ ID NO: 131893 - RNA, 1701 nt, Artificial Sequence; identical to SEQ ID NO: 131851
  derived and/or modified sequence opt3 from hemagglutinin__InfluenzaA__AGF44918

SEQ ID NO: 131894 - RNA, 1701 nt, Artificial Sequence
  derived and/or modified sequence opt3 from hemagglutinin__InfluenzaA__AGF44919
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucauuacguauaccgcgacgaggcccugaacaauagauuccagaucaaggguguggaacucaaaagcggcuauaaggacuggauacuguggaucucuuuugcaauuucaugcuuccuucugugugucgccuugcucggguuuaucaugugggcuugccagaaaggaaacauuagguguaauaucugcauauga

SEQ ID NO: 131895 - RNA, 1701 nt, Artificial Sequence; identical to SEQ ID NO: 131851
  derived and/or modified sequence opt3 from hemagglutinin__InfluenzaA__AGF44920

SEQ ID NO: 131896 - RNA, 1701 nt, Artificial Sequence; identical to SEQ ID NO: 131874
  derived and/or modified sequence opt3 from hemagglutinin__InfluenzaA__AGF44921

SEQ ID NO: 131897 - RNA, 1701 nt, Artificial Sequence
  derived and/or modified sequence opt3 from hemagglutinin__InfluenzaA__AGG13411
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgacagaaucgaagugacuaaugcgaccgagcugguacaaucuucaaguacaggugaaauuugcaacagcccacaccagauccuagauggcgagaauuguacccucauagacgcucugcuuggggauccgcagugcgacggauuucagaacaagaaaugggaucuguucguggaaagguccaaggcccauucuaauuguuaucccuacgacgucccugauuaugcaucguugcggucacucguggccagcaguggcacucuggaguuuaacaaugaguccuucaacuggacagguguuacccaaaaugggacgucuagcgcuugcauccgccgauccaacaauucauuuuucagucgucugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaggcuagcggcagaauuacugugucuaccaagaggaaccaacagacaguaaucccaaauauagggucccggccccgcguuagaaacauuccuucaagggugagcaucuauuggaccauugucaagccaggagauauccugcuaaucaauaguacggguaaccucauugccccgcggggcuacuucaaaauacgcucugggaaguccagcaucaugcgaucggacgcgcccauuggaaaauguaauucugcaugcaucacuccuaacggcuccauaccaaaugacaagcccuuucagaacgugaauagaauuacauacggugccuguccuagguaugugaagcagaacacccugaaacuugcuacugggaugcggaaugucccagagaagcaaacacguggaaucuucggcgccaucgcaggcuuuauugaaaacgggugggagggaaugguugaugguugguacggcuuccgccaccaaaauucagaggggagaggacaggcugccgaccugaaaaguacccaggcggccaucgaucagauuaacggcaaguugaacaggcucauagguaaaacgaaugaaaaguuccaucagaucgagaaagaauuuagcgagguggaagggcggauucaggaccuggagaaguauguagaggauaccaagaucgacuuaugguccuacaacgcagaacugcucguggcucuugagaaucaacacacaaucgaucugacugacucugaaaugaacaaauuguucgagaagaccaaaaagcagcuacgagaaaaugccgaggauaugggcaacggaugcuuuaaaauuuaucauaagugugacaaugcuugcauaggcagcauccgcaacgggacauacgaucacgacgucuauagagacgaggcccugaauaacagguuccagauuaagggaguggaacucaaaucagguuacaaggauuggauccuguggauuaguuuugcaaucuccugcuuccuucuguguguugccuugcucggcuuuauaaugugggcuugccagaaagggaauauccgguguaacauuugcaucuga

SEQ ID NO: 131898 - RNA, 1701 nt, Artificial Sequence
  derived and/or modified sequence opt3 from hemagglutinin__InfluenzaA__AGG13447
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgacagaaucgaagugacuaaugcgaccgagcugguacaaucuucaaguacaggugaaauuugcaacagcccacaccagauccuagauggcgagaauuguacccucauagacgcucugcuuggggauccgcagugcgacggauuucagaacaagaaaugggaucuguucguggaaagguccaaggcccauucuaauuguuaucccuacgacgucccugauuaugcaucguugcggucacucguggccagcaguggcacucuggaguuuaacaaugaguccuucaacuggacagguguuacccaaaaugggacgucuagcgcuugcauccgccgauccaacaauucauuuuucagucgucugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaggcuagcggcagaauuacugugucuaccaagaggucccaacagacaguaaucccaaacauagggucacggccccgcguuagaaauauuccuagcagggugaguaucuauuggaccauugucaagccaggagauauccugcuaaucaacucuacggguaaucucauugccccgcggggcuacuucaaaauacgcuccggaaagagcucgaucaugcgaucugacgcgcccauugggaaauguaacuccgcaugcaucacuccuaauggcucaauaccaaacgacaagcccuuucagaaugugaacagaauuacauacggugccuguccuagguaugugaagcagaauacccugaaacuugcuacugggaugcggaacgucccagagaagcaaacacguggaaucuucggcgccaucgcaggcuuuauugaaaaugggugggagggaaugguugaugguugguacggcuuccgccaccagaacagugaggggagaggacaggcugccgaccugaaaagcacccaagcggccaucgaucagauuaauggcaaguugaacaggcucauagguaaaacgaacgaaaaguuccaucagaucgagaaagaauuuuccgagguggaagggcggauucaggaccuggagaaguauguagaggauaccaagaucgacuuauggucuuacaaugcagaacugcucguggcucuugagaaccaacacacaaucgaucugacugacagcgaaaugaauaaauuguucgagaagacccagaaacagcuacgagaaaacgccgaggauaugggcaauggaugcuuuaagauuuaucauaaaugugacaacgcuugcauaggcucaauccgcaaugggacauacgaucacgacgucuauagagacgaggcccugaacaauagguuccagauuaagggaguggaacucaagagugguuacaaagauuggauccuguggauuuccuuugcaaucagcugcuuccuucuguguguugccuugcucggcuuuauaaugugggcuugccaaaaggggaacauccgguguaauauuugcaucuga

SEQ ID NO: 131899 - RNA, 1701 nt, Artificial Sequence
  derived and/or modified sequence opt3 from hemagglutinin__InfluenzaA__AGG13459
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucaugacguauacagagacgaggcucugaacaauagguuccagaucaagggaguggaacucaaaagcgguuacaaggauuggauacuguggaucucuuuugccauuucaugcuuccuucugugugucgcauugcucggcuuuaucaugugggccugccagaaagggaacauucgguguaauaucugcauauga

SEQ ID NO: 131900 - RNA, 1701 nt, Artificial Sequence
  derived and/or modified sequence opt3 from hemagglutinin__InfluenzaA__AGG13495
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccgacucaaguuucuuuagccgacugaacuggcucacucauuuaaauuuuaaguauccagcacugaacgugaccaugcccaauaacgagcaguucgauaaacuuuacauuuggggaguccaccauccuggcacagacaaggaucagaucuuuuuguaugcccaggcuucuggccguauuacuguguccaccaagagaucacaacagagcguaaucccaaacauagggaguaggccccggauucgcaauaucccuucuagaauuuccaucuacuggacaaucguuaaaccaggagacauucugcuaauaaacagcaccgguaaucucaucgccccgaggggcuacuucaagauucagucggggaaaucuuccaucaugcggucagacgcgcccauaggaaaguguaacagugaaugcauuacgccuaauggcagcaucccaaacgauaagcccuuucaaaaugugaaccgcaucacuuauggugcauguccucgauacgucaaacagaauacacugaaacuugccaccgggaugagaaacgugccagagaagcagacuaggggaauuuucggcgcuaucgccggcuuuauugaaaaugggugggagggaaugguggacgguugguauggcuuccggcaccaaaacuccgaggggcguggacaggcagcugaucugaagucuacacaggccgcgauagaccagaucaauggcaaauugaaccgccucauugguaagaccaaugaaaaauuccaccaaaucgagaaggaauuuagcgaggucgaagggagaauccaggaucuggagaaguacguugaggacacgaaaauugauuuauggucauauaacgccgaacugcucguggcacuugagaaccagcauaccauagaccugacagauagugaaaugaauaaguuguucgagaaaacuaagaaacagcuaagggaaaacgcugaggacaugggcaauggaugcuuuaagaucuaccacaagugugauaacgccugcauuggcuccauccggaaugggaccuauaaccaugacguauaccgagacgaggcucugaauaaccgcuuccaaauuaaaggaguggaacucaagagcgguuacaaagauuggauccuguggauaucuuuugccaucucaugcuuccuucugugugucgcauugcucggcuuuauuaugugggccugccagaaggggaauaucagauguaacauuugcaucuga

SEQ ID NO: 131901 - RNA, 1701 nt, Artificial Sequence; identical to SEQ ID NO: 131899
  derived and/or modified sequence opt3 from hemagglutinin__InfluenzaA__AGG13507

SEQ ID NO: 131902 - RNA, 1701 nt, Artificial Sequence
  derived and/or modified sequence opt3 from hemagglutinin__InfluenzaA__AGG13519
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccgacucaaguuucuuuagccgacugaacuggcucacucauuuaaauuuuaaguauccagcacugaacgugaccaugcccaauaacgagcaguucgauaaacuuuacauuuggggaguccaccauccuggcacagacaaggaucagaucuuuuuguaugcccaggcuucuggccguauuacuguguccaccaagagaucacaacagagcguaaucccaaacauagggaguaggccccggauucgcaauaucccuucuagaauuuccaucuacuggacaaucguuaaaccaggagacauucugcuaauaaacagcaccgguaaucucaucgccccgaggggcuacuucaagauucagucggggaaaucuuccaucaugcggucagacgcgcccauaggaaaguguaacagugaaugcauuacgccuaauggcagcaucccaaacgauaagcccuuucaaaaugugaaccgcaucacuuauggugcauguccucgauacgucaaacagaauacacugaaacuugccaccgggaugagaaacgugccagagaagcagacuaggggaauuuucggcgcuaucgccggcuuuauugaaaaugggugggagggaaugguggacgguugguauggcuuccggcaccaaaacuccgaggggcguggacaggcagcugaucugaagucuacacaggccgcgauagaccagaucaauggcaaauugaaccgccucauugguaagaccaaugaaaaauuccaccaaaucgagaaggaauuuagcgaggucgaagggagaguucaggaucuggagaaguacguggaggacacgaaaaucgauuuauggucauauaacgccgaacugcucguagcacuugagaaccagcauaccauugaccugacagauagugaaaugaauaaguuguucgagaaaacuaagaaacagcuaagggaaaacgcugaggacaugggcaauggaugcuuuaagauauaccacaagugugauaacgccugcaucggcuccauucggaaugggaccuauaaccaugacguguaccgagacgaggcucugaauaaccgcuuccaaaucaaaggagucgaacucaagagcgguuacaaagauuggauucuguggaucucuuuugccauaucaugcuuccuucuguguguggcauugcucggcuuuaucaugugggccugccagaaggggaauauuagauguaacaucugcauuuga

SEQ ID NO: 131903 - RNA, 1701 nt, Artificial Sequence; identical to SEQ ID NO: 131899
  derived and/or modified sequence opt3 from hemagglutinin__InfluenzaA__AGG13531

SEQ ID NO: 131904 - RNA, 1701 nt, Artificial Sequence
  derived and/or modified sequence opt3 from hemagglutinin__InfluenzaA__AGG13543
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggacauagagaaauacguugaggauaccaagaucgaccuguggucauauaacgccgaauuacugguggcacucgagaaccaacauacgauugaucuuaccgacagugaaaugaauaaacuguucgagaagacaaagaagcaguugcgagaaaacgcugaggauaugggcaauggaugcuuuaagaucuaccacaaaugugacaacgccugcauuggcuccauccgcaaugggacuuaugaucauaacguauacagagacgaggcucuaaauaacagguuccagauaaagggaguggaacugaaaagcgguuacaaggacuggauccucuggauuucuuuugccaucucaugcuuccugcuuugugucgcacuguugggcuuuauuaugugggccugccagaaagggaauauccgguguaacauaugcauuuga

SEQ ID NO: 131905 - RNA, 1701 nt, Artificial Sequence; identical to SEQ ID NO: 131899
  derived and/or modified sequence opt3 from hemagglutinin__InfluenzaA__AGG13555

SEQ ID NO: 131906 - RNA, 1701 nt, Artificial Sequence; identical to SEQ ID NO: 131899
  derived and/or modified sequence opt3 from hemagglutinin__InfluenzaA__AGG13567

SEQ ID NO: 131907 - RNA, 1701 nt, Artificial Sequence
  derived and/or modified sequence opt3 from hemagglutinin__InfluenzaA__AGG13591
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaauuucaacuggacugguguuacacaaaaugggaccaguuccgcuugcauucgccgaucuaacagcuccuuuuucucacgucugaauuggcucacgcauuuaaacuuuaaguauccagcacugaacgugacuaugcccaauaacgagcaguucgacaaguuguacaucuggggaguccaccauccuggcaccgauaaagaccagauuuuucuuuaugcccagaguagcggcagaaucacagugucuacuaagaggucccaacaggcuguaauaccaaauauugggucacggccccgcaucagaaacauuccuagcaggaucaguaucuacuggaccauuguuaaaccaggagauauacugcuaaucaauucuacagguaaccucauugccccgcggggcuacuucaagauccgcuccgggaaaagcucgauaaugcgaucugacgcgcccauuggaaaguguaaguccgaaugcaucaccccuaauggcucaaucccaaacgacagacccuuucagaaugugaacaggauuacguauggugcauguccucgguacgucaaacagaguacucugaaacuugccacagggaugcguaaugugccagagaagcaaacccgcggaaucuucggcgcuauugccggcuuuauagaaaacgggugggagggaaugguggaugguugguauggcuucagacaccagaauagcgaggggaggggacaggcagcugaccugaaguccacucaagccgcgaucgaucagauuaacggcaaauugaaucggcucaucgguaagacaaacgaaaaauuccaccagaucgagaaggaauuuucugaggucgaagggcgcauucaggaccuggagaaguacguugaggauaccaaaauagacuuauggagcuauaacgccgaacugcucguggcacuugagaaucaacauacgaucgaucugaccgacucagaaaugaacaaguuguucgagaaaacaaagaaacagcuacgagaaaaugcugaggauaugggcaacggaugcuuuaagauuuaccacaagugugacaaugccugcaucggcaguauuagaaacgggacuuaugaucaugacguauacagggacgaggcucugaauaaccgguuccagaucaaaggaguggaacucaaguccgguuacaaagauuggauacuguggaucagcuuugccauuucuugcuuccuucugugugucgcauugcucggcuuuaucaugugggccugccagaaggggaauauucgcuguaacaucugcauauga

SEQ ID NO: 131908 - RNA, 1701 nt, Artificial Sequence
  derived and/or modified sequence opt3 from hemagglutinin__InfluenzaA__AGG13615
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcaauuccucauuuuucagucgucugaacuggcugacgcaucucaauuuuaaguauccagcauuaaacgugacuaugcccaacaaugagcaguucgacaagcuguacauuuggggaguccaccauccuggcaccgauaaagaccagaucuuucuuuaugcccagagcucuggcagaauaacaguguccacuaagaggucacaacaggcuguaauuccaaacaucgggagccggccccgcauuagaaauaucccuaguaggaucucuauuuacuggaccauaguuaaaccaggagauaucuugcugauuaacuccacagguaaucuaaucgccccgcggggcuacuucaagauacgcagcgggaaaucgucuauuaugcgauccgacgcgcccaucggaaaguguaagucagaaugcaucaccccuaacggcaguauuccaagcgacaaacccuuucagaaugugaacagaaucacguauggugcauguccuagguacgucaagcaguccacucucaaacuggccacagggaugcggaaugugccagagaagcaaacccguggaauuuucggcgcuauagccggcuuuaucgaaaacgggugggagggaaugguggaugguugguauggcuuccgccaccaaaauucugaggggagaggacaggcagcugaccuuaaaagcacucaggccgcgauugaucagaucaacggcaagcugaauagguugaucgguaaaacaaacgaaaaguuccaccagauugagaaggaauuuucagaggucgaagggcggauacaggaccucgagaaauacguugaggauaccaagaucgaccuguggaguuauaaugccgaauuacugguggcacucgagaaccaacauacgauugaucuuaccgacuccgaaaugaacaaacuguucgagaagacuaaaaagcaguugcgagaaaaugcugaggauaugggcaacggaugcuuuaagaucuaccacaaaugugacaaugccugcauuggcagcauccgcaacgggacauaugaucaugacguauacagagacgaggcucuaaauaacagguuccagauaaagggaguggaacugaaaucugguuacaaggauuggauccucuggauuucauuugccaucaguugcuuccugcuuugugucgcacuguugggcuuuauuaugugggccugccagaaagggaauauccgguguaacauaugcauuuga

SEQ ID NO: 131909 - RNA, 1701 nt, Artificial Sequence; identical to SEQ ID NO: 131907
  derived and/or modified sequence opt3 from hemagglutinin__InfluenzaA__AGG13627

SEQ ID NO: 131910 - RNA, 1701 nt, Artificial Sequence
  derived and/or modified sequence opt3 from hemagglutinin__InfluenzaA__AGG13639
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacuaacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgaugcacccauuggcaaguguaagucagaaugcaucacaccuaaugguaguaucccaaacgacaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaacgcagaacugcucguggcucuugagaaucaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugauguauaccgcgacgaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 131911 - RNA, 1701 nt, Artificial Sequence; identical to SEQ ID NO: 131900
  derived and/or modified sequence opt3 from hemagglutinin__InfluenzaA__AGG13651

SEQ ID NO: 131912 - RNA, 1701 nt, Artificial Sequence; identical to SEQ ID NO: 131899
  derived and/or modified sequence opt3 from hemagglutinin__InfluenzaA__AGG13663

SEQ ID NO: 131913 - RNA, 1701 nt, Artificial Sequence; identical to SEQ ID NO: 131900
  derived and/or modified sequence opt3 from hemagglutinin__InfluenzaA__AGG13675

SEQ ID NO: 131914 - RNA, 1701 nt, Artificial Sequence; identical to SEQ ID NO: 131899
  derived and/or modified sequence opt3 from hemagglutinin__InfluenzaA__AGG13687

SEQ ID NO: 131915 - RNA, 1701 nt, Artificial Sequence; identical to SEQ ID NO: 131900
  derived and/or modified sequence opt3 from hemagglutinin__InfluenzaA__AGG13711

SEQ ID NO: 131916 - RNA, 1701 nt, Artificial Sequence; identical to SEQ ID NO: 131899
  derived and/or modified sequence opt3 from hemagglutinin__InfluenzaA__AGG13723

SEQ ID NO: 131917 - RNA, 1701 nt, Artificial Sequence; identical to SEQ ID NO: 131899
  derived and/or modified sequence opt3 from hemagglutinin__InfluenzaA__AGG13735

SEQ ID NO: 131918 - RNA, 1701 nt, Artificial Sequence; identical to SEQ ID NO: 131899
  derived and/or modified sequence opt3 from hemagglutinin__InfluenzaA__AGG13747

SEQ ID NO: 131919 - RNA, 1701 nt, Artificial Sequence
  derived and/or modified sequence opt3 from hemagglutinin__InfluenzaA__AGG13759
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgacagaaucgaagugacuaaugcgaccgagcugguacaaucuucaaguacaggugaaauuugcaacagcccacaccagauccuagauggcgagaauuguacccucauagacgcucugcuuggggauccgcagugcgacggauuucagaacaagaaaugggaucuguucguggaaagguccaaggcccauucuaauuguuaucccuacgacgucccugauuaugcaucguugcggucacucguggccagcaguggcacucuggaguuuaacaaugaguccuucaacuggacagguguuacccaaaaugggacgucuagcgcuugcauccgccgauccaacaauucauuuuucagucgucugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaggcuagcggcagaauuacugugucuaccaagaggucccaacagacaguaaucccaaacauagggucacggccccgcguuagaaauauuccuagcagggugaguaucuauuggaccauugucaagccaggagauauccugcuaaucaacucuacggguaaucucauugccccgcggggcuacuucaaaauacgcuccggaaagagcucgaucaugcgaucugacgcgcccauugggaaauguaacuccgcaugcaucacuccuaauggcucaauaccaaacgacaagcccuuucagaaugugaacagaauuacauacggugccuguccuagguaugugaagcagaauacccugaaacuugcuacugggaugcggaacgucccagagaagcaaacacguggaaucuucggcgccaucgcaggcuuuauugaaaaugggugggagggaaugguugaugguugguacggcuuccgccaccagaacagugaggggagaggacaggcugccgaccugaaaagcacccaagcggccaucgaucagauuaauggcaaguugaacaggcucauagguaaaacgaacgaaaaguuccaucagaucgagaaagaauuuuccgagguggaagggcggauucaggaccuggagaaguauguagaggauaccaagaucgacuuauggucuuacaaugcagaacugcucguggcucuugagaaccaacacacaaucgaucugacugacagcgaaaugaauaaauuguucgagaagaccaaaaagcagcuacgagaaaacgccgaggauaugggcaauggaugcuuuaaaauuuaucauaagugugacaacgcuugcauaggcucaauccgcaaugggacauacgaucacgacgucuauagagacgaggcccugaacaauagguuccagauuaagggaguggaacucaaaagugguuacaaggauuggauccuguggauuuccuuugcaaucagcugcuuccuucuguguguugccuugcucggcuuuauaaugugggcuugccagaaagggaacauccgguguaauauuugcaucuga

SEQ ID NO: 131920 - RNA, 1701 nt, Artificial Sequence
  derived and/or modified sequence opt3 from hemagglutinin__InfluenzaA__AGG13771
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccgacucaaguuucuuuagccgacugaacuggcucacucauuuaaauuuuaaguauccagcacugaacgugaccaugcccaauaacgagcaguucgauaaacuuuacauuuggggaguccaccauccuggcacagacaaggaucagaucuuuuuguaugcccaggcuucuggccguauuacuguguccaccaagagaucacaacagagcguaaucccaaacauagggaguaggccccggauucgcaauaucccuucuagaauuuccaucuacuggacaaucguuaaaccaggagacauucugcuaauaaacagcaccgguaaucucaucgccccgaggggcuacuucaagauucagucggggaaaucuuccaucaugcggucagacgcgcccauaggaaaguguaacagugaaugcauuacgccuaauggcagcaucccaaacgauaagcccuuucaaaaugugaaccgcaucacuuauggugcauguccucgauacgucaaacagaauacacugaaacuugccaccgggaugagaaacgugccagagaagcagacuaggggaauuuucggcgcuaucgccggcuuuauugaaaaugggugggagggaaugguggacgguugguauggcuuccggcaccaaaacuccgaggggcguggacaggcagcugaucugaagucuacacaggccgcgauagaccagaucaauggcaaauugaaccgccucauugguaagaccaaugaaaaauuccaccaaaucgagaaggaauuuagcgaggucgaagggagaauccaggaucuggagaaguacguugaggacaacaaaauugauuuauggucauauaacgccgaacugcucguggcacuugagaaucagcauacgauagaccugaccgauagugaaaugaacaaguuguucgagaaaacaaagaaacagcuaagggaaaaugcugaggacaugggcaacggaugcuuuaagaucuaccacaagugugauaaugccugcauuggcuccauccggaacgggacuuauaaucaugacguauaccgagacgaggcucugaacaaucgcuuccaaauuaaaggaguggaacucaagagcgguuacaaagauuggauccuguggauaucuuuugccaucucaugcuuccuucugugugucgcauugcucggcuuuauuaugugggccugccagaaggggaacaucagauguaauauuugcaucuga

SEQ ID NO: 131921 - RNA, 1701 nt, Artificial Sequence
  derived and/or modified sequence opt3 from hemagglutinin__InfluenzaA__AGG13783
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaaugggugagauuugcgacaguccacaccagauccuagauggcgaaaacuguacacucauagacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauccggggaagcaauuccucauuuuucagucgccugaacuggcucacccauuuaaauuuuaaguauccagcccugaacgugacgaugcccaacaaugagcaguucgacaaacuuuacauuuggggcguccaccauccuggcacugauaaggaccagaucuuuuuguaugcucaaagcucugggcgaauuaccguguccacaaagcguucacagcaggccguaaucccaaacauaggaagcagacccaggauucggaauguuccuagucgcaucucuauuuacuggacuaucgugaaaccaggugauauccugcuaauuaacuccaccggcaaucucauagcgccgagaggguacuucaagaucaggagcggaaaaucgucuauuaugcgguccgacgcacccaucggcaaguguaagucagaaugcauaacaccuaacgguaguauuccaaaugacaaacccuuucagaacgucaaucgcaucaccuauggggccuguccucgauacgugaagcaaagcacgcugaaacuugcuacuggaaugagaaacgugccagagaagcagacaaggggcaucuucggcgccauugcaggguuuaucgaaaauggaugggaggguauggucgauggcugguauggguuccggcaccagaacuccgagggacguggccaagcugccgaccugaaaucuacccaggcggccauugaucagauaaaugguaaguugaaccgccucaucgggaaaacuaaugaaaaguuccaccagauugagaaggaauuuagcgagguugaaggcagaauccaagaccuggagaaauacguggaggauacaaagaucgacuuauggucauauaacgcagaacugcucguagcucuugagaaccagcauaccauugaucugacggacagugaaaugaauaaauuguucgagaagaccaaaaagcagcuaagggaaaacgccgaggauaugggaaauggcugcuuuaagauauaccacaaaugugacaacgcuugcaucggguccauucggaauggaacauaugaucaugacguguaccgagacgaggcccugaacaaucgcuuccagaucaagggugucgaacucaaaagcggcuacaaggauuggauucuguggaucucuuuugcaauaucaugcuuccuucuguguguggccuugcucggguuuaucaugugggcuugccaaaaaggaaacauuagauguaauaucugcauuuga

SEQ ID NO: 131922 - RNA, 1701 nt, Artificial Sequence; identical to SEQ ID NO: 131900
  derived and/or modified sequence opt3 from hemagglutinin__InfluenzaA__AGG13795

SEQ ID NO: 131923 - RNA, 1701 nt, Artificial Sequence; identical to SEQ ID NO: 131851
  derived and/or modified sequence opt3 from hemagglutinin__InfluenzaA__AGG13807

SEQ ID NO: 131924 - RNA, 1701 nt, Artificial Sequence; identical to SEQ ID NO: 131900
  derived and/or modified sequence opt3 from hemagglutinin__InfluenzaA__AGG13819

SEQ ID NO: 131925 - RNA, 1701 nt, Artificial Sequence; identical to SEQ ID NO: 131900
  derived and/or modified sequence opt3 from hemagglutinin__InfluenzaA__AGG13831

SEQ ID NO: 131926 - RNA, 1701 nt, Artificial Sequence; identical to SEQ ID NO: 131899
  derived and/or modified sequence opt3 from hemagglutinin__InfluenzaA__AGG13855

SEQ ID NO: 131927 - RNA, 1701 nt, Artificial Sequence
  derived and/or modified sequence opt3 from hemagglutinin__InfluenzaA__AGG13867
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauugguaaaaucugcgacaguccacaccagauacuagauggcgagaacuguacacucauggacgcucugcuuggggauccgcagugcgacggauuucagaauaagaaaugggaucuguucguggaaaggagcaaggccuauuccaacuguuaccccuaugacgucccugauuacgcaucuuugcggucgcucguggccucaagcggcacccuggaguuuaauaacgaaaguuucaauuggacugguguuacacaaaacgggaccuccucugcuugcauccgccgaagcaauuccucauuuuucagucgucugaacuggcucacgcauuuaaauuuuaaguauccagcacugaacgugacuaugcccaacaaugagcaguucgacaaacuuuacauuuggggaguccaccauccuggcaccgauaaggaccagaucuuuuuguaugcccagagcucuggcagaauuacaguguccacuaaaaggucacaacaggcuguaaucccaaacauagggagccggccccgcauuagaaauaucccuaguaggauuucuaucuacuggaccaucguuaagccaggagauauucugcuaauaaacuccacagguaaucucaucgccccgcggggcuacuucaaaauucgcagcgggaagucgucuaucaugcgauccgacgcgcccauaggaaaguguaaaucagagugcauuaccccuaacggcaguaucccaaaugacaagcccuuucagaacgugaauagaaucacguauggugcauguccuagguacgucaaacagagcacucugaaacuugccacagggaugcggaacgugccagaaaaacaaacccguggaauuuucggcgcuaucgccggcuuuauugagaaugggugggaaggaaugguggaugguugguauggcuuccgccaccagaacuccgaggggagaggacaggcagcugaccugaagucuacucaagccgcgauagaucagaucaauggcaaauugaacaggcucauugguaagacaaaugagaaguuccaccagaucgaaaaagaguuuagcgaagucgaggggcggauccaggaccuggaaaaguacguugaggauaccaaaauugacuuauggucauauaacgccgagcugcucguggcacuugaaaaccaacauacgauagaucugaccgacagugagaugaauaaguuguucgaaaagacaaagaagcagcuacgagagaacgcugaagauaugggcaauggaugcuuuaaaaucuaccacaagugugacaacgccugcauuggcuccauccgcaaugggacuuaugaucauaacguauacagagacgaggcucugaauaacagguuccagauuaaaggaguggagcucaagagcgguuacaaagacuggauccuguggauaucuuuugccaucucaugcuuccuucugugugucgcauugcucggcuuuauuaugugggccugccagaaggggaauauccgguguaacauuugcaucuga

SEQ ID NO: 131928 - RNA, 1701 nt, Artificial Sequence; identical to SEQ ID NO: 131899
  derived and/or modified sequence opt3 from hemagglutinin__InfluenzaA__AGG13879

SEQ ID NO: 131929 - RNA, 1701 nt, Artificial Sequence; identical to SEQ ID NO: 131899
  derived and/or modified sequence opt3 from hemagglutinin__InfluenzaA__AGG13891

SEQ ID NO: 131930 - RNA, 1701 nt, Artificial Sequence
  derived and/or modified sequence opt3 from hemagglutinin__InfluenzaA__AGG13903
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccgacucaaguuucuuuagccgacugaacuggcucacucauuuaaauuuuaaguauccagcacugaacgugaccaugcccaauaacgagcaguucgauaagcuguacauuuggggaguccaccauccuggcacagacaaagaucagaucuuuuuguaugcccaggcuucuggccguauuacuguguccaccaagagaucacaacagagcguacugccaaacaucgggaguaggccccggauacgcaauauuccuucuagaaucuccauuuacuggacaaucguuaaaccaggagacauccuacucauuaacagcaccgguaaucugauagccccgaggggcuacuucaagauccagucggggaaaucuuccauuaugcggucagacgcgcccaucggaaaguguaacagugaaugcauaacgccuaauggcagcauuccaaacgauaagcccuuucaaaaugugaaccgcaucacuuauggugcauguccucgauacgucaaacagaauacacuuaagcuggccaccgggaugagaaacgugccagagaaacagacuaggggaaucuucggcgcuauugccggcuuuaucgaaaaugggugggagggaaugguggacgguugguauggcuuccggcaccaaaacuccgaggggcguggacaggcagcugauuugaagucuacacaggccgcgauugaccagauaaauggcaaacucaaccgccugaucgguaagaccaaugaaaaauuccaccaaauugagaaggaauuuagcgaggucgaagggagaauccaggauuuagagaaguacguugaggacacgaaaaucgaucuguggucauauaacgccgaacuccuuguggcacuggagaaccagcauaccauugacuugacagauagugaaaugaauaagcuauucgagaaaacuaagaaacagcugagggaaaacgcugaggacaugggcaauggaugcuuuaagauauaccacaagugugauaacgccugcaucggcuccauucggaaugggaccuauaaccaugacguauaccgagacgaggcucucaauaaccgcuuccaaaucaaaggaguggaacuuaagagcgguuacaaagauuggauucuuuggaucucuuuugccauaucaugcuuccuguugugugucgcacuccugggcuuuaucaugugggccugccagaaggggaauauuagauguaacaucugcauuuga

SEQ ID NO: 131931 - RNA, 1701 nt, Artificial Sequence; identical to SEQ ID NO: 131899
  derived and/or modified sequence opt3 from hemagglutinin__InfluenzaA__AGG13927

SEQ ID NO: 131932 - RNA, 1701 nt, Artificial Sequence; identical to SEQ ID NO: 131907
  derived and/or modified sequence opt3 from hemagglutinin__InfluenzaA__AGG13939

SEQ ID NO: 131933 - RNA, 1701 nt, Artificial Sequence
  derived and/or modified sequence opt3 from hemagglutinin__InfluenzaA__AGG13962
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaagguuuugagauuuucccgaagacaagcuccuggcccaaccacgacucaaauaagggggucaccgccgcuuguccucaugcaggagccaaaaguuuuuauaagaaccugaucuggcucgugaaaaagggcaauagcuacccaaaauuaucuaaguccuauauaaacgauaagggcaaagaaguacugguucuuugggggauccaccaccccucaacgacugcugaccaacagagcuuguaccagaaugccgaugcguacguguucgucggaaccagucgguauucuaagaaauuuaagccugagauugcaauccgcccaaaagugcgagaccaggagggucguaugaacuacuauuggacacugauugaacccggcgauaagaucacuuucgaggccaccgggaaccuaguggucccuagauacgcuuuugccauggaaaggaaugcagaguccggaauaauuaucagcgacacaccaguucaugauugcaacaccacgugucaaacuccggaaggcgcuauuaauacaucgcuccccuuccagaacauccacccuaucaccauugguaaaugcccaaaguaugugaagucuacuaaacugcggcuugccacagggcugcgcaauguacccuccauacagucaagaggauuguuuggcgcgaucgccggcuucauugaagggggauggaccgguaugguggacggcugguacggguaucaucaccagaacgagcaaggaaguggcuacgcagcugaccucaagagcacgcagaaugccaucgauaaaauaaccaacaaggucaauuccgugauugagaaaaugaacacacaguuuacugcuguugguaaggaguucaaucaccuggaaaagaggaucgagaacuuaaauaaaaagguggacgauggguuccuggacaucuggaccuacaacgccgaacuccuuguccuguuggagaaugagcggacacuagauuaucaugacucuaacgugaaaaaccuguacgaaaagguacgcaaucagcucaaaaacaaugcaaaggagauuggcaacggauguuuugaguucuaucacaagugcgauaauacuuguauggagagcguuaaaaacggcaccuacgacuauccuaaguacucagaagaggccaaacugaaucgagagaagaucgauggggugaaacuugaaaguacaagaauuuaucaaauacuggcuaucuacuccaccgucgcgagcucuuuggugcucgucgugucacugggagcaauuaguuuuuggaugugcagcaacgguuccuuacagugcaggaucuguaucuga

SEQ ID NO: 131934 - RNA, 1701 nt, Artificial Sequence; identical to SEQ ID NO: 131899
  derived and/or modified sequence opt3 from hemagglutinin__InfluenzaA__AGG13973

SEQ ID NO: 131935 - RNA, 1701 nt, Artificial Sequence; identical to SEQ ID NO: 131899
  derived and/or modified sequence opt3 from hemagglutinin__InfluenzaA__AGG13985

SEQ ID NO: 131936 - RNA, 1701 nt, Artificial Sequence; identical to SEQ ID NO: 131899
  derived and/or modified sequence opt3 from hemagglutinin__InfluenzaA__AGG13997

SEQ ID NO: 131937 - RNA, 1701 nt, Artificial Sequence; identical to SEQ ID NO: 131899
  derived and/or modified sequence opt3 from hemagglutinin__InfluenzaA__AGG14009

SEQ ID NO: 131938 - RNA, 1701 nt, Artificial Sequence
  derived and/or modified sequence opt3 from hemagglutinin__InfluenzaA__AGG14021
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugcgcucugacgcacccauugggaaauguaacuccgccugcaucacgccuaauggcucaauaccaaacgacaagcccuuucagaaugugaaccgaauuacuuacggugcuuguccuagauaugugaagcaaaauacacugaaacuugccaccgggaugaggaacgucccagagaagcagacucggggaaucuucggcgcaaucgcuggcuuuauugaaaaugggugggagggaaugguugaugguugguacggcuuccgucaccagaacagugaggggcgcggacaagccgcggaccugaaaagcacacaggccgcaaucgaucagauuaauggcaaguugaacagacucauagguaaaaccaacgaaaaguuccaucagaucgagaaagaauuuuccgagguggaagggaggauucaagaccuggagaaguauguagaggauacgaagaucgacuuauggucuuacaaugcugaacugcucguggcccuugagaaccagcacaccaucgaucugacagacagcgaaaugaauaaauuguucgagaagacuaaaaagcagcuacgggaaaacgcugaggauaugggcaauggaugcuuuaaaauuuaucauaagugugacaacgccugcauaggcucaauccgaaaugggaccuacgaucacgacgucuaucgcgacgaggcacugaacaauagauuccagauuaagggaaucgaacucaaaagugguuacaaggauuggauucuguggaucuccuuugccauaagcugcuuccuucuguguguggcuuugcucggcuuuaucaugugggcgugccaaaaagggaacauuagguguaauaucugcauuuga

SEQ ID NO: 131939 - RNA, 1701 nt, Artificial Sequence; identical to SEQ ID NO: 131900
  derived and/or modified sequence opt3 from hemagglutinin__InfluenzaA__AGG14033

SEQ ID NO: 131940 - RNA, 1701 nt, Artificial Sequence; identical to SEQ ID NO: 131919
  derived and/or modified sequence opt3 from hemagglutinin__InfluenzaA__AGG14318

SEQ ID NO: 131941 - RNA, 1701 nt, Artificial Sequence
  derived and/or modified sequence opt3 from hemagglutinin__InfluenzaA__AGG14330
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaauucgauccgacgcgcccaucggaaaguguaagucagaaugcaucaccccuaacggcaguauuccaaaugacaaacccuuucagaacgugaauagaaucacguauggugcauguccuagguacgucaagcagagcacucugaaacuugccacagggaugcggaacgugccagagaagcaaacccguggaauuuucggcgcuauagccggcuuuaucgaaaaugggugggagggaaugguggaugguugguauggcuuccgccaccagaacuccgaggggagaggacaggcagcugaccugaaaucuacucaagccgcgauugaucagaucaauggcaaguugaacaggcucaucgguaaaacaaaugaaaaguuccaccagauugagaaggaauuuagcgaggucgaagggcggauacaggaccuggagaaauacguugaggauaccaagaucgacuuauggucauauaacgccgaacugcucguggcacuugagaaccaacauacgauugaucugaccgacagugaaaugaauaaauuguucgagaagacaaagaagcagcuacgagaaaacgcugaggauaugggcaauggaugcuuuaagaucuaccacaaaugugacaacgccugcauuggcuccauccgcaaugggacuuaugaucaugacguauacagagacgaggcucugaacaauagguuccagauaaagggaguggaacucaaaagcgguuacaaggauuggauccuguggauuucuuuugccaucucaugcuuccuucugugugucgcauugcucggcuuuauuaugugggccugccagaaagggaacauccgguguaauauaugcauuuga

SEQ ID NO: 131942 - RNA, 1701 nt, Artificial Sequence
  derived and/or modified sequence opt3 from hemagglutinin__InfluenzaA__AGG84179
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaagugcuagcgagauuugcgacuccccacaccauauccuagauggugaaaauuguacacucauagacgcccugcuuggcgauccgcagugcgacggguuucagaacaaaaagugggaucuguucguggagagaucuagggcauauucgaauuguuaccccuaugacgucccugauuacgccucauugcggagccucguggcuaguuccggaacccuggaauuuaacaaugagucuuucaacuggacuggcguuacacaaaaugguaccagcuccgcaugcauccgccgaucaaacaauuccuuuuucagccgucugaacuggcucacgcacuuaaauuuuaaauauccagcccugaacgugacuaugcccaacaaugagcaguucgacaaacuuuacauuuggggaguccaucacccugggaccgauaaggaccagaucuuuuuguaugcucaggccucuggcagaauuacaguguccacuaaaaggucacaacaggcgguaaucccaaacauaggcagccggccccgcguuagaaauauuccuaguaggaucucuauuuacuggaccaucgugaagccaggggauauccugcuaauuaacuccacaggaaaucucauagcaccgcgggguuacuucaaaauccgcagcggcaagucgucuauuaugcgauccgacgcccccaucgggaaauguaacucagaaugcauaaccccuaauggaaguauuccaaacgacaagcccuuucagaaugucaacagaaucacguauggcgcuuguccuagguacgugaagcagagcacucugaaacuugccacagguaugcggaaugugccagagaagcaaacccgugggaucuucggagcaauugcuggcuuuaucgaaaacggcugggaggggaugauggauggaugguaugguuuccgccaccagaauagugagggcagagggcaggccgcggaccugaaaucuacucaagccgcaauugaucagauaaacggaaaguugaauaggcucaucggcaaaacaaacgaaaaguuccaucagauugagaaagaauuuagcgaggucgaaggucggauccaggaccuggagaaguacguugaggauaccaagaucgacuuauggucauauaacgcugaacugcucguggcccuugagaaucaacacacgauugaucugaccgacagugaaaugaacaaauuguucgagaagacaaagaagcagcuacgagaaaaugcugaggauauggggaacggcugcuuuaaaauauaccauaagugugacaaugccugcaucggauccauucgcaacggcacuuaugaucacgacguauacagagacgaggcacugaauaacagguuccagaucaaggggguggaacucaaaagcggauacaaggauuggauucuguggaucucuuuugccauaucaugcuuccuucugugugucgcuuugcucgguuuuaucaugugggcgugccagaaaggcaauauucgguguaacaucugcauuuga

SEQ ID NO: 131943 - RNA, 1704 nt, Artificial Sequence
  derived and/or modified sequence opt3 from hemagglutinin__InfluenzaA__AGI02564
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccgacaaaugaucugugcuaccccgggaacuuuaaugacuaugaggaauugaagcaucuccugagcaggaucaaccacuucgagaaaauucagaucauuccuaaguccucuuggucgggacaugaggcuucaagcggcgucaguuccgccuguccauaccaggguacucccagcuuuuuccggaaugugguauggcugaucaaaaagaacaauaccuauccuacaauaaaacgcagcuacaacaauaccaaccaagaagaucucuuaauucugugggggauccaccacuccaacgacgcagccgagcagacuaaacuuuaucagaauccaacaaccuacauuucaguuggaacgaguacuuugaaccagcgacuggugcccaagaucgcuacccguagcaaagucaauggccaaucuggcagaauggauuucuucuggacaauccuaaagccuaacgacgcaauuaauuuugaauccaacgggaauuucauagccccagaguacgcuuauaaaaucgugaagaaaggagauucagccauuaugaagucugaaguggaguacgguaacugcaauacuaaaugucagaccccgaucggcgcgauaaacaguucuaugcccuuucauaauauucacccucucacaaucggggaaugcccaaaguaugucaaguccaacaaacugguucuugcaaccggacugaggaauagccccuugcgggagcgcagaaggaagcggggccucuucggugccaucgcuggguuuauugagggaggcuggcagggcaugguggacgggugguacggauaucaucacucgaacgaacaggguucuggcuacgccgcagacaaagaguccacgcaaaaggcuaucgaugggguaacuaauaaagugaacucaauuauagacaagaugaacacacaguucgaagccgucggacgcgaguuuaauaaccuggaacgaagaaucgagaauuuaaacaagaaaauggaggauggcuuccuggacguguggaccuauaaugcggaacuccuuguucugauggagaacgaaaggacuuuggauuuccacgacaguaaugugaagaaccuauacgauaaaguccggcugcagcuccguaauaacgccaaggagcuggguaauggguguuuugaauuuuaccauaaaugcgacaacgaguguauggagagcgugcgcaauggcacauaugauuacccucaauauuccgaagaggcaagacuuaagagggaagagauuucuggaguaaagcuggagagcaucggcaccuaccagaucuugucaauuuauaguacgguugcuuccagccucgcccuggcuauaaugguggccggguuaucucuguggaugugcucaaacggaagucuacagugccggaucuguauuuga

SEQ ID NO: 131944 - RNA, 1707 nt, Artificial Sequence
  derived and/or modified sequence opt3 from hemagglutinin__InfluenzaA__AGI02565
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguucaucaauguuccagaauggaguuauauaguggagaaggcgaucccggcuaacgaucugugcuaccccggggacuuuaaugauuaugaggaauugaagcaucuccugagcaggauuaaccacuucgagaaaauccagauuaucccuaaguccucuuggucgaaucaugaagccucacugggagucagcagugcauguccauaccucggcaaacccuccuuuuuccggaacgugguaugguuaauaaagaaaaauucuacauauccuacuauuaagcgcagcuacaacaauaccaaccaggaggaccugcuuguuuugugggguauccaccacccaaaugaugccgcugagcaaacaaagcuguaucagaaccccaccacuuacauuuccguggggacaucaacccuaaaccagcgacucgucccuaaaaucgcaacgcguaguaaggugaauggacagagcggcagaauggaauuuuucuggacuauccugaaaccaaacgacgccauuaauuuugagucuaacggcaauuucauagcuccggaauacgccuauaagaucgugaaaaagggggauuccgcgauuaugaaaucagagcuugaauacggaaacugcaauaccaagugucaaacacccaugggugcaaucaacagcaguaugccuuuucauaauauacacccacugacuauuggcgagugccccaaguaugucaaaucuaacagguugguucucgccaccgggcugcgcaauuccccucagggagagcggagaaggaagaaacggggcuuauucggugcuaucgccggguuuaucgaaggaggcuggcagggcaugguggacgggugguacggauaucaucacagcaacgagcaggguucgggcuacgcagcugacaaggaaucuacacaaaaagccauugaugggguaaccaauaaggugaacuccaucauugacaagaugaauacgcaguucgaggcggucggacgcgaauuuaacaaccuggagcgaagaauagagaaucucaacaaaaagauggaagauggcuuccuugacguguggacuuauaaugccgagcuguugguucuaauggaaaacgagaggacacuggauuuccacgacucaaaugugaaaaaccucuacgauaagguccggcugcagcuucgugacaaugcaaaagaacuggguaacggguguuuugaguucuaccauaagugcgauaaugaguguauggaaagugugcgcaacggcaccuaugacuacccacaauauagcgaggaagcuagauugaagagggaggagaucuccggaguaaaacucgaaucuauuggcacuuaccagauccugagcaucuauucaacaguugccaguuccuuagcucuggccauuaugguggcagggcuaagccucuggaugugcucuaauggaucacugcagugccggauauguaucuga

SEQ ID NO: 131945 - RNA, 1704 nt, Artificial Sequence
  derived and/or modified sequence opt3 from hemagglutinin__InfluenzaA__AGI02566
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagagaaccucuuaauucugugggguauccaccacuccaaugacgccgcugagcagauuaaacuuuaucagaacccaaccacuuacaucucaguugggacaaguaccuugaaucagcgacuggugcccaagaucgcaacgcguagcaaagucaacggacaaucuggcagaauggacuuuuucuggacuauucuaaagccuaaugaugccauaaacuuugaauccaauggcaacuucaucgcuccagaguacgccuauaaaauugugaaggaaggggauucagcgaucaugaaaagcgagguggaauacggaaauugcaacaccaagugucagacaccgauaggugcaauuaauaguucuaugcccuuucauaacauccacccucucacuaucggcgagugcccaaaauaugucaaguccaauaagcugguucuugccaccgggcugaggaacagccccuugcgggagcgcagaaggaaacggggacucuucggcgcuauugccgguuuuaucgaagggggauggcagggcaugguggacggcugguacggguaucaucacucgaaugagcagggaucugguuacgcagcugacaaggaauccacacaaaaagccauugauggcguaaccaacaaggugaacucaauaaucgacaaaaugaauacgcaguucgaggcggucgggcgcgaauuuaacaaucuggagcgaagaauugagaacuuaaauaagaagauggaagauggauuccuggacguguggacuuauaacgccgagcuccuuguucugauggaaaaugagaggacauuggauuuccacgacaguaacgugaaaaaucuauacgauaagguccggcugcagcuccgugacaacgcaaaagaacugggcaaugguuguuuugaguucuaccauaagugcgauaacgaguguauggaaagcgugcgcaaugggaccuaugacuacccucaauauuccgaggaagcuagacuuaaaagggaggagaucucuggcguaaagcuggaaagcaucggaacuuaccagauuuugucaauauauaguacaguugccuccagccucgcucuggccaucaugguggcaggcuuaucucuguggaugugcucaaacgggagucuacagugccggauuuguaucuga

SEQ ID NO: 131946 - RNA, 1707 nt, Artificial Sequence
  derived and/or modified sequence opt3 from hemagglutinin__InfluenzaA__AGI02567
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaauuaugugaucuggacggagucaaaccccuaauucucagagauugcucaguggccgguuggcugcuuggcaacccuaugugugacgaguuccugaauguuccagaauggaguuauaucguggagaaggcgaacccggcuaaugauuugugcuaccccgggaacuuuaaugacuaugaggaacucaagcaucugcugagcaggauaaaccacuucgagaaaauccagauuaucccuaaguccucuuggucggaucaugaagccucaagcggagucaguuccgcauguccauaccagggccggucuagcuuuuuccgcaaugugguauggcucauuaaaaagaacaaugccuaucccacaaucaaacgauccuacaacaauacuaaccaagaggacuuacugguucuuugggguauacaccacccuaacgaugcugcagagcagacccguuuguaucagaauccaacaaccuacauuucaguggggacaaguacucugaaccagaggcuaguccccaagaucgccaccagaagcaaggugaauggacaaucuggccggauggaauuuuucuggacgauucucaaaccuaacgacgcuaucaauuuugaguccaacggcaauuucaucgccccagaauacgcguauaagauugugaaaaagggggauucaacuauaaugaaaagcgagcuggaauacggaaacugcaauaccaagugucagacaccgaucggugcaauuaacaguucuaugcccuuucauaauauccacccucuuacuauaggcgagugcccaaaauaugucaaguccaaccgccugguuuuggccaccgggcucagaaauagcccccagggagagaggcggcgcaagaaacgaggccuguucggugcuauugccggguuuaucgaaggaggcuggcagggcaugguggacgggugguacggauaucaucacucgaacgagcaagguucuggcuacgcagcugacaaggaauccacacagaaagccaucgaugggguaaccaauaaggugaacucaauuaucgacaaaaugaacacgcaguucgaggcggucggaagagaauuuaauaacuuagagaggcggauugagaaucugaacaagaagauggaagauggcuuccucgacguguggacuuauaaugccgagcuucugguuuugauggaaaacgagcguacacuagauuuccacgacaguaaugugaaaaaccuguacgauaagguccgccuccaacugagagacaaugcaaaagaacuugguaacggguguuuugaguucuaccauaggugcgauaaugaguguauggaaagcgugcggaacggcaccuaugacuacccucaguauuccgaggaagcucgacugaagcgcgaggagauaucuggaguaaaauuggaaagcaucggcacuuaccagauucucucaaucuauaguacaguugccuccagccuggcuuuagccaucaugguggcagggcugucucuauggaugugcucaaauggaagucuccagugcagaauuuguauauga

SEQ ID NO: 131947 - RNA, 1704 nt, Artificial Sequence
  derived and/or modified sequence opt3 from hemagglutinin__InfluenzaA__AGI02568
auggagaagaucgugcugcuccuugccauugucagccugguuaaauccgaccagauaugcaucggcuaccacgcuaacaauucuaccgaacaaguggauacaauuauggagaagaacguaacugugacgcaugcacaggacaucuuggaaaagacccacaaugggaaguuaugugaucuggacggagucaaaccccuaauucucagagauugcucaguggccgguuggcugcuuggcaacccuaugugugacgaguucaucaauguuccagaauggaguuauauaguggagaaggcgaacccggcuaaugaucugugcuaccccgggaacuuuaaugacuaugaggaauugaagcaucuccugagcaggaucaaccacuucgagaaaauucagaucauuccuaaguccucuuggucggaucaugaagccucaagcggagucaguuccgcauguccauaccagggcacacccagcuuuuuccggaaugugguauggcugaucaaaaagaacaauacuuauccuaccauaaaacgcucuuacaacaauacaaaccaagagaaccucuuaauucugugggguauccaccacuccaaugacgccaccgagcagauuaaacuuuaucagaacccaacuacauacaucucaguugggaccaguacguugaaucagcgacuggugcccaagaucggaacucguagcaaagucaacggccaaucuggcagaauggacuuuuucuggaccauucuaaagccuaaugaugcuauaaacuuugaauccaaugggaacuucaucgcaccagaguacgccuauaaaauugugaaggaaggagauucagcuaucaugaaaagcgagguggaauacgguaauugcaacacaaagugucagacuccgauaggcgccauuaauaguucuaugcccuuucauaacauccacccucucaccaucggggagugcccaaaauaugucaaguccaauaagcugguucuugcgacaggacugaggaacagccccuugcgggagcgcagaaggaaacggggccucuucggugcaauugccggguuuaucgaaggaggcuggcagggcaugguggacgggugguacggauaucaucacucgaaugagcaggguucuggcuacgcugccgacaaggaauccacccaaaaagcaauugaugggguaacgaacaaggugaacucaauaaucgacaaaaugaauacucaguucgaggcugucggacgcgaauuuaacaaucuggagcgaagaauugagaacuuaaauaagaagauggaagauggcuuccuggacguguggacauauaacgccgagcuccuuguucugauggaaaaugagaggaccuuggauuuccacgacaguaacgugaaaaaucuauacgauaagguccggcugcagcuccgugacaacgcgaaagaacuggguaauggguguuuugaguucuaccauaagugcgauaacgaguguauggaaagcgugcgcaauggcacuuaugacuacccucaauauuccgaggaagccagacuuaaaagggaggagaucucuggaguaaagcuggaaagcaugggcaucuaccagauuuugucaauauauaguacaguugcauccagccucgcucuggccaucaugguggcuggguuaucucuguggaugugcucaaacggaagucuacagugccggauuuguaucuga

SEQ ID NO: 131948 - RNA, 1683 nt, Artificial Sequence
  derived and/or modified sequence opt3 from hemagglutinin__InfluenzaA__AGI60301
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggauuuccggacgcaucgauuuccacuggcucauguuaaaccccaaugacaccgugacguuuucauucaacggcgccuuuauugcuccugaucgagccagcuuccugagaggcaaaaguauggggauccagucuggagugcaggucgacgcaaacugcgaaggugauuguuaccauuccggcgggacuaucauuagcaaucuuccauuucagaacauagacucgagggcuguuggaaagugcccgcgguaugugaagcaacguucuuugcugcuagccacaggcaugaaaaauguacccgagaucccuaagggucgcgggcuuuucggcgcgauugccggauucaucgaaaacggcugggaggggcugauagauggaugguacgguuuuagacaccagaaugcacagggcgaagggaccgcugccgacuacaaauccacucaaucagcuauugaccagaucacaggaaagcucaacaggcugaucgagaaaaccaaucagcaguucgaguugauugauaacgaauuuaaugagguggaaaagcaaaucggcaacgucauuaauuggacgcgggacaguauaaccgagguguggagcuauaacgccgaacuccugguugcaauggagaaucagcacacaaucgauuuagccgacuccgagauggauaaacuguacgaacgagugaagcgccagcucagagagaacgcugaagaggacgguacuggguguuucgaaauuuuucauaagugcgaugacgauuguauggcgucuaucaggaauaacaccuaugaccacagcaaauaccgggaggaggcaaugcagaaccgcauccaaauugauccagucaaacuuucaaguggcuauaaggacgugauacugugguucuccuuuggagccagcugcuucaucuugcuagcuauuguaaugggccugguuuuuaucugcgugaagaaugggaacaugagauguacaauuugcaucuga

SEQ ID NO: 131949 - RNA, 1683 nt, Artificial Sequence
  derived and/or modified sequence opt3 from hemagglutinin__InfluenzaA__AGJ72861
augaacacccagauccugguguucgcccucauugcuauaauccccacaaaugcagacaagauuugccuuggccaccaugccgucagcaacgggacuaaaguuaauacgcugaccgagagaggaggugaagugguaaacgcgacagagacuguggaaaggaccaauaucccucggauuuguuccaagggcaaaaagacagucgauuuggggcaaggaggcccacgcgguaccaucacugggccgccccagugcgaccaguuuuuagaguucucugcugaucugauaauggaacgacgugagggaucagacguguguuacccuggcaaauuuguuaacgaggaagcccuaagacagauccucagggagaguggcgggauugauaaggaagcaaugggauucacauauagcgguauccggaccaauggcgccacguccgcuugccgcagaucugggucgucauuuuacgcagagaugaaguggcugcuuagcaacacugacaaugccgcuuucccacaaaugaccaaaaguuauaagaacacaaggaaaucccccgcccugauuguguggggaauccaccauucugucagcacugcggagcagaccaaguuguacggcuccgguaauaaacucgugacaguagggucaaguaacuaucagcagagcuuuguuccuucuccaggagcacggccccaagugaauggccaguccggccgcauagauuuccacuggcugaugcugaacccuaaugacaccgucacguuuucauucaacggggccuuuauugcuccagaucgagccagcuuccucagaggaaagaguauggguauccagucuggcguccagguggacgcaaacugugaaggggauugcuaccauuccggaggcacuauuaucagcaauuuaccguuucaaaacaucgacucgagggcuguggguaaguguccccgguauguuaaacagcguucucugcuuuuggccacagggaugaagaaugugccugagauuccaaaaggccgcggacuguucggcgcgauagccggguucaucgaaaacggaugggagggucuaauugauggcugguacggguuuagacaccagaaugcacaaggagaaggcaccgcugccgacuacaaguccacucagucagcuaucgaccagauaacagguaaacucaacaggcugauugagaagaccaaucagcaauucgagcuuaucgauaacgaauuuaaugagguagaaaaacagaucgggaacgugauuaauuggacgcgggacaguaucaccgaggucuggagcuauaacgccgaacuguugguggcaauggagaaucagcacacaauugaucucgccgacuccgagauggauaagcuguacgaacgaguuaagcgccaguuaagagagaacgcugaagaggacggcacuggaugcuucgaaauauuucauaaaugugaugacgauugcauggcgucuaucaggaauaacaccuaugaccacagcaaguaccgggaggaggcaaugcaaaaccgcauucagaucgaucccgugaaacugucaaguggcuauaaggacgucauccucugguucuccuuuggggccagcuguuucauucuucuggcuauagugaugggauugguauuuaucugcguuaaaaaugguaacaugagaugcacaauuuguaucuga

SEQ ID NO: 131950 - RNA, 1701 nt, Artificial Sequence
  derived and/or modified sequence opt3 from hemagglutinin__InfluenzaA__AGJ73327
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaucaaagccuuuaccagaaugccgaugcguacguguucgucgggaccagucgcuauucuaagaaauuuaagccugagauugcaauccgaccaaaagugcgugaccaggagggaagaaugaacuacuauuggacacugauugaacccggugauaagaucacuuucgaggccaccggcaaccuaguggucccuagguacgcuuuugccauggaacggaaugcaggguccggaauaauuaucccagacacaccgguucacgauugcaacaccacgugucagacucccaaaggcgcuauuaauacaagccucccuuuccaaaacauccauccaaucaccauugguaagugccccaaguaugugaaaucgacuaagcugcgccuugccacagggcugagaaauguaccuucuauacaguccaggggauuguuuggcgcgaucgccggcuucauugaagggggauggaccgguaugguggacggcugguacggguaucaccaccagaacgaacagggaucaggcuacgcagcugaccucaaaaguacgcaaaaugccaucgauaagauaaccaacaaagucaauagcgugauugagaagaugaacacacaguuuacugcuguugguaaggaguucaaucaucuggaaaaacggaucgagaacuuaaauaagaaacuggacgauggguuccucgacaucuggaccuacaacgccgaacuucugguguugcuagagaaugaacgcacacuggauuaucacgacuccaacgucaagaaccucuacgagaaagugcgaaaucagcugaagaacaaugcaaaggagauuggcaacggauguuuugaguucuaucauaaaugcgauaauacuuguauggagucuguaaagaacggcaccuacgacuauccaaaauacagcgaagaggccaaguugaauagagagaaaaucgaugggguuaagcuggagucaacaaggauuuaucagauauuggcuaucuacaguaccguggcguccagccucguccugguggucucuuuaggagagauuucauuuuggaugugcaguaacgguagccugcaaugccggaucuguaucuga

SEQ ID NO: 131951 - RNA, 1701 nt, Artificial Sequence
  derived and/or modified sequence opt3 from hemagglutinin__InfluenzaA__AGJ73329
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgaugcaccagugcaugacugcaauaccacgugucaaacuccgaaaggugcuaucaacacaagccuccccuuccagaauauucacccuaucaccaucgggaagugcccaaaguauguaaaaucgacuaagcugcgccuugccacaggacugagaaacgugcccucuauucaguccaggggcuuguuuggcgcgauagccggguucaucgagggagguuggaccggcauggucgacgggugguacggauaucaucaccagaaugaacaaggcucagguuacgcagcugaucucaaaaguacgcagaacgccauugacaagaucaccaauaaagugaacagcguuauagagaagaugaauacacaguuuacugcuguggggaaggaguucaaccaccuggaaaaacggauugagaauuuaaacaagaaagucgaugacggcuuccuggauaucuggaccuacaaugccgaacuccuugugcuguuggagaacgaacgcacacuagacuaucaugauuccaauguaaagaaccuguacgagaaaguucgaaaccagcucaagaauaacgcaaaggagaucggaaauggcuguuuugaguucuaucacaaaugcgacaacacuuguauggagucugugaagaaugggaccuacgauuauccuaaauacagcgaagaggccaagcugaacagagaagagauugacggagucaaacuugagucaacaaggaucuaucaaauucuggcuauauacaguaccguggcguccagcuugguccucgugguuucucugggugcaaucucauuuuggaugugcaguaauggcagcuuacagugccggauuuguaucuga

SEQ ID NO: 131952 - RNA, 1701 nt, Artificial Sequence
  derived and/or modified sequence opt3 from hemagglutinin__InfluenzaA__AGJ73331
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccacggccuguccucaugcuggggcaaaaaguuuuuauaagaaucugaucuggcucgugaaaaagggaaacagcuacccaaaauuaucuaaguccuauauaaaugacaagggcaaagaaguacugguucuuuggggcauccaccaucccccuacuucagccgaucaacagagcuuguaccagaacgcugacgccuacguguucgucgggaccagucgcuauucuaagaaauuuaagccagagauugcgauccgacccaaagugcguggacaggaggguagaaugaauuacuauuggacacugguggaaccuggcgauaagauuacuuucgaggcaaccgggaaccuagucguuccaagguacgccuuugcuauggaacggaacgccggauccggcaucauaauuagcgacacaccggugcacgauugcaauaccacgugucaaacucccaaaggugcaaucaacacaucgcucccuuuccagaauauucacccaaucaccaucgggaagugccccaaguauguaaaaucuacuaagcugcgccuugcuacaggacugagaaacgugccuuccauucagucaaggggcuuguuuggcgccauagcgggguucaucgagggagguuggaccggcauggucgacgggugguacggauaucaucaccagaaugaacaaggcagugguuacgccgcagaccucaaaagcacgcagaacgcuauugaugagaucaccaauaaggugaacuccguuauagagaaaaugaauacacaguuuacugccguggggaaggaguucaaccaccuggagaagcggauugaaaauuuaaacaaaaaggucgacgauggcuuccuggacaucuggaccuacaaugcugagcuccuugugcuguuggaaaacgagcgcacacuagauuaucaugacucuaaaguaaagaaucuguacgagaaaguucgaagccagcucaagaacaacgccaaggaaaucggaaauggcuguuuugaguucuaucacaaaugcgauaacacuuguauggaaucagugaagaaugggaccuacgacuauccaaaauacagugaggaagcaaagcugaacagagaggagauugauggagucaaacuugaauccacaaggaucuaucaaauucuggccauauacagcaccguggcuucuucauugguccucgugguuagucugggugcgaucagcuuuuggaugugcuccaauggcucuuuacagugccggauuuguaucuga

SEQ ID NO: 131953 - RNA, 1701 nt, Artificial Sequence
  derived and/or modified sequence opt3 from hemagglutinin__InfluenzaA__AGJ73333
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgucagcugaucaacagagcuuguaccagaacgccgacacuuacguguucgucggaaccagucgcuauucuaagaaauuuaagccugagauugcgauccgaccaaaagugcgugaucaggaggguagaaugaauuacuauuggacacugguggaacccggcgacaagauuacuuucgaggcaaccgggaaccuagucguuccuagguacgccuuugcuauggaacggaacgccggauccggcaucauaauuagcgauacaccagugcaugacugcaauaccacgugucaaacuccgaaaggugcaaucaacacaucgcuccccuuccagaauauucacccuaucaccaucgggaagugcccaaaguauguaaaaucuacuaagcugcgccuugcuacaggacugagaaacgugcccuccauucagucaaggggcuuguuuggcgccauagcgggguucaucgagggagguuggaccggcauggucgacgggugguacggauaucaucaccagaaugaacaaggcagugguuacgccgcagaucucaaaagcacgcagaacgcuauugacaagaucaccaauaaagugaacuccguuauagagaagaugaauacacaguuuacugccguggggaaggaguucaaccaccuggaaaaacggauugagaauuuaaacaagaaagucgaugacggcuuccuggauaucuggaccuacaaugcugaacuccuugugcuguuggagaacgaacgcacacuagacuaucaugauucuaauguaaagaaccuguacgagaaaguucgaaaccagcucaagaauaacgccaaggagaucggaaauggcuguuuugaguucuaucacaaaugcgacaacacuuguauggagagcgugaagaaugggaccuacgauuauccuaaauacucagaagaggcaaagcugaacagagaagagauugacggagucaaacuugagaguacaaggaucuaucaaauucuggccauauacuccaccguggcuagcucuuugguccucgugguuucacugggugcgaucaguuuuuggaugugcagcaauggcuccuuacagugccggauuuguaucuga

SEQ ID NO: 131954 - RNA, 1701 nt, Artificial Sequence
  derived and/or modified sequence opt3 from hemagglutinin__InfluenzaA__AGJ73335
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgacugcugaucaacagagcuuguaccagaacgccgacaccuacguguucgucgggacaagucgcuauucuaagaaauuuaagccugagauugcgauccgaccaaaagugcgugaucaggagggaagaaugaauuacuauuggacucugguggaacccagggacaagauuaccuucgaggcaacagguaaccuagucguuccucgguacgccuuugcuauggaacgcaacgccggcuccgggaucauaauuagcgauaccccagugcaugacugcaauacgacuugucaaacaccgaaaggagcaaucaacaccucgcuccccuuccagaauauucacccuaucacuaucggcaagugcccaaaguauguaaaaucuacaaagcugagacuugcuaccggucugaggaacgugcccuccauucagucacggggguuguuuggagccauagcgggcuucaucgagggcggguggacgggaauggucgacgguugguacggcuaucaucaccagaaugaacaagggaguggauacgccgcagaucucaaaagcacccagaacgcuauugacaagaucacaaauaaagugaacuccguuauagagaagaugaauacucaguuuaccgccgugggcaaggaguucaaccaccuggaaaaacgcauugagaauuuaaacaagaaagucgaugacgguuuccuggauaucuggacauacaaugcugaacuccuugugcuguuggagaacgaacgaacucuagacuaucaugauucuaauguaaagaaccuguacgagaaaguuagaaaccagcucaagaauaacgccaaggagaucgggaauggcuguuuugaguucuaucacaaaugcgacaacaccuguauggagagcgugaagaauggaacauacgauuauccuaaauacucagaagaggcaaagcugaacagggaagagauugacggcgucaaacuugagaguacccggaucuaucaaauucuggccauauacuccacuguggcuagcucuuugguccucgugguuucacugggggcgaucaguuuuuggaugugcagcaauggauccuuacagugccguauuuguaucuga

SEQ ID NO: 131955 - RNA, 1701 nt, Artificial Sequence; identical to SEQ ID NO: 128470
  derived and/or modified sequence opt3 from hemagglutinin__InfluenzaA__AGJ73337

SEQ ID NO: 131956 - RNA, 1701 nt, Artificial Sequence; identical to SEQ ID NO: 128470
  derived and/or modified sequence opt3 from hemagglutinin__InfluenzaA__AGJ73339

SEQ ID NO: 131957 - RNA, 1701 nt, Artificial Sequence; identical to SEQ ID NO: 128470
  derived and/or modified sequence opt3 from hemagglutinin__InfluenzaA__AGJ73341

SEQ ID NO: 131958 - RNA, 1701 nt, Artificial Sequence
  derived and/or modified sequence opt3 from hemagglutinin__InfluenzaA__AGJ73343
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcagaaugggaaacuauguaagcucagaggaguggcuccccugcaccuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcaacugagcaguguguccucuuucgaacgguuugagauuuucccgaagacaagcuccuggcccaaccaugacucaaauaagggugucaccgccgcuuguccucacgcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgagcgcugaccagcagaguuuguaccagaaugccgaugcguacguguucgucgggacuucuaaguauuccaaaaaguuuaaaccugagauugcagugcgcccaaaggugcgagaccaagagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcacgauugcaacacaaccugucagacgccgaagggcgcuauuaauacuucucugcccuuccagaacauccauccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaccaucaaaacgaacagggaagcggcuacgcagcugaccugaaguccacccagaaugccaucgauaaaauuacgaacaagguaaauucuguuaucgagaagaugaacacccaguuuacagcuguggguaaagaguucaaucacuuagaaaagaggauagagaaccugaauaaaaaggucgacgauggguuccucgacauuuggacuuacaacgccgaacuucugguguugcuagagaaugaacggacccuggauuaucacgacagcaacgugaaaaaccucuacgagaagguucgcucacaacugaagaauaacgcaaaagagaucggcaauggauguuuugaguucuaucauaagugcgauaacacauguauggaaagugugaaaaauggcacuuacgacuauccuaaguacuccgaagaggccaaacuuaaccgagaagagaucgauggggucaagcuggagagcaccagaauuuaucagaucuuggcuauuuacucuacaguggcgucaagucucguccuggugguuagcuuaggagcaauauccuuuuggaugugcucuaaugguucgcugcagugcaggaucuguauuuga

SEQ ID NO: 131959 - RNA, 1701 nt, Artificial Sequence
  derived and/or modified sequence opt3 from hemagglutinin__InfluenzaA__AGJ73345
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugaggaugccuacguguucgucgggacuucuaaguauuccaaaaaguuuaaaccugagauugcggugcgcccaaaggugcgagaccaggaaggacguaugaacuacuauuggacccuggucgagcccgguaacaaaaucacauucgaagcaacuggcaaucuacucguuccuagauacgccuuugcuauggagaggaacgccgggagcggaauuaucauaucggauaccccagugcaugacugcaauacaaccugucaaacgccgaagggcgcaauuaacacuucucugcccuuccagaauauccacccuauuacaaucgguaagugcccaaaauauguaaaguccaccaaacuucggcuggcuacuggguugcgcaacgugcccucaauccagaguagaggacucuuuggcgccauugcgggcuucauagaagggggauggacagguauggucgauggcugguacggguaucaucaccagaaugagcaaggaagcggcuacgccgcagaccugaaguccacccagaacgcuaucgacaaaauuacgaauaaggugaacucuguuaucgagaagaugaauacccaguuuacagccguggguaaagaguucaaccacuuagagaagaggauagaaaaucugaacaaaaaggucgaugacggguuccucgauauuuggacuuacaaugcugagcuucugguguugcuagaaaacgagcggacccuggacuaucaugauagcaacguuaaaaaucucuacgagaagguacgcucacagcugaagaacaaugccaaagaaaucggcaacggauguuuugaguucuaucacaagugcgacaauacauguauggaaagugugaaaaacggcacuuacgauuauccuaaguacuccgaggaagcaaaacuuaaucgagaggagaucgacggggucaagcuggaaagcaccagaauuuaucaaaucuuggccauuuacucuacaguggcuucaagucucguccuggugguuagcuuaggagcgauauccuuuuggaugugcucuaacgguucgcugcagugcaggaucuguauuuga

SEQ ID NO: 131960 - RNA, 1701 nt, Artificial Sequence; identical to SEQ ID NO: 129066
  derived and/or modified sequence opt3 from hemagglutinin__InfluenzaA__AGJ73347

SEQ ID NO: 131961 - RNA, 1701 nt, Artificial Sequence; identical to SEQ ID NO: 129066
  derived and/or modified sequence opt3 from hemagglutinin__InfluenzaA__AGJ73349

SEQ ID NO: 131962 - RNA, 1701 nt, Artificial Sequence
  derived and/or modified sequence opt3 from hemagglutinin__InfluenzaA__AGJ73351
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaaaugcgugaucaggaggguagaaugaauuacuauuggacucugguggaacccggcgacaagauuaccuucgaggcaacagggaaccuaguggucccuagguacgccuuugcuauggaacggaacgccggaucuggcaucauaauuuccgauaccccaguucaugacugcaauacgacuugucaaacaccgaaaggugcaaucaacaccagccuccccuuccagaauauucacccuaucacuaucgggaagugcccaaaguaugugaaaucgacaaagcugcgccuugcuaccggacugagaaacguacccucuauucaguccaggggcuuguuuggcgccauagcgggguucaucgagggagguuggacgggcaugguggacgggugguacggauaucaucaccagaaugaacaaggcucagguuacgccgcagaucucaaaaguacccagaacgcuauugacaagaucacaaauaaagucaacagcgugauagagaagaugaauacucaguuuaccgccguugggaaggaguucaaccaccuggaaaaacggauugagaauuuaaacaagaaaguggaugacggcuuccuggauaucuggacauacaaugcugaacuccuuguccuguuggagaacgaacgcacucuagacuaucaugauuccaaugugaagaaccuguacgagaaaguacgaaaccagcucaagaauaacgccaaggagaucggaaauggcuguuuugaguucuaucacaaaugcgacaacaccuguauggagucuguuaagaaugggacauacgauuauccuaaauacagcgaagaggcaaagcugaacagagaagagauugacggagugaaacuugagucaaccaggaucuaucaaauucuggccauauacaguacugucgcuuccagcuuggugcucgucgugucucugggugcgaucucauuuuggaugugcaguaauggcagcuuacagugccggauuuguaucuga

SEQ ID NO: 131963 - RNA, 1701 nt, Artificial Sequence
  derived and/or modified sequence opt3 from hemagglutinin__InfluenzaA__AGJ73353
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgagcgcugaccaacagaguuuguaccagaaugccgaugcguacguguucgucgggacuucuaaguauuccaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcaugauugcaacacaaccugucaaacgccgaagggcgcuauuaauacuucucugcccuuccaguccauccacccuauuacaaucgguaagugcccaaaauauguaaagucaaccaaacuucggcuggccacuggguugcgcaacgugcccaguauccagagcagaggacucuuuggcgcgauugccggcuucauagaagggggauggacagguauggucgacggcugguacggguaucaucaccagaaugaacaaggauccggcuacgcagcugaccugaagucuacccagaacgccaucgauaaaauuacgaauaaggugaacagcguuaucgagaagaugaauacccaguuuacagcuguggguaaagaguucaaccacuuagaaaagaggauagagaaucugaacaaaaaggucgacgauggguuccucgacauuuggacuuacaaugccgaacuucugguguugcuagagaacgaacggacccuggauuaucaugacucaaauguuaaaaaccucuacgagaagguacgcagucagcugaagaacaaugcaaaagagaucggcaacggauguuuugaguucuaucacaagugcgauaauacauguauggaauccgugaaaaacggcacuuacgacuauccuaaguacagcgaagaggccaaacuuaaucgagaagagaucgauggggucaagcuggagucuaccagaauuuaucaaaucuuggcuauuuacucaacaguggcgaguagccucguccuggugguuuccuuaggagcaauaucuuuuuggaugugcucgaacgguagccugcagugcaggaucuguauuuga

SEQ ID NO: 131964 - RNA, 1701 nt, Artificial Sequence
  derived and/or modified sequence opt3 from hemagglutinin__InfluenzaA__AGJ73355
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccaaggagaucggaaauggcuguuuugaguucuaucacaaaugcgacaacaccuguauggagucugugaagaaugggacauacgauuauccuaaauacagcgaagaggcaaagcugaacagagaagagauugacggagucaaacuugagucaaccaggaucuaucaaauucuggccauauacaguacuguggcuuccagcuugguccucgugguuucucugggugcgacgucauuuuggaugugcaguaauggcagcuuacagugccggaucuguauuuga

SEQ ID NO: 131965 - RNA, 1701 nt, Artificial Sequence; identical to SEQ ID NO: 128883
  derived and/or modified sequence opt3 from hemagglutinin__InfluenzaA__AGJ73357

SEQ ID NO: 131966 - RNA, 1701 nt, Artificial Sequence
  derived and/or modified sequence opt3 from hemagglutinin__InfluenzaA__AGJ73361
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacaaguagcuccuggucuuacauuguugagaccucgucaagcgacaacggaacuugcuauccaggcgauuuuaucgacuacgaggaacucagggagcagcugaguuccgugucuagcuucgaacgguuugagauuuucccgaagacauccucauggcccaaucacgauaguaacaagggugucaccgcagccuguccucaugcuggggcaaaaggauuuuauaagaaucugaucuggcucgugaaaaagggcaacagcuacccaaaauuaucuaaguccuauauaaaugacaagggcaaagaaguacugguucuuugggggauccaccaccccucaacgacugccgaucaacagagcuuguaccagaacgcugacaccuacguguucgucggaacaagucgcuauucuaagaaauuuaagccugagauugccauccgaccaaaagugcgugaucaggaggguagaaugaauuacuauuggacucugguggaacccggcgacaagauuaccuucgaggcgacagggaaccuagucguuccuagguacgcauuugccauggaacggaacgcuggauccggcaucuucauaagcgauaccccagugcaugacugcaauacgacuugucaaacaccgaaaggugccauuaacaccucgcuccccuuucagaauauccacccuauuacuaucgggaagugcccaaaguauguaaaaucuacaaagcugcgccuugcaaccggacugagaaacgugcccuccauccagucaaggggcuuguucggcgcuauugccggguuuauagagggagguuggacgggcauggucgacgggugguacggauaucaucaccagaaugaacaaggcagugguuacgcggccgaucucaaaagcacccagaacgcaaucgacaagauuacaaauaaagugaacuccguuaucgagaagaugaauacucaguucaccgcuguggggaaggaguucaaccaccuggaaaaacggauagagaauuuaaacaagaaagucgaugacggcuuucuggauauuuggacauacaaugccgaacuccuugugcuguuggagaacgaacgcacucuagacuaucaugauucuaauguaaagaaccuguacgagaaaguucgaaaccagcucaagaauaacgcuaaggagaucggaaauggcuguuucgaauuuuaucacaaaugcgacaacaccuguauggagagcgugaagaaugggacauacgauuauccuaaauacucagaagaggccaagcugaacagagaagagaucgacggagucaaacuugagaguaccaggauuuaucaaauccuggcaauuuacuccacuguggccagcucuuugguccucgugguuucacugggugcuauaaguuucuggaugugcagcaauggcuccuuacagugccggaucuguauuuga

SEQ ID NO: 131967 - RNA, 1701 nt, Artificial Sequence; identical to SEQ ID NO: 129066
  derived and/or modified sequence opt3 from hemagglutinin__InfluenzaA__AGJ73363

SEQ ID NO: 131968 - RNA, 1701 nt, Artificial Sequence; identical to SEQ ID NO: 128883
  derived and/or modified sequence opt3 from hemagglutinin__InfluenzaA__AGJ73365

SEQ ID NO: 131969 - RNA, 1701 nt, Artificial Sequence
  derived and/or modified sequence opt3 from hemagglutinin__InfluenzaA__AGJ73367
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcuggccauacauuguugagaccuccucuucggacaacggaacuugcuauccgggcgauuuuaucaauuacgaggagcucagggagcagcugucaagcgugaguuccuucgaacgguuugagauuuuccccaagacaucuagcuggccuaaccacgacuccaauaagggugucgccgcugcauguccacaugccggggcuaaaucauuuuauaagaaccugaucuggcucgugaaaaagggaaauaguuaccccaaauuaagcaagucuuauauaaacgauaagggcaaagaaguacugguucuuuggggcauccaccacccuuccaccucagccgaccaacagagcuuguaccagaaugcggaugcauacguguucgucgggacgaguaaguauucuaaaaaguuuaaaccagagauugccgugcgccccaaggugcgagaccaggagggacguaugaacuacuauuggacucuggucgaaccuggugauaaaaucaccuucgaggcuacaggcaaccuacucguuccaagauacgccuuugcaauggaaaggaaugcuggguccggaauuaucauaagcgacacuccggugcaagauugcaacaccacaugucagacccccaagggcgccauuaauacgucgcugccuuuccagaacauccauccaauuacuaucgguaagugccccaaauauguaaagucuacaaaacuucggcuggcgaccggguugcgcaaugugccuuccauccagucaagaggacucuuuggcgccauugcaggcuucauagaagggggauggacugguauggucgacggcugguacggguaucaccaucaaaacgaacagggaaguggcuacgcugccgacuuaaagagcacacagaaugcuaucgauaaaauuaccaacaagguaaauuccguuaucgagaagaugaacacgcaguuuaccgccguggguaaagaguucaaucaccuggaaaagaggauagagaaccugaauaaaaaggucgacgauggguuccucgacauuuggacauacaacgcagaacuucugguguugcuagagaaugaacggacucuggauuaucacgacucuaacgugaaaaaccucuacgagaagguucgcaaucaacugaagaacaaugccaaagagaucggcaacggauguuuugaguucuaucauaagugcgauaauaccuguauggaaagcgugaaaaacggcacauacgacuauccaaaguacucagaagaggcuaaacuuaaucgagaagagaucgauggggucaagcuggagaguacuagaauuuaucagaucuuggcgauuuacuccaccguggcaagcucucucguccuggugguuucauuaggagccauaaguuuuuggaugugcagcaacgguucccugcagugcaggaucuguauuuga

SEQ ID NO: 131970 - RNA, 1701 nt, Artificial Sequence
  derived and/or modified sequence opt3 from hemagglutinin__InfluenzaA__AGJ73369
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccuccccuuccagaauauucacccuaucacuaucgggaagugcccaaaguauguaaaaucgacaaagcugcgccuugcuaccggacugagaaacgugcccucuauucaguccaggggcuuguuuggcgccauagcgggguucaucgagggagguuggacgggcauggucgacgggugguacggauaucaucaccagaaugaacaaggcucagguuacgccgcagaucucaaaaguacccagaacgcuauugacaagaucacaaauaaagugaacagcguuauagagaagaugaauacucaguuuaccgccguggggaaggaguucaaccaccuggaaaaacggauugagaauuuaaacaagaaagucgaugacggcuuccuggauaucuggacauacaaugcugaacuccuugugcuguuggagaacgaacgcacucuagacuaucaugauuccaauguaaagaaccuguacgagaaaguucgaaaccagcucaagaauaacgccaaggagaucggaaauggcuguuuugaguucuaucacaaaugcgacaacaccuguauggagucugugaagaaugggacauacgauuauccuaaauacagcgcagaagccaagcugaacagagaggaaauugacggagucaaacuugagucaaccaggaucuaucaaauucuggcuauauacaguacuguggcguccagcuugguccucgugguuucucugggugcaaucucauuuuggaugugcaguaauggcagcuuacagugccggauuuguaucuga

SEQ ID NO: 131971 - RNA, 1701 nt, Artificial Sequence; identical to SEQ ID NO: 128470
  derived and/or modified sequence opt3 from hemagglutinin__InfluenzaA__AGJ73371

SEQ ID NO: 131972 - RNA, 1701 nt, Artificial Sequence
  derived and/or modified sequence opt3 from hemagglutinin__InfluenzaA__AGJ73373
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacucagggagcagcugagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcucgugaaaaagggcaacaguuacccaaaauuaagcaagucuuauauaaaugacaagggcaaagaaguacugguucuuugggggauccaccaccccuccacgacugcugaucaacagucauuguaccagaacgccgacaccuacguguucgucggaacaagccgcuauaguaagaaauuuaagccugagauugcgauccgaccaaaagugcgugaucaggaggguagaaugaauuacuauuggacucugguggaacccggcgacaagauuaccuucgaggcaacagggaaccuagucguuccuagguacgccuuugcuauggaacggaacgccggaucuggcaucauaauuuccgauaccccagugcaugacugcaauacgacuugucaaacaccgaaaggugcaaucaacaccagccaccccuuccagaauauucauccuaucacuaucgggaagugcccaaaguauguaaaaucgacaaagcuccgccuggcuaccggacuuagaaacgugcccucuauucaguccaggggccuguuuggcgccauagcgggguucaucgagggagguuggacgggcauggucgacgggugguacggauaucaccaccagaaugaacaaggcucagguuacgccgcagauuugaaaaguacccagaacgcuauugacaagaucacaaauaaagugaacagcguuauagagaagaugaauacucaguuuaccgccguggggaaggaguucaaccaucucgaaaaacggauugagaaucugaacaagaaagucgaugacggcuucuuagauaucuggacauacaaugcugaacugcucgugcuucuggagaacgaacgcacuuuggacuaucacgauuccaauguaaagaaccuauacgagaaaguucgaaaccagcugaagaauaacgccaaggagaucggaaauggcuguuuugaguucuaucauaaaugcgacaacaccuguauggagucugugaagaaugggacauacgauuauccuaaauacagcgaagaggcaaagcucaacagagaagagauugacggagucaaacuggagucaaccaggaucuaucaaauucuugccauauacaguacuguggcuuccagccuggucuuggugguuucucucggugcgaucucauuuuggaugugcaguaauggcagccugcagugccggauuuguaucuga

SEQ ID NO: 131973 - RNA, 1701 nt, Artificial Sequence
  derived and/or modified sequence opt3 from hemagglutinin__InfluenzaA__AGJ73375
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccggaaacaagcuccuggcccaaccacgacucaaauaagggugucaccgccgcuuguccucaugcaggggccaagaguuuuuauaaaaaccugaucuggcucgugaagaaaggaaauagcuacccaaaguuaucuaaauccuauauaaacgauaagggcaaggagguacugguucuuuggggcauccaccaccccucaacgacugcugaccaacagagcuuguaccagaaugccgaugcguacguguucgucgggaccagucgcuauucuaaaaaguuuaaaccugagauugcaauccgaccaaaggugcgugaccaggaaggaagaaugaacuacuauuggacacugauugagcccggugauaaaaucacuuucgaagccaccggcaaccuaguggucccuagguacgcuuuugccauggagcggaaugcaggguccggaauaauuaucagcgacacaccaguucaugauugcaacaccacgugucaaacuccggaaggcgcuauuaauacaucgcuccccuuccagaacauccacccuaucaccauugguaagugcccaaaauaugugaagucuacuaagcugcgccuugccacagggcugagaaauguacccuccauacagucaaggggauuguuuggcgcgaucgccggcuucauugaagggggauggaccgguaugguggacggcugguacggguaucaucaccagaacgagcaaggaaguggcuacgcagcugaccucaaaagcacgcagaaugccaucgauaagauaaccaacaaagucaauuccgugauugaaaagaugaacacacaguuuacugcuguugguaaagaguucaaucaccuggaaaagcggaucgagaacuuaaauaagaaaguggacgauggguuccuggacaucuggaccuacaacgccgaacuccuuguccuguuggagaaugagcgcacacuagauuaucaugacucuaacgugaagaaccuguacgaaaaaguacgaaaucagcucaagaacaaugcaaaagagauuggcaacggauguuuugaguucuaucacaagugcgauaauacuuguauggaaagcguuaagaacggcaccuacgacuauccuaaauacucagaagaggccaagcugaauagagaggaaaucgauggggugaaacuugagaguacaaggauuuaucaaauacuggcuaucuacuccaccgucgcgagcucuuuggugcucgucgugucacugggagcaauuaguuuuuggaugugcagcaacgguuccuuacagugccggaucuguaucuga

SEQ ID NO: 131974 - RNA, 1701 nt, Artificial Sequence
  derived and/or modified sequence opt3 from hemagglutinin__InfluenzaA__AGJ73377
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccaguuguccucgcgcuggggcaaagagcuuuuauaagaaccugaucuggcucgugaaaaagggaaauucuuacccaaaauuauccaagucauauauaaacgauaagggcaaagaaguacugguucuuuggggcauccaucaccccagcacgacugccgaccaacagaguuuguaccagaaugcugaugccuacguguucgucgggaccucucgauauuccaagaaauuuaagccugagauugcgauccguccaaaagugagagaccaggagggaaggaugaacuacuauuggacacugguggaacccggugauaagauuacuuucgaggcaaccggcaaccuacucgucccucgguacgccuuugcuauggaacgcaaugccgggagcggaaucauaauuucggacacaccaguucacgauugcaacaccacgugucaaacuccgaaaggcgcaaucaauacaucucugcccuuccagaacauucauccuaucaccaucgguaagugcccaaaguaugugaaauccacuaaacuuagacuggcuacaggguugaggaauguacccucaauucagagucggggacucuuuggcgccauagcgggcuucaucgaagggggauggaccgguaugguggacggcugguacggguaucaccaucagaacgaacaaggaagcggcuacgccgcagaccugaaauccacgcagaaugcuauugauaagaucaccaacaaagucaauucugugauagagaagaugaacacacaguuuacugccguugguaaggaguucaaucacuuagaaaaacgcauugagaaccugaauaagaaaguggacgauggguuccucgacaucuggaccuacaacgcugaacuucuggucuugcuagagaaugaacgaacacuggauuaucacgacagcaacgugaagaaccucuacgagaaaguaagaaaucagcugaagaacaaugccaaggagaucggcaacggauguuuugaguucaaucauaaaugcgauaacacuuguauggaaucaguuaagaauggcaccuaugacuacccuaaauauagugaagaggcaaaacuuaacaaggaagagauugauggggugaagcuggaguccacaaggaucuaccaaauuuuggccauauauagcaccgucgcuucuucacucgugcuggucgugaguuuaggagcgaucagcuuuuggaugugcuccaaugguucucugcagugccggauuuguaucuga

SEQ ID NO: 131975 - RNA, 1701 nt, Artificial Sequence
  derived and/or modified sequence opt3 from hemagglutinin__InfluenzaA__AGJ73380
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcguggacaggaggguagaaugaacuacuauuggacacugauugaacccggcgacaagaucacuuucgaggccaccgggaaccuaguggucccuagguacgcuuuugccauggaacggaaugcaggauccggcauaauuaucagcgauacaccaguucaugacugcaacucgaccugucaaacgccgaaaggugcuauuaauacuucucuccccuuccagaacauccacccuaucacaauugggaagugcccaaaguaugugaaauccaccaagcugcgccuugccacuggacugagaaauguacccucaauacagaguaggggcuuguuuggcgcgaucgccggguucauugagggagguuggacaggcaugguggaugggugguacggauaucaucaccagaacgaacaaggcagcgguuacgcagcugaccucaaauccacccagaaugccaucgacaagauaacgaacaaagucaauucugugauugagaagaugaacacccaguuuacagcuguugggaaggaguucaaucaccuggaaaaacggaucgagaacuuaaauaagaaaguggaugacggcuuccuggauaucuggacuuacaacgccgaacucuuuguccuucuggagaaugaacgcaccuuggacuaucaugauagcaacgugaaggaccuauacgagaaaguacgaaaccagcugaagaauaacgcaaaggagauuggaaauggcuguuucgaauuuuaucacaaaugcgauaacacauguauggagucaguuaagaaugggacuuacgacuauccuaaauacagugaagaggccaagcucaacagagagaaaaucgauggagugaagcuggaguccaccaggauuuaucaaauacuugcuaucuacagcacagucgcgucuucacugguguuggucgugagucucggugcaauuagcuucuggaugugcuccaauggcucucugcagugccggaucuguaucuga

SEQ ID NO: 131976 - RNA, 1701 nt, Artificial Sequence
  derived and/or modified sequence opt3 from hemagglutinin__InfluenzaA__AGK62991
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaggcuucuggccguauuacuguguccaccaagagaucacaacaggccguaaucccaaauauagggagcaggccccggauucgcaacaucccuaguagaauuucuaucuacuggacaaucguuaaaccaggagauauucugcuaauaaauuccaccgguaaccucaucgcgccgaggggcuacuucaagauucggagcgggaaaucgucuaucaugcgcuccgacgcacccauaggaaaguguaauucagaaugcauuacgccuaacggcaguaucccaaaugacaagcccuuucagaacgugaaucgaaucacuuauggugccuguccuagauacgucaaacaaagcacacugaaacuugcuaccgggaugaggaacgugccagagaagcagacucggggaauuuucggcgccaucgcaggcuuuauugaaaaugggugggagggaaugguggaugguugguauggcuuccgucaccagaacuccgaggggcgcggacaagcugccgaccugaagucuacacaggcggccauagaucagaucaauggcaaauugaacagacucauugguaagaccaaugaaaaauuccaccagaucgagaaggaauuuagcgaggucgaagggaggauccaagaccuggagaaguacguugaggauacgaaaauugacuuauggucauauaacgcagaacugcucguggcucuugagaaccagcauaccauagaucugacagacagugaaaugaauaaguuguucgagaaaacuaagaaacagcuacgggaaaacgccgaggauaugggcaauggaugcuuuaagaucuaccacaagugugacaacgcuugcauuggcuccauccgaaaugggaccuauaaccaugauguauaccgcgacgaggcccugaauaacagauuccagauuaaaggaguggaacucaagagcgguuacaaagacuggauccuguggauaucuuuugcaaucucaugcuuccuucugugugucgccuugcucggcuuuauuaugugggcuugccaaaaggggaauaucagguguaacauuugcaucuga

SEQ ID NO: 131977 - RNA, 1701 nt, Artificial Sequence
  derived and/or modified sequence opt3 from hemagglutinin__InfluenzaA__AGK62993
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuuccaaguguaauucagccugcaucacgacuaacggaaguauaccuaaugacaagccauuucagaacgugaaucgaauuacauacggcgcuugucccagauaugugaaacaaaacacccugaaacuugccacugguaugaggaaugucccugaaaagcagacacgggggaucuucggagcaaucgcuggcuuuauugagaacggcugggaagggaugguugacggaugguacgguuuccgucaccagaauagcgagggccgcgggcaagccgcggaucugaaguccacccaggccgcaaucgaccagauuaacggaaaauugaacagacucauaggcaagacgaaugagaaauuccaucagaucgaaaaggaguuuucugaaguggaggguaggauucaagaucuggaaaaguauguagaggacaccaaaaucgauuuauggagcuacaacgcugagcugcucguggcccuugaaaaucagcacacaaucgaccugacugauucagagaugaacaaguuguucgaaaagaccaagaaacagcuacgggagaaugcugaagacauggggaacggcugcuuuaagauuuaucauaagugugauaaugccugcauaggaaguauccgaaacggcacauacgaccacgaugucuaucgcgacgaggcacugaauaacagauuccagauuaaagggguggagcucaaguccggauacaaagacuggauccuguggauuagcuuugccaucucuugcuuccuucuguguguugcuuugcucgguuuuauaauguggucaugccaaaagggcaauaucagguguaacauuugcaucuga

SEQ ID NO: 131978 - RNA, 1701 nt, Artificial Sequence
  derived and/or modified sequence opt3 from hemagglutinin__InfluenzaA__AGK62995
augaagaccaucauugcccugagcuacauacucugccuuguguucgcucagaaacugcccggcaacgacaauuccacagcaacuuuguguuuagggcaccaugccggaccuaacgguacgaucgucaagaccauuacaaaugaucaaaucgagguuacuaacgcgaccgaacuggugcagucuucaaguacaggcgagauuugcgacagcccacaccagauccuagauggggaaaauuguacccucauagacgcucugcuuggagauccgcagugcgacggcuuucaaaacaaaaagugggaucuguucguagagagauccaaagccuauucuaauuguuaccccuaugacgugccugauuacgcaucguugaggucacucgucgccagcagugguacucuggaauuuaacaaugaguccuucaacuggacaggggugacccagaauggaacgucuagcgcuugcauccggcgcuccaacaauucauuuuucagucgacugaacuggcucacucauuuaaauuuuaaguauccagcacugaacguuaccaugcccaacaaugagcaguucgacaaacuuuacauuuggggcgugcaccauccuggcacagauaaggaccagaucuuuuuguaugcccaaagcucugggcguauuacugucuccaccaagagaucacagcaggcugugaucccaaacauaggaagcaggccccggauucgcaauaucccuaguagaauuucuaucuacuggacaaucguaaaaccaggugauauucugcuaauaaacuccaccggcaaucucaucgccccgaggggguacuucaagauucggagcggaaaaucgucuaucaugcgcuccgacgcgcccauaggcaaguguaacucagaaugcauuacgccuaaugguaguaucccaaacgacaagcccuuucagaauguuaaccgaaucacuuauggggcauguccuagauacgugaaacaaagcacacugaaacuugccaccggaaugaggaaugucccagagaagcagacucggggcauuuucggcgcuaucgccggguuuauugaaaacggaugggaggguaugguggauggcugguauggguuccgucaccaaaauuccgagggacgcggccaggcagcugaccugaagucuacacaggccgcgauagaucagaucaacgguaaauugaauagacucauugggaagaccaacgaaaaauuccaccagaucgagaaggaauuuagcgagguggaaggcaggauccaagaccuggagaaguacgucgaggauacgaaaauugacuuauggucauauaacgccgaacugcucguugcacuugagaaucagcauaccauagaucugacagacagugaaaugaacaaguuguucgagaaaacuaagaaacagcuacgggaaaaugcugaggauaugggaaacggcugcuuuaagaucuaccacaagugugacaaugccugcauuggguccauccgaaacggaaccuauaaucaugauguguaccgcgacgaggcucugaacaauagauuccagauuaaagguguagaacucaagagcggcuacaaagacuggauccuguggauaucuuuugccaucucaugcuuccuucuguguguggcauugcucggguuuauuaugugggccugccaaaagggaaacaucagguguaauauuugcaucuga

SEQ ID NO: 131979 - RNA, 1701 nt, Artificial Sequence
  derived and/or modified sequence opt3 from hemagglutinin__InfluenzaA__AGK62997
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgauaaguucgacaaacuuuauauuuggggaguccaucacccuggcacagauaaggaccagaucuuuuuguacgcccaggcuagcggccguauuacugugucuaccaaaagaucccaacaggccguaaucccaaauauagggucaaggccccggguucgcaacauuccuagcagagugaguaucuauuggacaauugucaagccaggagauauccugcuaaucaauucuaccgguaaccucauugcgccgaggggcuacuucaaaauacgguccggaaagagcucgaucaugcgcucugacgcacccauugggaaguguaauuccgccugcaucacgccuaacggcucaauaccaaaugacaaacccuuucagaacgugaaucgaauuacuuguggugcuugcgccagauacgugaagcagaacacacugaaacuugcaaccgggaugaggaaugucccugagaagcaaacucggggaaucuucggcgcuaucgccguuuuuauugaaaacggcugggaggggaugguggauggaugguaugguuuccgucaccagaauagugaaggccgcgagcaggcggccgcauuccaaagcacacaggcugccaucgaccagauuauagggaaacugaacagauugaucggagagaccaacgaaaaguuucaucagauugagaaagaguucuccgaaguagaaaggcggauccaagcucucgagaaguacguggaggauacgaagaucgaccuguggucuuauaaugccgaauuacuggucgcacucgagaaccagcacaccauugaucuuacagacagcgaaaugaauaaacuguuugagaagacuaaaaagcaguugcgagaaaacgccgaggauaugggcaaugguuguuucaaaauauaccauaagugcgacaacgcuugcaucgggucaauucgcaauggcaccuaugaucacgacguguacagagaugaggcgcuaaacaauagguuucagaucaagggaguugaacugaaaaguggcuauaaggacuggauucucuggaucuccuucgcaauaagcuguuuucugcuuugcguggcccuguugggguucaucauguggucuugucaaaaaggaaacauucggugcaauaucuguauuuga

SEQ ID NO: 131980 - RNA, 1701 nt, Artificial Sequence
  derived and/or modified sequence opt3 from hemagglutinin__InfluenzaA__AGK62999
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagccuauucuaacuguuaccccuaugaugucccugacuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaacuuuaaguauccagcacugaacgugaccaugcccaauaacgagcaguucgauaagcuguacauuuggggaguccaccauccuggcacagacaaagaucagaucuuuuuguaugcccaagcuagcggccguauuacugugucuaccaagagaucccagcaggccguaaucccaaauauagggucaaggccccggguucgcaacauuccuagcagagugaguaucuacuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgccuaacggcucaauaccaaaugacaagcccuuucagaacgugaaucgaauuacuuauggugcuuguccuagauacgugaaacaaaacacacugaaacuugccaccgggaugaggaaugucccagaaaaacagacucggggaaucuucggcgcaaucgcuggcuuuauugagaacgggugggaaggaaugguugacgguugguauggcuuccgucaccagaauagugaggggcgcggacaagccgcggaucuuaagagcacacaggccgcaaucgaccagauuaacggcaaauugaacagacucauagguaagaccaaugagaaauuccaccagaucgaaaaggaguuuuccgaaguggaggggaggauucaagaucuggaaaaguacguagaggacacgaaaaucgauuuauggucuuauaacgcugagcugcucguggcccuugaaaaucagcauaccaucgaccugacagauagcgagaugaacaaguuguucgaaaagacuaagaaacagcuacgggagaaugcugaagacaugggcaacggaugcuuuaagauuuaccacaagugugauaaugccugcauaggcucaauccgaaacgggaccuaugaccaugaugucuaccgcgacgaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucagguguaacauuugcaucuga

SEQ ID NO: 131981 - RNA, 1701 nt, Artificial Sequence
  derived and/or modified sequence opt3 from hemagglutinin__InfluenzaA__AGK63001
augaagaccaucauugcccugagcuacauacucugccuuguguucgcucagaaacugcccggcaacgacaauuccacagcaacuuuguguuuaguccaccaugccguuccuaacgggacgaucgugaagaccauuacaaaugaucaaaucgagguaacuaacgcgaccgaacuggugcagucuucaaguacaggagagauuugcgacagcccacaccagauccuagauggugaaaauuguacccucauagacgcucugcuuggcgauccgcagugcgacggguuucaaaacaaagagugggaucuguucgucgaaagauccaaggccuauucuaauuguuaccccuaugacgugccugauuacgcaucguugaggucacucguugccagcaguggaacucuggaguuuaacaaugaguccuucaacuggacaggcgugacccagaaugguacgucuagcgcuugcauccggcgcuccaacucaaguuucuucagccgacugaaugggcucacucauuuaaacuuuaaauauccagcacugaaugucaccaugcccaacaacgaacaguucgacaaacuuuacauuuggggagugcaccauccuggcacagauaaggaccagaucuuuuuguaugcccaaucuuccggccguauuacuguaucaaccaagagaagccagcaggcuguuaucccaaauauagggaguaggccccggauucgcaacaucccuucuagaauuuccaucuacuggacaaucgugaagccaggagauauucugcuaauaaauagcaccgguaaccucaucgccccgaggggcuacuucaaaauucggucggggaagucuuccaucaugcgcucagacgcgcccauaggaaaauguaauagugagugcauuacgccuaacggcagcaucccaaaugacaagcccuuucagaacgucaaucgaaucacuuauggugcauguccuagauacgugaagcaauccacacugaaacuugccaccgggaugaggaacgugccagaaaagcagacucggggaauuuucggcgcuaucgccggcuuuauugagaaugggugggagggaauggucgaugguugguauggcuuccgucaccagaacucugaagggcgcgagcaagcagcugacuuccagagcacacaggccgcgauagaucagaucauuggaaaacugaauagauugaucggcaagaccaacgaaaaauuucaccaaaucgagaaggaauuuucagagguugagaggcggauucaggaccucgaaaaauacguggaggauacgaagauagaccuguggaguuauaaugccgaauuacugguagcacucgagaaccagcauaccaucgaucuuacagacuccgaaaugaacaagcuguuugagaaaacuaagaaacaguugcgagagaaugcugaagauauggguaacgggugcuucaagauuuaccacaaaugugacaaugccugcaucggcagcauucgcaacggaaccuauaaucaugauguguacagagacgaggcucuaaacaauagguuucaaaucaagggcgucgaacugaagucuggguacaaagacuggauacucuggaucucauucgccauuaguugcuuucugcuuuguguggcacuguugggauucaucauguggagcugccagaaggguaacauucgguguaauaucugcauauga

SEQ ID NO: 131982 - RNA, 1701 nt, Artificial Sequence
  derived and/or modified sequence opt3 from hemagglutinin__InfluenzaA__AGK63003
augaagaccaucauugcccugagcuacauacucugccuuguguucgcucagaaacugcccggcaacgacaauuccacagcaacuuuguguuuagggcaccaugccggaccuaacgguacgaucgucaagaccauuacaaaugaucaaaucgagguuacuaacgcgaccgaacuggugcagucuucaaguacaggcgagauuugcgacagcccacaccagauccuagauggggaaaauuguacccucauagacgcucugcuuggagauccgcagugcgacggcuuucaaaacaaaaagugggaucuguucaucgagagauccaaagccuauucuaauuguuaccccuaugacguaccugauuacgcaucguugaggucacucguggccagcagugguacucuggaauuuaacaaugaguccuucaacuggacaggggucacccagaauggaacgucuagcgcuugcauucggcgcuccaacucaaguuucuuuagccgacugaauuggcucacucauuuaaacuuuaaguauccagcacugaaugugaccaugcccaacaacgagcaguucgacaagcuguacaucuggggcguucaccauccuggcacagauaaagaccagaucuuuuuguaugcccaaucuuccgggcguauuacugugucaaccaagagaagccagcaggcugucauaccaaauauuggaaguaggccccggauccgcaacauuccuucuagaaucuccaucuacuggacaauugugaaaccaggugauauacugcuaaucaauagcaccggcaaccucauugccccgaggggguacuucaagauccggucgggaaaaucuuccauaaugcgcucagacgcgcccauuggcaaguguaauagugcaugcaucacgccuaacgguagcaucccaaaugacaagcccuuucagaacguaaaucgaauuacuuauggggccuguccuagauacguuaaacaauccacacugaaacuugcuaccggaaugaggaacgugccagaaaaacagacucggggcaucuucggcgccauugcaggguuuauagagaauggaugggaagguauggucgauggcugguauggguuccgucaccagaacucugagggacgcggccaagcugccgaccuuaagagcacacaggcggccaucgaucagauuaaugguaaauugaacagacucaucgggaagaccaaugagaaauuccaccagaucgaaaaggaguuuucagaaguggagggcaggauucaagaccuggaaaaguacguggaggauacgaaaauagacuuauggaguuauaacgcagagcugcucgucgcucuugaaaaccagcauaccaucgaucugacagacuccgagaugaauaaguuguucgaaaagacuaagaaacagcuacgggagaacgccgaagauaugggaaauggcugcuuuaagauuuaccacaagugugacaacgcuugcaucgggagcauucgaaauggaaccuauaaccaugauguuuaccgcgacgaggcccugaauaacagauuccagaucaaagguguggagcucaagucuggcuacaaagacuggauacuguggaucucauuugcaauuaguugcuuccuucuguguguagccuugcucggguuuaucaugugggcuugccaaaagggaaauauuagguguaacaucugcauauga

SEQ ID NO: 131983 - RNA, 1701 nt, Artificial Sequence
  derived and/or modified sequence opt3 from hemagglutinin__InfluenzaA__AGK63005
augaagaccaucauugcccugagcuacauacucugccuuguguucgcucagaaacugcccggcaacgacaauuccacagcaacuuuguguuuaguccaccaugccguuccuaacgggacgaucgugaagaccauuacaaaugaucaaaucgagguaacuaacgcgaccgaacuggugcagucuucaaguacaggagagauuugcgacagcccacaccagauccuagauggugaaaauuguacccucauagacgcucugcuuggcgauccgcagugcgacggguuucaaaacaaaaagugggaucuguucgucgagagauccaaagccuauucuaauuguuaccccuaugacgugccugauuacgcaucguugaggucacucguugccagcaguggaacucuggaauuuaacaaugaguccuucaacuggacaggcgugacccagaaugguacgucuagcgcuugcauccggcgcuccaacucaaguuucuucagccgacugaaugggcucacucauuuaaacuuuaaguauccagcacuggacgucaccaugcccaauaacgauaaguucgacaaacuuuacauuuggggagugcaccauccuggcacagauaaggaccagaucuuuuuguaugcccagucuuccggccguauuacuguaucaaccaaaagaagccaacaggcuguuaucccaaacauagggaguaggccccggauucgcaauaucccuucuagaauuuccaucuacuggacaaucgugaagccaggagacauucugcuaauaaacagcaccgguaaucucaucgccccgaggggcuacuucaaaauucggucggggaagucuuccaucaugcgcucagaugcgcccauaggaaaguguaacagugagugcauuacgccuaauggcagcaucccaaacgacaaacccuuucagaaugucaaccgaaucacuuauggugcauguccuagauacgugaagcaguccacacugaaacuugccaccgggaugaggaaugugccagaaaagcaaacucggggaauuuucggcgcuaucgccgucuuuauugagaacggcugggaagggaugguugauggaugguaugguuuccgucaccaaaauucugagggccgcgagcaggcagcugacuuccagagcacacaggccgcgauagaucagaucaacgggaaacugaauagauugauuggaaagaccaacgaaaaauuucaccagaucgagaaggaauuuucagagguggaaggcaggauccaagaccucgagaaguacguagaggauacgaaaauugaccuguggaguuauaaugccgaauuacugguggcacucgagaaccagcauaccauagaucuuacagacuccgaaaugaacaagcuguuugagaaaacuaagaaacaguugcgggaaaaugcugaggauauggguaacgggugcuucaagaucuaccacaagugugacaaugccugcauuggcagcauccgaaacggaaccuauaaucaugacgucuaccgcgaugaggcucuaaacaauagauuucagauuaaaggcguggaacugaagucuggguacaaagacuggauccucuggauaucauucgccaucaguugcuuucugcuuuguguugcacuguugggauucauuaugugggccugccaaaaggguaacaucagguguaauauuugcaucuga

SEQ ID NO: 131984 - RNA, 1701 nt, Artificial Sequence
  derived and/or modified sequence opt3 from hemagglutinin__InfluenzaA__AGK63007
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagcccauucuaauuguuaucccuacgacgucccugauuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaauuuuaaguacccagcacugaacgugaccaugcccaacaaugagcaguucgacaagcuguauauuuggggaguccaucacccuggcacagauaaagaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaaaccaggagauauccugcuaaucaacucuaccgguaaucucauugcgccgaggggcuacuucaagauacgguccgggaaaagcucgaucaugcgcucugacgcacccauuggaaaguguaacuccgaaugcaucacgccuaauggcucaauaccaaacgacaagcccuuucagaaugugaaccgaauuacuuacggugccuguccuagauaugugaaacaaaauacacugaaacuugcuaccgggaugaggaacgucccagagaagcagacucggggaaucuucggcgccaucgcaggcuuuauugaaaaugggugggagggaaugguugaugguugguacggcuuccgucaccagaacagugaggggcgcggacaagcugccgaccuuaagagcacacaggcggccaucgaucagauuaauggcaaauugaacagacucauagguaagaccaacgaaaaauuccaucagaucgagaaggaauuuuccgagguggaagggaggauucaagaccuggagaaguauguagaggauacgaaaaucgacuuauggucuuacaaugcagaacugcucguggcucuugagaaccagcacaccaucgaucugacagacagcgaaaugaauaaguuguucgagaaaacuaagaaacagcuacgggaaaacgccgaggauaugggcaauggaugcuuuaagauuuaucauaagugugacaacgcuugcauaggcucaauccgaaaugggaccuacgaucacgacgucuaucgcgacgaggcccugaacaauagauuccagauuaaaggaguggaacucaagagugguuacaaagauuggauccuguggauuuccuuugcaaucagcugcuuccuucuguguguugccuugcucggcuuuauaaugugggcuugccaaaaggggaacaucagguguaauauuugcaucuga

SEQ ID NO: 131985 - RNA, 1701 nt, Artificial Sequence
  derived and/or modified sequence opt3 from hemagglutinin__InfluenzaA__AGK63009
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggacugcaaaauaaaaagugggacuuguuuguggagagauccaaagcccauucuaacuguuaucccuacgaugucccugacuaugcaucgcucaggucacugguggccagcaguggcacucuggaguucaauaacgaauccuuuaauuggacagguguuacccagaacgggacgucuagcgcuugcauccggcgcuccaauaacucauucuuuagucgacucaauugguuaacucaccugaacuucaaguacccagcacuuaacgugaccaugcccaauaacgagcaguuugauaaguuguauauuuggggaguccaucacccuggcacagacaaagaucagaucuuccuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccuacucaucaauucuaccgguaaccugauugcgccgaggggcuacuuuaagauacgguccgggaaaagcucgaucaugcgcucugaugcacccauuggaaaguguaauuccgccugcaucacgccuaacggcucaauaccaaaugacaagcccuuccagaacgugaaucgaauuacuuacggugcuuguccuagauaugugaaacaaaacacacuuaagcuggccaccgggaugaggaaugucccagaaaaacagacucggggaaucuuuggcgcaaucgcuggcuucauugagaacgggugggaaggaaugguugacgguugguacggcuuucgucaccagaauagugaggggcgcggacaagccgcggauuugaaaagcacacaggccgcaaucgaccagauuaacggcaaacucaacagacugauagguaagaccaaugagaaauuccaucagaucgaaaaggaguucuccgaaguggaggggaggauucaagauuuagaaaaguauguagaggacacgaaaaucgaucuguggucuuacaacgcugagcuccuuguggcccuggaaaaucagcacaccaucgacuugacagauagcgagaugaacaagcuauuugaaaagacuaagaaacagcugcgggagaaugcugaagacaugggcaacggaugcuucaagauuuaucauaagugugauaaugccugcauaggcucaauccgaaacgggaccuacgaccacgaugucuaucgcgacgaggcacucaauaacagauuucagauuaaaggaguggagcugaagagugguuacaaagacuggauccuuuggauuuccuucgccaucagcugcuuucuguuguguguugcucuccugggcuucauaaugugggcgugccaaaaggggaauaucagguguaacauuugcaucuga

SEQ ID NO: 131986 - RNA, 1701 nt, Artificial Sequence
  derived and/or modified sequence opt3 from hemagglutinin__InfluenzaA__AGK63011
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggguucgcaauauuccuagcagaaucaguauuuacuggacaaucgugaaaccaggagauauccugcuaauuaacucuaccgguaaucucauagcgccgaggggcuacuucaagauccgguccgggaaaagcucgauuaugcgcucugacgcacccaucggaaaguguaacuccgaaugcauaacgccuaauggcucaauuccaaacgacaagcccuuucagaaugucaaccgaaucacuuauggugccuguccuagauacgugaaacaaaguacacugaaacuugcuaccgggaugaggaaugugccagagaagcagacucggggaaucuucggcgccauugcaggcuuuaucgaaaacgggugggagggaauggucgaugguugguauggcuuccgucaccagaauagcgaggggcgcggacaagcugccgaccugaaguccacacaggcggccauugaucagauaaacggcaaauugaauagacucaucgguaagaccaacgaaaaauuccaccagauugagaaggaauuuucugagguugaagggaggauccaagaccuggagaaguacguggaggauacgaaaaucgacuuauggagcuauaacgcagaacugcucguagcucuugagaaucagcauaccauugaucugacagacucagaaaugaacaaguuguucgagaaaacuaagaaacagcuacgggaaaaugccgaggauaugggcaacggaugcuuuaagauauaccacaagugugacaaugcuugcaucggcaguauucgaaacgggaccuaugaucaugacguguaccgcgacgaggcccugaauaacagauuccagaucaaaggagucgaacucaaguccgguuacaaagauuggauucuguggaucagcuuugcaauaucuugcuuccuucuguguguggccuugcucggcuuuaucaugugggcuugccaaaaggggaauauuagguguaacaucugcauuuga

SEQ ID NO: 131987 - RNA, 1701 nt, Artificial Sequence
  derived and/or modified sequence opt3 from hemagglutinin__InfluenzaA__AGK63013
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacuggaugugaccaugcccaacaaugagcaguucgacaaacuuuauauuuggggaguccaucacccuggcacagauaaggaccagaucuuuuuguacgcccaagcuagcggccguauuacugugucuaccaagagaucccagcaggccguaaucccaaacauagggucaaggccccggguucgcaauauuccuagcagagugaguaucuauuggacaauugucaaaccaggagauauccugcuaaucaacucuaccgguaaucucauugcgccgaggggcuacuucaagauacgguccgggaaaagcucgaucaugcgcucugacgcacccauuggaaaguguaacuccgccugcaucacgccuaauggcucaauaccaaacgacaagcccuuucagaaugugaaccgaauuacuuacggugcuugugccagauaugugaaacaaaauacacugaaacuugcaaccgggaugaggaacgucccugaaaagcagacucggggaaucuucggcgcuaucgccguuuuuauugagaauggcugggaagggaugguggauggaugguacgguuuccgucaccagaacagugagggccgcgggcaagcggccgcacugcagagcacacaggcugccaucgaccagauuaccggaaaguugaauagacucauaggcgagacgaacgaaaaauuccaucaaaucgagaaggaauuuuccgagguagaagguaggauucaggcucuggagaaauauguggaggauaccaagaucgacuuauggucuuacaacgccgaacugcucgucgcacuugagaaucagcacacaaucgaucugacugacagcgaaaugaacaaguuguucgagaaaaccaagaaacagcuacgggaaaaugccgaggauauggggaacggcugcuuuaagauuuaucauaaaugugacaaugcuugcauaggaucaauccgaaacggcacauacgaucacgacguguaucgcgaugaggcgcugaauaacagauuccaaauuaaggggguugaacucaagaguggauacaaagacuggauccuguggauuuccuuugcaaucagcugcuuccuucuguguguggccuugcucgguuuuauaauguggucuugccagaagggcaauaucagguguaacauuugcaucuga

SEQ ID NO: 131988 - RNA, 1701 nt, Artificial Sequence
  derived and/or modified sequence opt3 from hemagglutinin__InfluenzaA__AGK63015
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggaaguccaacucaaguuucuuuagccgccugaauuggcucacucauuuaaacuuuaaguauccagcacugaaugugaccaugcccaacaacgagcaguucgacaaacuuuacauuuggggaguccaccauccuggcacagauaaggaccagaucuuuuuguaugcccaaucuuccggccgaauuacugugucaaccaaacguagccagcaggcuguaaucccaaauauagggaguagacccaggauucggaacaucccuucucgcauuuccaucuacuggacaaucguuaagccaggagauauucugcuaauaaauagcaccgguaaccucaucgccccgagaggcuacuucaaaauuaggucggggaagucuuccaucaugcggucagacgcgcccauaggaaaguguaauagugaaugcauuacgccuaacggcagcaucccaaaugacaaacccuuucagaacgugaaucgcaucacuuauggugcauguccucgauacgucaagcaauccacacugaaacuugccaccgggaugagaaacgugccagagaagcagacuaggggaauuuucggcgcuaucgccggcuuuauugaaaaugggugggagggaaugguggaugguugguauggcuuccggcaccagaacucugaggggcguggacaagcagcugaccugaaaagcacacaggccgcgauagaucagaucaauggcaaguugaaccgccucauugguaaaaccaaugaaaaguuccaccagaucgagaaggaauuuucagaggucgaagggagaauccaagaccuggagaaauacguugaggauacgaagauugacuuauggaguuauaacgccgaacugcucguggcacuugagaaccagcauaccauagaucugacagacuccgaaaugaauaaauuguucgagaagacuaaaaagcagcuaagggaaaacgcugaggauaugggcaauggaugcuuuaagaucuaccacaaaugugacaacgccugcauuggcagcauccggaaugggaccuauaaccaugauguauaccgagacgaggcucugaauaaccgcuuccagauuaagggaguggaacucaaaucugguuacaaggacuggauccuguggauaucauuugccaucaguugcuuccuucugugugucgcauugcucggcuuuauuaugugggccugccaaaaagggaauaucagauguaacauuugcaucuga

SEQ ID NO: 131989 - RNA, 1701 nt, Artificial Sequence; identical to SEQ ID NO: 128998
  derived and/or modified sequence opt3 from hemagglutinin__InfluenzaA__AGK63017

SEQ ID NO: 131990 - RNA, 1701 nt, Artificial Sequence
  derived and/or modified sequence opt3 from hemagglutinin__InfluenzaA__AGK63019
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacucaaguuucuuuagccgacugaauuggcucacucauuuaaacuuuaaguauccagcacugaaugugaccaugcccaacaacgagcaguucgacaagcuguacauuuggggaguccaccauccuggcacagauaaagaccagaucuuuuuguaugcccaaucuuccggccguauuacugugucaaccaagagaagccagcaggcuguaaucccaaauauagggaguaggccccggauucgcaacaucccuucuagaauuuccaucuacuggacaaucguuaaaccaggagauauucugcuaauaaauagcaccgguaaccucaucgccccgaggggcuacuucaagauucggucggggaaaucuuccaucaugcgcucagacgcgcccauaggaaaguguaauagugaaugcauuacgccuaacggcagcaucccaaaugacaagcccuuucagaacgugaaucgaaucacuuauggugcauguccuagauacgucaaacaauccacacugaaacuugccaccgggaugaggaacgugccagagaagcagacucggggaauuuucggcgcuaucgccggcuuuauugaaaaugggugggagggaaugguggaugguugguauggcuuccgucaccagaacucugaggggcgcggacaagcagcugaccuuaagagcacacaggccgcgauagaucagaucaauggcaaauugaacagacucauugguaagaccaaugaaaaauuccaccagaucgagaaggaauuuucagaggucgaagggaggauccaagaccuggagaaguacguugaggauacgaaaauugacuuauggaguuauaacgccgaacugcucguggcacuugagaaccagcauaccauagaucugacagacuccgaaaugaauaaguuguucgagaaaacuaagaaacagcuacgggaaaacgcugaggauaugggcaauggaugcuuuaagaucuaccacaagugugacaacgccugcauuggcagcauccgaaaugggaccuaugaucaugacguauaccgcgacgaggcucugaacaauagauuccagauuaaaggaguggaacucaagucugguuacaaagauuggauccuguggauaucauuugccaucaguugcuuccuucugugugucgcauugcucggcuuuauuaugugggccugccaaaaggggaacaucagguguaauauuugcaucuga

SEQ ID NO: 131991 - RNA, 1701 nt, Artificial Sequence; identical to SEQ ID NO: 131865
  derived and/or modified sequence opt3 from hemagglutinin__InfluenzaA__AGK63021

SEQ ID NO: 131992 - RNA, 1701 nt, Artificial Sequence
  derived and/or modified sequence opt3 from hemagglutinin__InfluenzaA__AGK63025
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucaucgagagauccaaagccuauucuaauuguuaccccuaugacgugccugauuacgcaucguugaggucacucgucgccagcaguggcacucuggaauuuaacaaugaguccuucaacuggacaggugugacccagaaugggacgucuagcgcuugcauucggaaguccaacucaaguuucuuuagccgccugaauuggcucacucauuuaaacuuuaaguauccagcacugaauguuaccaugcccaacaacgagcaguucgacaaacuuuacaucuggggagugcaccauccuggcacagauaaggaccagaucuuuuuguaugcccaaucuuccggccgaauuacugucucaaccaaacguagccagcaggcugugauaccaaauauugggaguagacccaggauccggaacauuccuucucgcaucuccaucuacuggacaauuguaaagccaggagauauacugcuaaucaauagcaccgguaaccucauugccccgagaggcuacuucaaaaucaggucggggaagucuuccauaaugcggucagacgcgcccauuggaaaguguaauagugaaugcaucacgccuaacggcagcaucccaaaugacaaacccuuucagaacguuaaucgcauuacuuauggugcauguccucgauacgugaagcaauccacacugaaacuugccaccgggaugagaaacgucccagagaagcagacuaggggaaucuucggcgcuauugccggcuuuauagaaaaugggugggagggaaugguggaugguugguauggcuuccggcaccagaacucugaggggcguggacaagcagcugaccugaaaagcacacaggccgcgaucgaucagauuaauggcaaguugaaccgccucaucgguaaaaccaaugaaaaguuccaccagaucgagaaggaauuuucagagguggaagggaggauucaagaccuggagaaauacgucgaggauacgaagauagacuuauggaguuauaacgccgaacugcucguugcacuugagaaccagcauaccaucgaucugacagacuccgaaaugaauaaauuguucgagaagacuaaaaagcagcuaagagaaaacgcugaggauaugggcaauggaugcuuuaagauuuaccacaaaugugacaacgccugcaucggcagcauucggaaugggaccuauaaccaugauguguaccgagacgaggcucugaauaaccgcuuccagaucaagggaguagaacucaaaucugguuacaaggacuggauacuguggaucucauuugccauuaguugcuuccuucuguguguggcauugcucggcuuuaucaugugggccugccaaaaagggaauauuagauguaacaucugcauauga

SEQ ID NO: 131993 - RNA, 1701 nt, Artificial Sequence; identical to SEQ ID NO: 131090
  derived and/or modified sequence opt3 from hemagglutinin__InfluenzaA__AGK63027

SEQ ID NO: 131994 - RNA, 1701 nt, Artificial Sequence
  derived and/or modified sequence opt3 from hemagglutinin__InfluenzaA__AGK63029
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaagcuguauauuuggggaguccaucacccuggcacagacaaagaucagaucuuuuuguacgcccaagcuagcggccguauuacugugucuaccaagagaucccagcaggccguaaucccaaauauagggucaaggccccggguucgcaacauuccuagcagagugaguaucuauuggacaauugucaaaccaggagacauccugcuaaucaauucuaccgguaaccucauugcgccgaggggcuacuucaagauacgguccgggaaaagcucgaucaugcgcucugaugcacccauuggaaaguguaauuccgccugcaucacgacuaacggcucaauaccuaaugacaagccauuucagaacgugaaucgaauuacauacggugcuugucccagauaugugaaacaaaacacccugaaacuugccacugggaugaggaaugucccugaaaaacagacacggggaaucuucggcgcaaucgcuggcuuuauugagaacgggugggaaggaaugguugacgguugguacggcuuccgucaccagaauagugaggggcgcggacaagccgcggaucuuaagagcacccaggccgcaaucgaccagauuaacggcaaauugaacagacucauagguaagacgaaugagaaauuccaucagaucgaaaaggaguuuuccgaaguggaggggaggauucaagaucuggaaaaguauguagaggacaccaaaaucgauuuauggucuuacaacgcugagcugcucguggcccuugaaaaucagcacacaaucgaccugacugauagcgagaugaacaaguuguucgaaaagaccaagaaacagcuacgggagaaugcugaagacaugggcaacggaugcuuuaagauuuaucauaagugugauaaugccugcauaggcucaauccgaaacgggacauacgaccacgaugucuaucgcgacgaggcacugaauaacagauuccagauuaaaggaguggagcucaagagugguuacaaagacuggauccuguggauuuccuuugccaucagcugcuuccuucuguguguugcuuugcucggcuuuauaaugugggcgugccaaaaggggaauaucagguguaacauuugcaucuga

SEQ ID NO: 131995 - RNA, 1701 nt, Artificial Sequence
  derived and/or modified sequence opt3 from hemagglutinin__InfluenzaA__AGK63031
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaagaagaaaugggaucuguucguggagagauccaaggcccauucuaacuguuaucccuacgacgucccugauuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaaugugauuaugcccaacaacgagcaguucgacaaacuuuauaucuggggaguccaucacccuggcaccgauaaggaccagaucuuuuuguacgcccaagcuagcggccguauuacagugucuacuaaaagaucccagcaggccguaauaccaaauauugggucaaggccccggguucgcaacaucccuagcagagugaguauuuauuggaccaucgucaagccaggagauauccugcuaauuaauucuacagguaaccucauagcgccgaggggcuacuucaaaauccgguccgggaaaagcucgauuaugcgcucugacgcacccaucggaaaguguaauuccgccugcauaaccccuaacggcucaauuccaaaugacaaacccuuucagaacgugaaucgaaucacguacggugcuuguccuagauaugugaagcaaaacacucugaaacuugccacagggaugaggaaugucccagaaaagcagacccggggaaucuucggcgcaauugcuggcuuuaucgagaacgggugggaaggaaugguugaugguugguacggcuuccgucaccagaauagugaggggcgcggacaagccgcggaccugaaaagcacucaggccgcaauugaucagauaaacggcaaguugaauagacucaucgguaaaacaaacgagaagcugcaucagauugaaaaggaguucuccgaaguggaggggaggaucuuagaccuggaaaaauauguagaggauaccaagaucgaccucuggucuuacaacgcugagcuucugguggccuuggaaaaucaacacacgauugaucuaaccgacagcgagaugaacaaacuguuugaaaagacuaaaaagcagcuccgggagaaugcugaagauaugggcaacggaugcuucaagauauaucauaaaugugacaaugccugcaucggcucaauucgaaacgggacauacgaucacgacgucuaucgcgacgaggcacugaauaacagauuucagaucaagggaguggagcuuaaaagugguuacaaggauuggauucuguggaucuccuucgccauaagcugcuuuuugcucuguguugcucuguuaggcuucaucaugugggcgugccagaaagggaauauuagguguaacaucugcauuuga

SEQ ID NO: 131996 - RNA, 1701 nt, Artificial Sequence
  derived and/or modified sequence opt3 from hemagglutinin__InfluenzaA__AGK63033
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucugaucguggagagauccaaagccuauucuaauuguuaccccuaugacgucccugauuacgcaucguugaggucacucguggccagcaguggcacucuggaguucaacaaugaauccuuuaacuggacagguguuacccagaaugggacgucuagcgcuugcauucggaaguccaacucaaguuucuuuagccgccugaauuggcucacucauuuaaacuucaaguauccagcacugaaugugaccaugcccaacaacgagcaguuugacaaacuuuacaucuggggaguccaccauccuggcacagauaaggaccagauuuucuuguaugcccaggcuucuggccgaaucacuguguccaccaaacguucacaacaggccguaauaccaaauauugggagcagacccaggauccggaacauuccuagucgcaucucuaucuacuggacaauuguuaagccaggagauauacugcuaaucaauuccaccgguaaccucauugcgccgagaggcuacuuuaaaaucaggagcgggaagucgucuauaaugcgguccgacgcacccauuggaaaguguaauucagaaugcaucacgccuaacggcaguaucccaaaugacaaacccuuccagaacgugaaucgcauuacuuauggugccuguccucgauacgucaagcaaagcacacugaaacuugcuaccgggaugagaaacgugccagagaagcagacuaggggaaucuuuggcgccauugcaggcuucauagaaaaugggugggagggaaugguggaugguugguauggcuuucggcaccagaacuccgaggggcguggacaagcugccgaccugaaaucuacacaggcggccaucgaucagauuaauggcaaguugaaccgccucaucgguaaaaccaaugaaaaguuccaccagaucgagaaggaguucagcgaagucgaagggaggauucaagaccuggagaaauacguugaggauacgaagauagacuuauggucauauaacgcagaacugcucguggcucuugagaaccagcauaccaucgaucugacagacagugaaaugaauaaauuguuugagaagacuaaaaagcagcuaagagaaaacgccgaggauaugggcaauggaugcuucaagauuuaccacaaaugugacaacgcuugcaucggcuccauucggaaugggaccuaugaucaugacguauaccgagacgaggcccugaacaaucgcuuucagaucaagggaguggaacucaaaagcgguuacaaggauuggauacuguggaucucuuucgcaauuucaugcuuucuucugugugucgccuugcucggcuucaucaugugggcuugccaaaaagggaacauuagauguaauaucugcauauga

SEQ ID NO: 131997 - RNA, 1701 nt, Artificial Sequence
  derived and/or modified sequence opt3 from hemagglutinin__InfluenzaA__AGK63035
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaggaccagaucuuuuuguaugcccaagcuagcggccguauuacugugucuaccaagagaucccagcaggccguaaucccaaacauagggucaaggccccggauucgcaauaucccuagcagaauuaguaucuacuggacaaucguuaaaccaggagauauucugcuaauaaacucuaccgguaaucucaucgcgccgaggggcuacuucaagauucgguccgggaaaagcucgaucaugcgcucugacgcacccauaggaaaguguaacuccgaaugcauuacgccuaauggcucaaucccaaacgacaagcccuuucagaaugugaaccgaaucacuuauggugccuguccuagauacgucaaacaaaguacacugaaacuugcuaccgggaugaggaaugugccagagaagcagacucggggaauuuucggcgccaucgcaggcuuuauugaaaacgggugggagggaaugguggaugguugguauggcuuccgucaccagaauagcgaggggcgcggacaagcugccgaccugaaguccacacaggcggccauagaucagaucaacggcaaauugaauagacucauugguaagaccaacgaaaaauuccaccagaucgagaaggaauuuucugaggucgaagggaggauccaagaccuggagaaguacguugaggauacgaaaauugacuuauggagcuauaacgcagaacugcucguggcucuugagaaucagcauaccauagaucugacagacucagaaaugaacaaguuguucgagaaaacuaagaaacagcuacgggaaaaugccgaggauaugggcaacggaugcuuuaagaucuaccacaagugugacaaugcuugcauuggcaguauccgaaacgggaccuaugaucaugacguauaccgcgacgaggcccugaauaacagauuccagauuaaaggaguggaacucaaguccgguuacaaagauuggauccuguggaucagcuuugcaauaucuugcuuccuucugugugucgccuugcucggcuuuauuaugugggcuugccaaaaggggaauaucagguguaacauuugcaucuga

SEQ ID NO: 131998 - RNA, 1701 nt, Artificial Sequence
  derived and/or modified sequence opt3 from hemagglutinin__InfluenzaA__AGK63037
augaagaccaucauugcccugagcuacauacucugccuuguguucgcucaggagcugcccggcaacgacaauuccacagcaacuuuguguuuagggcaccaugccgucccuaacggaacgaucguuaaaaccauuacaaaugaucaaaucgaagugacuaacgcgaccgagcugguacagucuucaaguacaggugaaauuugcaauagcccacaccagauccuagacggcgagaacuguacccucauagaugcucugcuuggggacccgcagugcgauggauuucaaaauaagaaaugggaccuguucguggaaagauccaaggcccauucuaacuguaaucccuaugaugucccugacuacgcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaacuuuaaauauccagcacugaaugugaccaugcccaacaaugaacaguucgauaaacuuuacauuuggggaguccaucacccuggcacagacaaggaucagaucuuuuuguaugcccaagcuagcggccguauuacugugucuaccaagagaucccagcaggccguaaucccaaacauagggucaaggccccggguucgcaauauuccuagcagagugaguaucuacuggacaauugucaagccaggagacauccugcuaaucaacucuaccgguaaucucauugcgccgaggggcuauuucaaaauacgguccggaaagagcucgaucaugcgcucugaugcacccauugggaaauguaacuccgccugcaucacgccuaauggcucaauaccaaacgacaagcccuuucagaaugugaaccgaauuacuuacggugcuuguccuagauacgugaagcaaaauacacugaaacuugccaccgggaugaggaacgucccagagaagcagacucggggaaucuucggcgcaaucgcuggcuuuauugaaaaugggugggagggaaugguugacgguugguauggcuuccgucaccagaacagugaggggcgcggacaagccgcggaucugaaaagcacacaggccgcaaucgaccagauuaacggcaaguugaauagacucauagguaaaaccaacgaaaaguuccaucagaucgagaaagaauuuuccgagguggaagggaggauucaagaucuggagaaguacguagaggacacgaagaucgauuuauggucuuauaaugcucagcugcucguggcccuugaaaaccagcacaccaucgaccugacagauagcgagaugaauaaauuguucgaaaagacuaaaaagcagcuacgggagaacgcugaagacaugggcaauggaugcuuuaaaauuuaccauaagugugauaacgccugcauaggcucaauccgaaaugggaccuaugaccacgaugucuaccgcgacgaggcacugaacaauagauuccaaauuaagggaguggagcucaaaagugguuauaaggacuggauccuguggauuuccuuugccaucagcugcuuccuucuguguguugcuuugcucggcuuuauaaugugggcgugccagaaagggaacaucagguguaauauuugcaucuga

SEQ ID NO: 131999 - RNA, 1701 nt, Artificial Sequence
  derived and/or modified sequence opt3 from hemagglutinin__InfluenzaA__AGK63039
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaagaagaaaugggaccuguucguggagagauccaaggcccauucuaauuguuaucccuacgaugucccugacuaugcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucacuuaaauuuuaaguacccagcacugaacgugacccuucccaacaaugagcaguucgauaaauuguauauuuggggaguccaucacccuggcacagacaaggaucagaucuuucuguacgcccaagcuagcggccguauuacugugucuaccaaaagaucccagcaggccguaaucccaaacauagggucaaggccccggguucgcaauauuccuagcagagugaguaucuauuggacaauugucaagccaggagacauccuacucaucaacucuaccgguaaucugauugcgccgaggggcuacuucaaaauacgguccgggaaaagcucgaucaugcgcucugaugcacccauuuccaaguguaacucagccugcaucacgccuaauggaaguauaccaaacgacaaacccuuucagaaugugaaccgaauuacuuacggcgcuuguccuagauaugugaagcaaaauacacuuaaacuggccaccgguaugaggaacgucccagaaaagcagacucgggggaucuucggagcaaucgcuggcuuuauugagaauggcugggaagggaugguugacggaugguacgguuuccgucaccagaacagcgagggccgcgggcaagccgcggauuugaaauccacacaggccgcaaucgaccagauuaauggaaagcucaacagacugauaggcaaaaccaacgagaaguuccaucagaucgaaaaggaguuuucugaaguggaggguaggauucaagauuuagaaaaauauguagaggacacgaagaucgaucuguggagcuacaaugcugagcuccuuguggcccuggaaaaccagcacaccaucgacuugacagauucagagaugaauaaacuauucgaaaagacuaaaaagcagcugcgggagaacgcugaagacauggggaauggcugcuuuaagauuuaucauaaaugugauaacgccugcauaggaaguauccgaaauggcaccuacgaccacgaugucuaucgcgacgaggcacucaacaauagauuccagauuaaggggguggagcugaaauccggauacaaggacuggauccuuuggauuagcuuugccaucucuugcuuccuguuguguguugcucuccuggguuuuauaauguggucaugccaaaaaggcaacaucagguguaauauuugcaucuga

SEQ ID NO: 132000 - RNA, 1701 nt, Artificial Sequence
  derived and/or modified sequence opt3 from hemagglutinin__InfluenzaA__AGK63041
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggacugcaaaacaaaaagugggauuugaucguggagagauccaaagcccauucuuauuguuaccccuaugacgucccugauuacgcaucgcucaggucacugguggccagcaguggcacucuggaauuuaauaacgaguccuucaauuggacagagguuacccagaacgguacgucuagcgcuugcauucggcgcuccaauaacucauuuuucagucgacucaauugguuaacucaccugaacuuuaaguauccagcacuuaaugugaccaugcccaacaacgaacaguucgacaaguuguacaucuggggaguccaucacccugggacagauaaagaccagauuuuucuguaugcccaagcuagcggccguaucacugugucuaccaagagaucccagcaggccguaauaccaaauauuggcucaaggccccggguucgcaacaucccuagcagagugaguauuuacuggacaaucgucaaaccaggggauauccuacucauuaauucuaccggaaaccugauagcgccgagggguuacuucaagauccgguccggcaaaagcucgauuaugcgcucugacgcacccaucgggaaguguaauuccgccugcauaacgccuaacggaucaauuccaaaugacaagcccuuucagaacgugaaucgaaucacuuauggcgcuuguccuagauacgugaaacaaaacacacuuaagcuggccaccgguaugaggaaugucccagagaaacagacucgggggaucuucggagcaauugcuggcuuuaucgaaaacggcugggaggggaugguugauggaugguaugguuuccgucaccagaauagugagggccgcgggcaagccgcggaccucaagagcacacaggccgcaauugaucagauaaacggaaaauugaauagacugaucggcaagaccaacgaaaaauuucaucagauugagaaggaguucuccgaaguggaagguaggauccaagacuuagagaaguacguagaggauacgaaaaucgaccuguggucuuauaacgcugaacuccuuguggcccuggagaaucagcacaccauugauuugacagacagcgaaaugaacaagcuauucgagaaaacuaagaaacagcugcgggaaaaugcugaggauauggggaacggcugcuuuaagauauaccauaagugugacaaugccugcaucggaucaauucgaaacggcaccuaugaucacgacgucuaccgcgacgaggcacucaauaacagauuccagaucaaagggguggaacugaagaguggauacaaagauuggauucuuuggaucuccuuugccauaagcugcuuccuguuguguguugcucuccuggguuuuaucaugugggcgugccaaaagggcaauauuagguguaacaucugcauuuga

SEQ ID NO: 132001 - RNA, 1701 nt, Artificial Sequence
  derived and/or modified sequence opt3 from hemagglutinin__InfluenzaA__AGK63043
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaauuuuaaguauccagcacugaacgugaccaugcccaacaaugagcaguucgacaaacuuuacauuuggggaguccaccauccuggcacagauaaagaccagaucuuuuuguaugcccaagcuagcggccguauuacugugucuaccaagagaucccagcaggccguaaucccaaacauagggucaaggccccggguucgcaauauuccuagcagagugaguaucuacuggacaauugucaaaccaggagauauccugcuaaucaacucuaccgguaaucucauugcgccgaggggcuacuucaagauacgguccgggaaaagcucgaucaugcgcucugacgcacccauuggaaaguguaacuccgccugcaucacgccuaauggcucaauaccaaacgacaagcccuuucagaaugugaaccgaauuacuuauggugcuuguccuagauacgugaaacaaaguacacugaaacuugccaccgggaugaggaaugucccagaaaagcagacucggggaaucuucggcgcaaucgcuggcuuuauugagaacgggugggaaggaaugguugaugguugguauggcuuccgucaccagaauagcgaggggcgcggacaagccgcggaccugaaguccacacaggccgcaaucgaucagauuaacggcaaauugaauagacucauagguaagaccaacgagaaauuccaccagaucgaaaaggaguuuucugaaguggaggggaggauucaagaccuggaaaaguacguagaggauacgaaaaucgacuuauggagcuauaacgcugagcugcucguggcccuugaaaaucagcauaccaucgaucugacagacucagagaugaacaaguuguucgaaaagacuaagaaacagcuacgggagaaugcugaagauaugggcaacggaugcuuuaagauuuaccacaagugugacaaugccugcauaggcaguauccgaaacgggaccuaugaucaugacgucuaccgcgacgaggcacugaauaacagauuccagauuaaaggaguggagcucaaguccgguuacaaagauuggauccuguggauuagcuuugccaucucuugcuuccuucuguguguugcuuugcucggcuuuauaaugugggcgugccaaaaggggaauaucagguguaacauuugcaucuga

SEQ ID NO: 132002 - RNA, 1701 nt, Artificial Sequence
  derived and/or modified sequence opt3 from hemagglutinin__InfluenzaA__AGK63045
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaagaagaaaugggaccuguucguggagagauccaaggccuauucuaauuguuaccccuaugaugucccugacuacgcaucguugaggucacucguggccagcaguggcacucuggaauuuaacaaugaguccuucaacuggacagguguuacccagaaugggacgucuagcgcuugcauccggaaguccaacucaaguuucuuuagccgccugaauuggcucacucauuuaaacuuuaaauauccagcacugaaugugaccaugcccaacaacgagcaguucgauaaacuuuacauuuggggaguccaccauccuggcacagacaaagaucagaucuuuuuguaugcccaggcuucuggccgaauuacuguguccaccaagcguucacaacaggccguaaucccaaauauagggagcagacccaggauucggaacaucccuagucgcauuucuaucuacuggacaaucguuaaaccaggagacauucugcuaauaaauuccaccgguaaccucaucgcgccgagaggcuacuucaagauuaggagcgggaagucgucuaucaugcgguccgaugcacccauaggaaaauguaauucagaaugcauuacgccuaacggcaguaucccaaaugacaagcccuuucagaacgugaaucgcaucacuuauggugccuguccucgauacgucaaacaaagcacacugaaacuugcuaccgggaugagaaacgugccagagaaacagacuaggggaauuuucggcgccaucgcaggcuuuauugaaaaugggugggagggaaugguggacgguugguauggcuuccggcaccagaacuccgaggggcguggacaagcugccgaucugaagucuacacaggcggccauagaccagaucaauggcaaauugaaccgccucauugguaagaccaaugaaaaguuccaccagaucgagaaagaauuuagcgaggucgaagggagaauccaagaucuggagaaguacguugaggacacgaaaauugauuuauggucauauaacgcacagcugcucguggcucuugaaaaccagcauaccauagaccugacagauagugagaugaauaaguuguucgaaaagacuaagaagcagcuaagggagaacgccgaagacaugggcaauggaugcuuuaaaaucuaccacaagugugauaacgcuugcauuggcuccauccggaaugggaccuaugaccaugauguauaccgagacgaggcccugaacaaucgcuuccaaauuaaaggaguggagcucaagagcgguuacaaagacuggauccuguggauaucuuuugcaaucucaugcuuccuucugugugucgccuugcucggcuuuauuaugugggcuugccagaaggggaacaucagauguaauauuugcaucuga

SEQ ID NO: 132003 - RNA, 1701 nt, Artificial Sequence
  derived and/or modified sequence opt3 from hemagglutinin__InfluenzaA__AGK63047
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugacagagagggaaggaugaacuacuauuggacacugauugaacccggugauaagaucacuuucgaggccaccggcaaccuaguggucccucgguacgcuuuugccauggaacgcaaugcaggguccggaauaauuaucagcgacacaccaguucaugauugcaacaccgcuugucagacgccggagggcgccauuaauacuucgcuccccuuccaaaacauccacccuaucacaauugguaaaugcccaaaguaugugaagucuaccaaacugagacuugcgacugggcugaggaauguacccuccauacagucacggggauuguuuggcgccaucgcaggcuucauugaagggggauggacagguaugguggacggcugguacggguaucaucaccagaacgagcagggaaguggcuacgcugccgaccucaagagcacccaaaaugcuaucgauaaaauaacgaacaaggucaauuccgugauugagaaaaugaacacccaguuuacagccguugguaaggaguucaaucaccuggagaagcgcaucgaaaacuuaaauaaaaagguggacgauggguuccuggacaucuggacuuacaacgcagagcuccuuguccuguuggaaaaugagcgaacccuagauuaucaugacucuaacgugaaaaaccuguacgagaagguaagaaaucagcucaaaaacaaugccaaggaaauuggcaacggauguuuugaguucuaucacaagugcgauaauacauguauggaaagcguuaaaaacggcacuuacgacuauccuaaguacucagaggaagcuaaacugaauagggagaagaucgauggggugaaacuugagaguacccggauuuaucagauacuggcgaucuacuccacagucgcaagcucuuuggugcucgucgugucacugggagccauuaguuuuuggaugugcagcaacgguuccuuacaaugccguaucuguaucuga

SEQ ID NO: 132004 - RNA, 1683 nt, Artificial Sequence
  derived and/or modified sequence opt3 from hemagglutinin__InfluenzaA__AGK82158
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaguccccagcccucaucgucuggggcauacaccauucugugagcacugcggagcagaccaaacuguacggguccggaaauaagcugguaacaguuggcucaaguaacuaucagcagagcuuugugcccucuccuggugcacggccacaagucaaugggcucuccggacgcauugauuuccacugguuaaugcugaaccccaaugacaccgugacguuuucauucaacggcgccuuuaucgcuccugaucgagccagcuuccuuagaggcaaaaguauggggauucagucuggagugcaggucgacgcaaacugcgaaggugauuguuaccauuccggcgggacuaucaucagcaauuugccauuucagaacauugacucgagggcuguuggaaagugcccgcgguaugugaagcaacguucucugcuacucgccacaggcaugaaaaauguacccgagauaccuaagggucgcgggcuguucggcgcgaucgccggauucauugaaaacggcugggaggggcuuaucgauggaugguacgguuuuagacaccagaaugcacagggcgaagggaccgcugccgacuacaaauccacucaaucagcuauagaccagauuacaggaaagcugaacagguugaucgagaaaaccaaucagcaguucgagcucaucgauaacgaauuuaaugagguggaaaagcaaauuggcaacgucaucaauuggacgcgggacaguauuaccgagguguggagcuauaacgccgaacuguuaguugcaauggagaaucagcacacaauagaucuggccgacuccgagauggauaaacucuacgaacgagugaagcgccagcuuagagagaacgcugaagaggacgguacuggguguuucgaaaucuuucauaagugcgaugacgauuguauggcgucuauuaggaauaacaccuaugaccacagcaaauaccgggaggaggcaaugcagaaccgcauccaaaucgauccagucaagcugucaaguggcuauaaagacgugauuuugugguucuccuuuggagccagcugcuucauacuacuggcuaucguaaugggccucguuuuuauuugcgugaagaaugggaacaugagauguacaaucugcauuuga

SEQ ID NO: 132005 - RNA, 1683 nt, Artificial Sequence
  derived and/or modified sequence opt3 from hemagglutinin__InfluenzaA__AGK84857
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaucaccaagaguuauaaaaacacaaggaaguccccagcccucauagucuggggcauucaccauucugugagcacugcggagcagaccaaacuguacggguccggaaauaagcugguaacaguuggcucaaguaacuaucagcagagcuuugugcccucuccuggugcacggccacaagucaaugggcucuccggacgcaucgauuuccacugguuaaugcugaaccccaaugacaccgugacguuuucauucaacggcgccuuuauugcuccugaucgagccagcuuccuuagaggcaaaaguauggggauccagucuggagugcaggucgacgcaaacugcgaaggugauuguuaccauuccggcgggacuaucauuagcaauuugccauuucagaacauagacucgagggcuguuggaaagugcccgcgguaugugaagcaacguucucugcuacucgccacaggcaugaaaaauguacccgagaucccuaagggucgcgggcuguucggcgcgauugccggauucaucgaaaacggcugggaggggcuuauagauggaugguacgguuuuagacaccagaaugcacagggcgaagggaccgcugccgacuacaaauccacucaaucagcuauugaccagaucacaggaaagcugaacagguugaucgagaaaaccaaucagcaguucgagcucauugauaacgaauuuaaugagguggaaaagcaaaucggcaacgucauuaauuggacgcgggacaguauaaccgagguguggagcuauaacgccgaacuguuaguugcaauggagaaucagcacacaaucgaucuggccgacuccgagauggauaaacucuacgaacgagugaagcgccagcuuagagagaacgcugaagaggacgguacuggguguuucgaaauuuuucauaagugcgaugacgauuguauggcgucuaucaggaauaacaccuaugaccacagcaaauaccgggaggaggcaaugcagaaccgcauccaaauugauccagucaagcugucaaguggcuauaaagacgugauauugugguucuccuuuggagccagcugcuucauccuacuggcuauuguaaugggccucguuuuuaucugcgugaagaaugggaacaugagauguacaauuugcaucuga

SEQ ID NO: 132006 - RNA, 1683 nt, Artificial Sequence
  derived and/or modified sequence opt3 from hemagglutinin__InfluenzaA__AGK84860
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaaaugacaguggauuugggccaaugcggguuacugggaaccaucacuggcccaccgcagugugaccaguuucuagaguucucugcugaucucauaaucgaacgccgagaggguucagacguuugcuaccccgggaaguuugugaacgaggaagcccugcgucagauucuuagagagaguggaggcaucgauaaagaagcaaugggcuucacauauagcgggauuaggaccaauggagccacguccgcuugucggcgcucugguucgucauuuuacgcagagaugaaguggcuguugagcaacacugacaaugccgcuuucccucaaaugaccaagaguuauaaaaacacaagaaaguccccagcccucaucgucuggggcauacaccauucugugagcacugcggagcagaccaaacuguacggguccggaaauaagcugguaacaguuggcucaaguaacuaucagcagagcuuugugcccucuccuggugcaaggccacaagucaaugggcucuccggacggauugauuuccacugguuaaugcugaaccccaaugacaccgugacguuuucauucaacggcgccuuuaucgcuccugaucgcgccagcuuccuucgaggcaaaaguauggggauucagucuggagugcaggucgacgcaaacugcgaaggugauuguuaccauuccggcgggacuaucaucagcaauuugccauuucagaacauugacucgagagcuguuggaaagugcccgagguaugugaagcaacggucucugcuacucgccacaggcaugaaaaauguacccgagauaccuaagggucgugggcuguucggcgcgaucgccggauucauugaaaacggcugggaggggcuuaucgauggaugguacgguuuucgccaccagaaugcacagggcgaagggaccgcugccgacuacaaauccacucaaucagcuauagaccagauuacaggaaagcugaacagauugaucgagaaaaccaaucagcaguucgagcucaucgauaacgaauuuaaugagguggaaaagcaaauuggcaacgucaucaauuggacgagggacaguauuaccgagguguggagcuauaacgccgaacuguuaguugcaauggagaaucagcacacaauagaucuggccgacuccgagauggauaaacucuacgaacgggugaagcgacagcuucgcgagaacgcugaagaggacgguacuggguguuucgaaaucuuucauaagugcgaugacgauuguauggcgucuauuagaaauaacaccuaugaccacagcaaauacagggaggaggcaaugcagaaccggauccaaaucgauccagucaagcugucaaguggcuauaaagacgugauuuugugguucuccuuuggagccagcugcuucauacuacuggcuaucguaaugggccucguuuuuauuugcgugaagaaugggaacaugcgcuguacaaucugcauuuga

SEQ ID NO: 132007 - RNA, 1683 nt, Artificial Sequence
  derived and/or modified sequence opt3 from hemagglutinin__InfluenzaA__AGK84863
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaaaagacaguggauuugggccaaugcggguuacugggaaccaucacuggcccaccgcagugugaccaguuucuagaguucucugcugaucucauaaucgaacgccgagaggguucagacguuugcuaccccgggaaauuugugaacgaggaagcccugcgucagauucuuagagagaguggaggcaucgauaaggaagcaaugggcuucacauauagcgggauuaggaccaauggagccacguccgcuugucggcgcucugguucgucauuuuacgcagagaugaaguggcuguugagcaacacugacaaugccgcuuucccucaaaugaccaaaaguuauaagaacacaagaaaauccccagcccucaucgucuggggcauacaccauucugugagcacugcggagcagaccaagcuguacggguccggaaauaaacugguaacaguuggcucaaguaacuaucagcagagcuuugugcccucuccuggugcaaggccacaagucaaugggcucuccggacggauugauuuccacugguuaaugcugaaccccaaugacaccgugacguuuucauucaacggcgccuuuaucgcuccugaucgcgccagcuuccuucgaggcaagaguauggggauucagucuggagugcaggucgacgcaaacugcgaaggugauuguuaccauuccggcgggacuaucaucagcaauuugccauuucagaacauugacucgagagcuguuggaaagugcccgagguaugugaaacaacggucucugcuacucgccacaggcaugaagaauguacccgagauaccuaaaggucgugggcuguucggcgcgaucgccggauucauugaaaacggcugggaggggcuuaucgauggaugguacgguuuucgccaccagaaugcacagggcgaagggaccgcugccgacuacaaguccacucaaucagcuauagaccagauuacaggaaaacugaacagauugaucgagaagaccaaucagcaguucgagcucaucgauaacgaauuuaaugagguggaaaaacaaauuggcaacgucaucaauuggacgagggacaguauuaccgagguguggagcuauaacgccgaacuguuaguugcaauggagaaucagcacacaauagaucuggccgacuccgagauggauaagcucuacgaacgggugaagcgacagcuucgcgagaacgcugaagaggacgguacuggguguuucgaaaucuuucauaaaugcgaugacgauuguauggcgucuauuagaaauaacaccuaugaccacagcaaguacagggaggaggcaaugcagaaccggauccaaaucgauccagucaaacugucaaguggcuauaaggacgugauuuugugguucuccuuuggagccagcugcuucauacuacuggcuaucguaaugggccucguuuuuauuugcgugaaaaaugggaacaugcgcuguacaaucugcauuuga

SEQ ID NO: 132008 - RNA, 1701 nt, Artificial Sequence
  derived and/or modified sequence opt3 from hemagglutinin__InfluenzaA__AGL07713
augaaggccauccuggugguccuccuuuacaccuucgcuacagcaaacgccgacacucugugcauuggcuaucacgcgaauaacagcacggauaccguugacacaguguuggagaaaaauguaacugugaccagauccgucaacuuacuggaagauaagcauaaugggaaacuauguaagcucaggggaguggcuccccugcaccuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaagaacuccgggagcagcugagcaguguguccucuuucgaacgcuuugagauuuucccgaagacagguagcuggcccaaucaugauuccaacaagggggucaccgccgcuuguccucacgcaggagccaaaggcuuuuauaagaaucugaucuggcucguggaaaaaggcaacucauacccaaaguuaaguaaaagcuauauaaaugacaaggggaaggagguacugguucuuuggggaauccaucaccccucuacgacugcugaucaacagcgauuguaccagaacgccgacaccuacguguucgucgguacaucccguuauucaaagaaguuuaaaccugagauugcgaucagaccaaaggugagggaucaggaaggccggaugaauuacuauuggacucugguggagcccggggacaaaauuaccuucgaagcaacaggaaaccuagucguuccucgcuacgccuuugcuauggagagaaacgccggcagcgguaucauaauuagugauaccccagugcacgacugcaauacgacuugucaaacaccgaagggggcaaucaacaccucucuccccuuccagaauauucauccuaucacuaucggaaaaugcccaaaguauguaaaguccacaaaacugaggcuugcuaccggccugcggaacgugcccagcauucagucgcgcggcuuguuuggggccauagcgggauucaucgaagguggcuggacggggauggucgacggaugguacggcuaucaccaucagaaugagcaagguucuggguacgccgcagaucucaaguccacccagaacgcuauugacaaaaucacaaauaaggugaacucaguuauagagaaaaugaauacucaguuuaccgccgugggcaaggaguucaaccaccuggagaagcgaauugaaaauuuaaacaaaaaggucgaugacggauuccuggauaucuggacauacaaugcugagcuccuugugcuguuggaaaacgagagaacucuagacuaucacgauaguaauguuaaaaaccuguacgagaagguaaggaaccagcucaaaaauaacgccaaggaaaucggcaauggguguuuugaguucuaucauaagugcgacaacaccuguauggaaagcgugaaaaauggaacauacgauuauccuaaguacuccgaggaagcaaaacugaaccgggaggagauugacggugucaaacuugaaucuacccguaucuaucaaauucuggccauauacagcacuguggcuucaaguuugguccucgugguuucccugggcgcgaucagcuuuuggaugugcucuaaugggucauuacagugccgcauuuguaucuga

SEQ ID NO: 132009 - RNA, 1701 nt, Artificial Sequence
  derived and/or modified sequence opt3 from hemagglutinin__InfluenzaA__AGL09731
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgccgaagcaauuccucauuuuucagucgucugaacuggcugacgcaucucaauuuuaaguauccagcauuaaacgugacuaugcccaacaaugagcaguucgacaagcuguacauuuggggaguccaccauccuggcaccgauaaagaccagaucuuucuuuaugcccagagcucuggcagaauaacaguguccacuaagaggucacaacaggcuguaauuccaaacaucgggagccggccccgcauuagaaauaucccuaguaggaucucuauuuacuggaccauaguuaaaccaggagauaucuugcugauuaacuccacagguaaucuaaucgccccgcggggcuacuucaagauacgcagcgggaaaucgucuauuaugcgauccgacgcgcccaucggaaaguguaagucagaaugcaucaccccuaacggcaguauuccaaaugacaaacccuuucagaacgugaauagaaucacguauggugcauguccuagguacgucaagcagagcacucucaaacuggccacagggaugcggaacgugccagagaagcaaacccguggaauuuucggcgcuauagccggcuuuaucgaaaaugggugggagggaaugguggaugguugguauggcuuccgccaccagaacuccgaggggagaggacaggcagcugaccuuaaaucuacucaagccgcgauugaucagaucaauggcaagcugaacagguugaucgguaaaacaaaugaaaaguuccaccagauugagaaggaauuuagcgaggucgaagggcggauacaggaccucgagaaauacguugaggauaccaagaucgaccuguggucauauaacgccgaauuacugguggcacucgagaaccaacauacgauugaucuuaccgacagugaaaugaauaaacuguucgagaagacuaaaaagcaguugcgagaaaacgcugaggauaugggcaauggaugcuuuaagaucuaccacaaaugugacaacgccugcauuggcuccauccgcaaugggacauaugaucaugacguauacagagacgaggcucuaaacaauagguuccagauaaagggaguggaacugaaaagcgguuacaaggauuggauccucuggauuucuuuugccaucucaugcuuccugcuuugugucgcacuguugggcuuuauuaugugggccugccagaaagggaacauccgguguaauauaugcauuuga

SEQ ID NO: 132010 - RNA, 1701 nt, Artificial Sequence
  derived and/or modified sequence opt3 from hemagglutinin__InfluenzaA__AGL09732
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugucgccuugcucggguuuaucaugugggcuugccagaaaggaaacauuagguguaauaucugcauauga

SEQ ID NO: 132011 - RNA, 1701 nt, Artificial Sequence
  derived and/or modified sequence opt3 from hemagglutinin__InfluenzaA__AGL09734
augaagaccaucauugcccugagcuacauacucugccuuguguucgcucagaaauuucccggcaacgacaauuccacagcaacucuguguuuggggcaccaugccgucccuaacggaacgaucguuaagaccauuacaaaugauagaaucgaggugacuaacgcgaccgaauuaguacaaaauucuucaauuggugagaucugcgacaguccacaccagauacuggauggcgaaaacuguacacuaaucgacgcucuccugggggauccgcagugcgacggauuccagaauaaaaagugggaucuuuuuauugagaggagcaaagccuauuccaacuguuaccccuaugacgugccugauuacgcaucucugcggucguuggucgccucaagcggcacccucgaguucaauaacgaaaguuuuaauuggacuggugugacacaaaacgggaccuccucugcuugcauccgccgaagcaauuccucauucuuuagucgucugaacuggcugacgcaucucaauuucaaguauccagcauuaaacguuacuaugcccaacaaugagcaguuugacaagcuguacauuuggggagugcaccauccuggcaccgauaaagaccagaucuuccuuuaugcccagagcucuggcagaauaacagucuccacuaagaggucacaacaggcugugauuccaaacaucgggagccggccccgcauuagaaauaucccuaguaggaucucuauuuacuggaccauaguaaaaccaggagauaucuugcugauuaacuccacagguaaucuaaucgccccgcggggcuacuuuaagauacgcagcgggaaaucgucuauuaugcgauccgacgcgcccaucggaaaguguaagucagaaugcaucaccccuaacggcaguauuccaaaugacaaacccuuccagaacguuaauagaaucacguauggugcauguccuagguacgugaagcagagcacucucaaacuggccacagggaugcggaacgucccagagaagcaaacccguggaauuuuuggcgcuauagccggcuucaucgaaaaugggugggagggaaugguggaugguugguauggcuuccgccaccagaacuccgaggggagaggacaggcagcugaccuuaaaucuacucaagccgcgauugaucagaucaauggcaagcugaacagguugaucgguaaaacaaaugaaaaguuucaccagauugagaaggaguucagcgaaguggaagggcggauacaggaccucgagaaauacgucgaggauaccaagaucgaccuguggucauauaacgccgaauuacugguugcacucgagaaccaacauacgauugaucuuaccgacagugaaaugaauaaacuguuugagaagacuaaaaagcaguugcgagaaaacgcugaggauaugggcaauggaugcuucaagaucuaccacaaaugugacaacgccugcauuggcuccauccgcaaugggacauaugaucaugacguguacagagacgaggcucuaaacaauagguuucagauaaagggaguagaacugaaaagcgguuacaaggauuggauccucuggauuucuuucgccaucucaugcuuucugcuuuguguggcacuguugggcuucauuaugugggccugccagaaagggaacauccgguguaauauaugcauuuga

SEQ ID NO: 132012 - RNA, 1701 nt, Artificial Sequence
  derived and/or modified sequence opt3 from hemagglutinin__InfluenzaA__AGL09735
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguauaccgcgacgaggcccugaacaauagauuccagaucaaggguguggaacucaaaagcggcuacaaggauuggauacuguggaucucuuuugcaauuucaugcuuccuucugugugucgccuugcucggguuuaucaugugggcuugccagaaaggaaacauuagguguaauaucaguauauga

SEQ ID NO: 132013 - RNA, 1701 nt, Artificial Sequence
  derived and/or modified sequence opt3 from hemagglutinin__InfluenzaA__AGL09736
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucaaagcucugggcgaaucaccguguccacaaagcguucacagcaggccguaauaccaaacauuggaagcagacccaggauccggaauauuccuagucgcaucucuaucuacuggacuauuguuaaaccaggugauauacugcuaaucaacuccaccggcaaucucauugcgccgagaggguacuucaagaucaggagcggaaaaucgucuauaaugcgguccgacgcacccauuggcaaguguaagucagaaugcaucacaccuaacgguaguaucccaaaugacaaacccuuucagaacgugaaucgcauuaccuauggggccuguccucgauacgucaagcaaagcacgcugaaacuugcuacuggaaugagaaacgugccagagaagcagacaaggggcaucuucggcgccauugcaggguuuauagaaaauggaugggaggguaugguggauggcugguauggguuccggcaccagaacuccgagggacguggccaagcugccgaccugaaaucuacccaggcggccaucgaucagauuaaugguaaguugaaccgccucaucgggaaaacuaaugaaaaguuccaccagaucgagaaggaauuuagcgaggucgaaggcaggauucaagaccuggagaaauacguugaggauacaaagauagacuuauggucauauaacgcagaacugcucguggcucuugagaaccagcauaccaucgaucugacggacagugaaaugaauaaauuguucgagaagaccaaaaagcagcuaagagaaaacgccgaggauaugggaaauggcugcuuuaagauuuaccacaaaugugacaacgcuugcaucggguccauucggaauggaacauaugaucaugacguauaccgagacgaggcccugaacaaucgcuuccagaucaaggguguggaacucaaaagcggcuacaaggauuggauacuguggaucucuuuugcaauuucaugcuuccuucugugugucgccuugcucggguuuaucaugugggcuugccaaaaaggaaacauuagauguaauaucugcauauga

SEQ ID NO: 132014 - RNA, 1701 nt, Artificial Sequence; identical to SEQ ID NO: 131899
  derived and/or modified sequence opt3 from hemagglutinin__InfluenzaA__AGL09737

SEQ ID NO: 132015 - RNA, 1701 nt, Artificial Sequence
  derived and/or modified sequence opt3 from hemagglutinin__InfluenzaA__AGL09739
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccucuuguuaccccuaugacgucccugauuacgcaucguugcggucacucguggccagcaguggcacccuggaauuuaacaaugaguccuucaacuggacugguguuacacaaaaugggaccucuagcgcuugcauucgccgauccaacucaaguuucuuuagccgucugaauuggcucacgcauuuaaacuuuaaguauccagcacugaaugugacuaugcccaacaacgagcaguucgacaaacuuuacaucuggggaguccaccauccuggcaccgauaaagaccagaucuuuuuguaugcccagucuuccggcagaauuacagugucaacuaagaggagccaacaggcuguaauaccaaauauugggagucggccccgcaucagaaacauuccuucuaggaucuccaucuacuggaccauuguuaaaccaggagauauacugcuaaucaauagcacagguaaccucauugccccgcggggcuacuucaagauccgcucggggaaaucuuccauaaugcgaucagacgcgcccauuggaaaguguaagagugaaugcaucaccccuaauggcagcaucccaaacgacaaacccuuucagaaugugaacagaauuacguauggugcauguccuagguacgucaagcaguccacucugaaacuugccacagggaugcggaaugugccagagaagcaaacccguggaaucuucggcgcuauugccggcuuuauagaaaacgggugggagggaaugguggaugguugguauggcuuccgccaccaaaauucugaggggagaggacaggcagcugaccugaaaagcacucaggccgcgaucgaucagauuaacggcaaguugaauaggcucaucgguaaaacaaacgaaaaguuccaccagaucgagaaggaauuuucagaggucgaagggcggauucaggaccuggagaaauacguugaggauaccaagauagacuuauggaguuauaaugccgaacugcucguggcacuugagaaccaacauacgaucgaucugaccgacuccgaaaugaacaaauuguucgagaagacaaagaagcagcuacgagaaaaugcugaggauaugggcaacggaugcuuuaagauuuaccacaaaugugacaaugccugcaucggcagcauucgcaacgggacuuaugaucauaauguauacagagacgaggcucugaacaauagguuccagaucaagggaguggaacucaaaucugguuacaaggacuggauacuguggaucucauuugccauuaguugcuuccuucugugugucgcauugcucggcuuuaucaugugggccugccagaaagggaacauucgguguaauaucugcauauga

SEQ ID NO: 132016 - RNA, 1701 nt, Artificial Sequence; identical to SEQ ID NO: 131851
  derived and/or modified sequence opt3 from hemagglutinin__InfluenzaA__AGL09740

SEQ ID NO: 132017 - RNA, 1701 nt, Artificial Sequence; identical to SEQ ID NO: 131090
  derived and/or modified sequence opt3 from hemagglutinin__InfluenzaA__AGL09741

SEQ ID NO: 132018 - RNA, 1701 nt, Artificial Sequence
  derived and/or modified sequence opt3 from hemagglutinin__InfluenzaA__AGL09742
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacaaugaguccuucaacuggacagguguuacccagaaugggacgucuagcgcuugcauccggcgcuccaacaauucauuuuucagucgacugaacuggcucacucacuuaaauuuuaaauacccagcacugaacgugaccaugcccaacaaugaacaguucgacaagcuguauauuuggggaguccaucacccuggcacagauaaggaccagaucuuuuuguacgcccaagcuagcggccguauuacugugucuaccaaaagaucccagcaggccguaaucccaaacauagggucaaggccccggguucgcaauauuccuagcagagugaguaucuauuggacaauugucaagccaggagauauccugcuaaucaacucuaccgguaaucucauugcgccgaggggcuacuucaaaauacgguccggaaagagcucgaucaugcgcucugacgcacccauugggaaauguaacuccgccugcaucacgccuaauggcucaauaccaaacgacaagcccuuucagaaugugaaccgaauuacuuacggugcuuguccuagauaugugaagcaaaauacacugaaacuugccaccgggaugaggaacgucccagagacucagacacggggaaucuucggcgcaaucgcuggcuuuauugaaaaugggugggagggaaugguugaugguugguacggcuuccgucaccagaacagugaggggcgcggacaagccgcggaccuuaagagcacccaggccgcaaucgaucagauuaauggcaaauugaacagacucauagguaagacgaacgaaaaauuccaucagaucgagaaggaauuuuccgagguggaagggaggauucaagaccuggagaaauauguagaggauaccaagaucgacuuauggucuuacaaugcugaacugcucguggcccuugagaaccagcacacaaucgaucugacugacagcgaaaugaauaaguuguucgagaaaaccaagaaacagcuacgggaaaacgcugaggauaugggcaauggaugcuuuaagauuuaucauaaaugugacaacgccugcauaggcucaauccgaaaugggacauacgaucacgacgucuaucgcgacgaggcacugaacaauagauuccagauuaagggaguggaacucaggagugguuacaaggauuggauccuguggauuuccuuugccaucagcugcuuccuucuguguguugcuuugcucggcuuuauaaugugggcgugccaaaaagggaacauccgguguucuauuugcaucuga

SEQ ID NO: 132019 - RNA, 1701 nt, Artificial Sequence; identical to SEQ ID NO: 131874
  derived and/or modified sequence opt3 from hemagglutinin__InfluenzaA__AGL09744

SEQ ID NO: 132020 - RNA, 1701 nt, Artificial Sequence
  derived and/or modified sequence opt3 from hemagglutinin__InfluenzaA__AGL09745
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauguaggcaauggaugcuuuaagauuuaccacaaaugugacaacacuugcaucggcuccauucgcaaugggaccuaugaucauaacguguacagagacgaggcccugaauaacagguuccagaucaagggagucgaacucaaaagcgguuacaaggacuggauacuguggaucucuuuugcuauuucaugcuuccuucuguguguggccuugcucggcuuuaucaugugggcaugccagaaagggaauauucgguguaacaucugcauauga

SEQ ID NO: 132021 - RNA, 1701 nt, Artificial Sequence; identical to SEQ ID NO: 132013
  derived and/or modified sequence opt3 from hemagglutinin__InfluenzaA__AGL09746

SEQ ID NO: 132022 - RNA, 1701 nt, Artificial Sequence; identical to SEQ ID NO: 131851
  derived and/or modified sequence opt3 from hemagglutinin__InfluenzaA__AGL09747

SEQ ID NO: 132023 - RNA, 1701 nt, Artificial Sequence; identical to SEQ ID NO: 131874
  derived and/or modified sequence opt3 from hemagglutinin__InfluenzaA__AGL09748

SEQ ID NO: 132024 - RNA, 1701 nt, Artificial Sequence; identical to SEQ ID NO: 131872
  derived and/or modified sequence opt3 from hemagglutinin__InfluenzaA__AGL09749

SEQ ID NO: 132025 - RNA, 1701 nt, Artificial Sequence; identical to SEQ ID NO: 132010
  derived and/or modified sequence opt3 from hemagglutinin__InfluenzaA__AGL09750

SEQ ID NO: 132026 - RNA, 1701 nt, Artificial Sequence; identical to SEQ ID NO: 131851
  derived and/or modified sequence opt3 from hemagglutinin__InfluenzaA__AGL09751

SEQ ID NO: 132027 - RNA, 1701 nt, Artificial Sequence; identical to SEQ ID NO: 132010
  derived and/or modified sequence opt3 from hemagglutinin__InfluenzaA__AGL09753

SEQ ID NO: 132028 - RNA, 1701 nt, Artificial Sequence
  derived and/or modified sequence opt3 from hemagglutinin__InfluenzaA__AGL09754
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaaggacuggauacuguggaucucuuuugccauuucaugccuucuguugugugucgcacuccugggcuucaucaugugggccugccagaaagggaauauucgguguaacaucugcauauga

SEQ ID NO: 132029 - RNA, 1701 nt, Artificial Sequence; identical to SEQ ID NO: 132013
  derived and/or modified sequence opt3 from hemagglutinin__InfluenzaA__AGL09756

SEQ ID NO: 132030 - RNA, 1701 nt, Artificial Sequence
  derived and/or modified sequence opt3 from hemagglutinin__InfluenzaA__AGL09758
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaaauauguaagcuaagaggaguggcuccccuccaucuggguaaaugcaacaucgccggcuggauucuugggaauccugagugugaaucucugucaacagcaaguagcugguccuacaucguugagaccucuucgucagacaacggaacuugcuauccaggcgauuuuauugacuacgaagaguugagggagcagcucagcaguguguccucuuucgaacgguuugagaucuucccgaagacaagcuccuggcccaaucacgauucaaacaagggugucaccgccgcuuguccucaugcaggggccaaaggauuuuauaagaaucugauauggcuggugaaaaagggcaacaguuacccaaaacucagcaauucuuauaucaacgacaagggcaaggaaguauuaguucugugggggauucaccaccccuccacgacugcugaucaacagucacuuuaccagaaugccgacaccuacguguucgucggaacaagccgcuauaguaaaaaguuuaaaccugagaucgcgauucgaccaaaggugcgugaucaggaggguagaaugaacuacuauuggacuuugguggaacccggcgacaaaaucaccuucgaggcaacagggaaccuggucguuccuagguacgccuuugcuauggaacggaaugccggaucuggcauaauuaucuccgauaccacggugcaugacugcaacacuacaugucaaaccccaaagggugcaauuaauacuagccuaccguuccagaacauccaccccaucacaauugggaaaugcccuaaguauguaaagucgaccaaacuccgccuggcuacgggacuuagaaaugugccaucuauacaguccaggggccuguuuggcgccaucgcgggguucauugagggagguuggaccggcauggucgacgggugguacggauaucaucaccagaacgaacaaggcucagguuacgccgcagauuugaagaguacacagaaugcuaucgacaaaauaacuaacaaggugaauagcguuauugagaaaaugaacacccaguuuacagccguggggaaggaguucaaucaccucgaaaagcggaucgagaaccugaauaaaaaggucgaugacggcuucuuagauaucuggacuuacaacgcugaacugcucgugcuucuggagaaugaacgcaccuuggacuaucaugauuccaacguuaaaaaccuauacgagaagguacgaaaucagcugaaaaacaaugccaaggagauuggaaacggcuguuuugaguucuaucacaagugcgacaauauguguauggaaucugugaaaaacgggacauacgauuaucccaaguacagcgaagaggcaaaacucaauagagaaaagaucgacggagucaaacuggagucaaccaggauuuaucaaauacuugccaucuacaguacuguggcuuccagccuggucuuggugguuucucucggugcgauuucauuuuggaugugcaguaacggcagccugcagugccggaucuguaucuga

SEQ ID NO: 132031 - RNA, 1701 nt, Artificial Sequence
  derived and/or modified sequence opt3 from hemagglutinin__InfluenzaA__AGL09760
augaagaccaucauugccgugagcuacauacugugccucgucuucgcucaggagcuucccggcaacgacgauuccacagcaacucuguguuuggggcaccaugccguuccuaauggaacgaucgugaaaaccauuacaaacgaccaaaucgaaguaacuaaugcgaccgaguuagugcagucuucaaguacaggugaaauuugcaacagcccacaccagauccuggauggcgagaauuguacccuaauagacgcucuccugggggauccgcagugcgacggauuucaaaacaagaaaugggaucuuuucgucgaaagauccaaggcccauucuaauuguuaucccuacgacgugccugauuaugcaucgcugaggucauugguugccagcaguggcacucucgaguuuaacaaugaguccuucaacuggacaggugugacccagaaugggacgucuagcgcuugcauccggcgcuccaacaauucauuuuucagucgacugaacuggcugacucaccucaauuuuaaauacccagcauuaaacgucaccaugcccaacaaugaacaguucgacaagcuguauauuuggggagugcaucacccuggcacagauaaggaccagaucuuucuuuacgcccaagcuagcggccguauuacuguaucuaccaaaagaucccagcaggccguuaucccaaacauagggucaaggccccgggugcgcaauauuccuagcagagucaguaucuauuggacaauugugaagccaggagauaucuugcugaucaacucuaccgguaaucuaauugcgccgaggggcuacuucaaaauacgguccggaaagagcucgaucaugcgcucugacgcacccauugggaaauguaacuccgccugcaucacgccuaauggcucaauaccaaacgacaagcccuuucagaaugugaaccgaauuacuuacggugcuuguccuagauaugucaagcaaaauacacucaaacuggccaccgggaugaggaacguuccagagaagcagacucggggaaucuucggcgcaaucgcuggcuuuauugaaaaugggugggagggaaugguggaugguugguacggcuuccgucaccagaacagugaggggcgcggacaagccgcggaccuuaaaagcacacaggccgcaaucgaucagauuaauggcaagcugaacagauugauagguaaaaccaacgaaaaguuccaucagaucgagaaagaauuuuccgagguagaagggaggauucaagaccucgagaaguauguggaggauacgaagaucgaccuguggucuuacaaugcugaauuacuggucgcccucgagaaccagcacaccaucgaucuuacagacagcgaaaugaauaaacuguucgagaagacuaaaaagcaguugcgggaaaacgcugaggauaugggcaauggaugcuuuaaaauuuaucauaagugugacaacgccugcauaggcucaauccgaaaugggaccuacgaucacgacguguaucgcgacgaggcacuaaacaauagauuccagauuaagggaguugaacugaaaagugguuacaaggauuggauccucuggauuuccuuugccaucagcugcuuccugcuuuguguggcucuguugggcuuuauaaugugggcgugccaaaaagggaacaucagguguaauauuugcaucuga

SEQ ID NO: 132032 - RNA, 1701 nt, Artificial Sequence; identical to SEQ ID NO: 131884
  derived and/or modified sequence opt3 from hemagglutinin__InfluenzaA__AGL09761

SEQ ID NO: 132033 - RNA, 1701 nt, Artificial Sequence
  derived and/or modified sequence opt3 from hemagglutinin__InfluenzaA__AGL09762
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggggaagcaauuccucauuuuucagucgccugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccaaagcucugggcgaauuacaguguccacuaagcguucacagcaggcuguaauaccaaacauuggaagcagacccaggauccggaauauuccuagucgcaucucuaucuacuggaccauuguuaaaccaggugauauacugcuaaucaacuccacaggcaaucucauugccccgagaggguacuucaagaucaggagcggaaaaucgucuauaaugcgguccgacgcgcccauuggcaaguguaagucagaaugcaucaccccuaacgguaguaucccaaaugacaaacccuuucagaacgugaaucgcauuacguauggggcauguccucgauacgucaagcaaagcacucugaaacuugccacaggaaugagaaacgugccagagaagcagaccaggggcaucuucggcgcuauugccggguuuauagaaaauggaugggaggguaugguggauggcugguauggguuccggcaccagaacuccgagggacguggccaagcagcugaccugaaaucuacucaggccgcgaucgaucagauuaaugguaaguugaaccgccucaucgggaaaacaaaugaaaaguuccaccagaucgagaaggaauuuagcgaggucgaaggcaggauucaagaccuggagaaauacguugaggauaccaagauagacuuauggucauauaacgccgaacugcucguggcacuugagaaccagcauacgaucgaucugaccgacagugaaaugaauaaauuguucgagaagacaaagaagcagcuaagagaaaacgcugaggauaugggaaauggcugcuuuaagauuuaccacaaaugugacaacgccugcaucggguccauucggaauggaacuuaugaucaugacguauaccgagacgaggcucugaacaaucgcuuccagaucaaggguguggaacucaaaagcggcuacaaggauuggauacuguggaucucuuuugccauuucaugcuuccuucugugugucgcauugcucggguuuaucaugugggccugccaaaaaggaaacauuagauguaauaucugcauauga

SEQ ID NO: 132034 - RNA, 1701 nt, Artificial Sequence; identical to SEQ ID NO: 132010
  derived and/or modified sequence opt3 from hemagglutinin__InfluenzaA__AGL09763

SEQ ID NO: 132035 - RNA, 1701 nt, Artificial Sequence
  derived and/or modified sequence opt3 from hemagglutinin__InfluenzaA__AGL09764
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugaucaaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagagaagcaaagccuauuccaacuguuaccccuaugacgucccugauuacgcaucucugaggucguugguggccucaagcggcacccucgaauuuaauaacgagaguuucaauuggacugguguuacacagaacgggaccuccucugcuugcauccggcgcagcaauuccucauuuuucagucgacugaacuggcugacgcaucucaauuuuaaguauccagcauuaaacgugacuaugcccaacaaugagcaguucgacaagcuguacauuuggggaguccaccauccuggcaccgauaaagaccagaucuuucuuuaugcccaaagcucuggccguauaacaguguccacuaagagaucacagcaggcuguaauuccaaacaucgggagcaggccccggauucgcaauaucccuaguagaaucucuauuuacuggaccauaguuaaaccaggagauaucuugcugauuaacuccacagguaaucuaaucgccccgaggggcuacuucaagauacggagcgggaaaucgucuauuaugcgcuccgacgcgcccaucggaaaguguaagucagaaugcaucaccccuaacggcaguauuccaaaugacaaacccuuucagaacgugaaucgaaucacguauggugcauguccuagauacgucaagcaaagcacucucaaacuggccacagggaugaggaacgugccagagaagcagacccggggaauuuucggcgcuauagccggcuuuaucgaaaaugggugggagggaaugguggaugguugguauggcuuccgucaccagaacuccgaggggcgcggacaagcagcugaccuuaaaucuacucaggccgcgauugaucagaucaauggcaagcugaacagauugaucgguaaaacaaaugaaaaguuccaccagauugagaaggaauuuagcgaggucgaagggaggauacaagaccucgagaaauacguugaggauaccaagaucgaccuguggucauauaacgccgaauuacugguggcacucgagaaccagcauacgauugaucuuaccgacagugaaaugaauaaacuguucgagaagacuaaaaagcaguugcgggaaaacgcugaggauaugggcaauggaugcuuuaagaucuaccacaaaugugacaacgccugcauuggcuccauccgaaaugggacauaugaucaugacguauaccgcgacgaggcucuaaacaauagauuccagauaaagggaguggaacugaaaagcgguuacaaggauuggauccucuggauuucuuuugccaucucaugcuuccugcuuugugucgcacuguugggcuuuauuaugugggccugccaaaaagggaacaucagguguaauauaugcauuuga

SEQ ID NO: 132036 - RNA, 1701 nt, Artificial Sequence; identical to SEQ ID NO: 131874
  derived and/or modified sequence opt3 from hemagglutinin__InfluenzaA__AGL09765

SEQ ID NO: 132037 - RNA, 1701 nt, Artificial Sequence
  derived and/or modified sequence opt3 from hemagglutinin__InfluenzaA__AGL09766
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucaaagcucugggcgaaucaccguguccacaaagcguucacagcaggccguaauaccaaacauuggaagcagacccaggauccggaauauuccuagucgcaucucuaucuacuggacuauuguuaaaccaggugauauacugcuaaucaacuccaccggcaaucucauugcgccgagaggguacuucaagauccugagcggaaaaucgucuauaaugagguccgacgcacccauuggcaaguguaagucagaaugcaucacaccuaacgguaguaucccaaaugacaaacccuuucagaacgugaaucggauuaccuauggggccuguccucgcuacgucaagcaaagcacgcuuaaacuggcuacuggaaugcgaaacgugccagagaagcagacaagaggcaucuucggcgccauugcaggguuuauagaaaauggaugggaggguaugguggauggcugguauggguucaggcaccagaacuccgagggacggggccaagcugccgacuugaaaucuacccaggcggccaucgaucagauuaaugguaagcucaaccgucugaucgggaaaacuaaugaaaaguuccaccagaucgagaaggaauuuagcgaggucgaaggccgcauucaagacuuagagaaauacguugaggauacaaagauagaccuguggucauauaacgcagaacuccuuguggcucuggagaaccagcauaccaucgauuugacggacagugaaaugaauaaacuauucgagaagaccaaaaagcagcugagagaaaacgccgaggauaugggaaauggcugcuuuaagauuuaccacaaaugugacaacgcuugcaucggguccauuaggaauggaacauaugaucaugacguauaccgggacgaggcccucaacaaucgauuccagaucaaggguguggaacugaaaagcggcuacaaggauuggauacuuuggaucucuuuugcaauuucaugcuuccuguugugugucgcccuccugggguuuaucaugugggcuugccaaaaaggaaacauucgcuguaauaucugcauauga

SEQ ID NO: 132038 - RNA, 1701 nt, Artificial Sequence
  derived and/or modified sequence opt3 from hemagglutinin__InfluenzaA__AGL09767
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucauaacguauaccgcgacgaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 132039 - RNA, 1701 nt, Artificial Sequence
  derived and/or modified sequence opt3 from hemagglutinin__InfluenzaA__AGL09769
augaagaccaucauugcccugagcuacauacucugccuuguguucgcucagaaaauccccggcaacgacaauuccacagcaacucuguguuuggggcaccaugccgucccuaacggaacgauuguuaagaccaucacaaaugauagaauugaggugacuaacgcgaccgaauuaguacaaaauucuucaaucggugagauaugcgacaguccacaccagauccuggauggcgaaaacuguacacuaauugacgcucuccugggggauccgcagugcgacggauuucagaauaaaaagugggaucuuuucguggagaggagcaaagccuauuccaacuguuaccccuaugacgucccugauuacgcaucucugcggucguugguggccucaagcggcacccucgaauuuaauaacgagaguuucaauuggacugguguuacacaaaacgggaccuccucugcuugcauccgcggaagcaauuccucauuuuucagucgacugaacuggcugacgcaucucaauuuuaaguauccagcauuaaacgugacuaugcccaacaaugagcaguucgacaagcuguacauuuggggcguccaccauccuggcaccgauaaagaccagaucuuucuuuaugcccagagcucugggcguauaacaguguccacuaagagaucacaacaggcuguaauuccaaacaucggaagcaggccccggauucgcaauaucccuaguagaaucucuauuuacuggaccauaguuaaaccaggugauaucuugcugauuaacuccacaggcaaucuaaucgccccgaggggguacuucaagauacggagcggaaaaucgucuauuaugcgcuccgacgcgcccaucggcaaguguaagucagaaugcaucaccccuaacgguaguauuccaaaugacaaacccuuucagaacgugaaucgaaucacguauggggcauguccuagauacgucaagcagagcacucucaaacuggccacaggaaugaggaacgugccagagaagcaaacccggggcauuuucggcgcuauagccggguuuaucgaaaauggaugggaggguaugguggauggcugguauggguuccgucaccagaacuccgagggacgcggccaggcagcugaccuuaaaucuacucaagccgcgauugaucagaucaaugguaagcugaacagauugaucgggaaaacaaaugaaaaguuccaccagauugagaaggaauuuagcgaggucgaaggcaggauacaggaccucgagaaauacguugaggauaccaagaucgaccuguggucauauaacgccgaauuacugguggcacucgagaaccaacauacgauugaucuuaccgacagugaaaugaauaaacuguucgagaagacuaaaaagcaguugcgggaaaacgcugaggauaugggaaauggcugcuuuaagaucuaccacaaaugugacaacgccugcauuggguccauccgaaauggaacauaugaucaugacguauaccgcgacgaggcucuaaacaauagauuccagauaaaggguguggaacugaaaagcggcuacaaggauuggauccucuggauuucuuuugccaucucaugcuuccugcuuugugucgcacuguugggguuuauuaugugggccugccagaaaggaaacaucagguguaauauaugcauuuga

SEQ ID NO: 132040 - RNA, 1701 nt, Artificial Sequence; identical to SEQ ID NO: 131874
  derived and/or modified sequence opt3 from hemagglutinin__InfluenzaA__AGL09770

SEQ ID NO: 132041 - RNA, 1701 nt, Artificial Sequence
  derived and/or modified sequence opt3 from hemagglutinin__InfluenzaA__AGL09771
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgaggucgaaggcaggauucaggaccuggagaaauacguugaggauacaaagauagacuuauggucauauaacgcagaacugcucguggcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacaucuaccgcgacgaggcccugaacaauagauuccagauaaaggguguagaacucaaaagcggcuacaaggauuggauccuguggauuucuuuugcaaucucaugcuuccuucuguguguggccuugcucggguuuauuaugugggcuugccagaaaggaaacaucagguguaauauaugcauuuga

SEQ ID NO: 132042 - RNA, 1701 nt, Artificial Sequence
  derived and/or modified sequence opt3 from hemagglutinin__InfluenzaA__AGL09772
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucacuuaaacuuuaaguacccagcacugaacgugaccaugcccaauaacgagcaguucgauaaacuuuauauuuggggaguccaucacccuggcacagacaaagaucagaucuuuuuguacgcccaagcugccggccguauuacugugagcaccaagagaucucagcaggcgguaaucccaaauauaggguccaggccccggguucgcaacauuccuucaagagugagcaucuauuggacaauugucaaaccaggagacauccugcuaaucaauaguaccgguaaccucauugcaccgaggggcuacuucaagauacggucugggaaauccagcaucaugcgcucggaugcccccauuggaaaguguaauucugcuugcaucacgccuaacggcuccauaccaaaugacaagcccuuucagaacgugaaucgaauuacuuacggugccuguccuagauaugugaaacaaaacacacugaaacuugcaaccgggaugaggaaugucccagaaaagcagacucggggaaucuucggcgcuaucgccggcuuuauugagaacgggugggaaggaaugguugacgguugguacggcuuccgucaccaaaauucagaggggcgcggacaggcggccgaucugaagaguacacaggcagcuaucgaccagauuaacggcaaauugaacagacucauagguaagaccaaugagaaauuccaucagaucgaaaaggaguuuagcgaaguggaggggaggauucaagaucuggaaaaguauguagaggacacgaaaaucgauuuaugguccuacaacgccgagcugcucguggcucuugaaaaucagcacaccaucgaccugacagauucugagaugaacaaguuguucgaaaagacuaagaaacagcuacgggagaaugccgaagacaugggcaacggaugcuuuaagauuuaucauaagugugauaaugcaugcauaggcagcauccgaaacgggaccuacgaccacuaugucuaccgcgaugaggcccugaauaacagauuccagauuaaaggaguggagcucaagucagguuacaaagacuggauccuguggauuaguuuugcuacauccugcuuccuucuguguguugcguugcucggcuuuaucaugugggcaugccaaaaggggaauauaagguguaacaucugcauuuga

SEQ ID NO: 132043 - RNA, 1701 nt, Artificial Sequence
  derived and/or modified sequence opt3 from hemagglutinin__InfluenzaA__AGL09773
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcaauagcccacaccagauccuagacggcgaaaacuguacccucauagaugcucugcuuggggacccgcagugcgauggauuucaaaauaaaaagugggaccuguucguggagagauccaaagcccauucuaacuguuaucccuacgaugucccugacuaugcaucguugaggucacucguggccagcaguggcacucuggaauuuaauaacgaguccuucaauuggacagagguuacccagaacgguacgucuagcgcuugcauccggcgcuccaauaacucauuuuucagucgacugaauuggcucacucacuuaaacuuuaaguacccagcacugaacgugaccaugcccaauaacgaacaguucgauaaacuuuauauuuggggaguccaucacccugggacagacaaggaucagaucuuuuuguacgcccaagcugccggccguauuacugugagcaccaagagaucucagcaggcgguaaucccaaauauaggcuccaggccccggguucgcaacauuccuucaagagugagcaucuauuggacaauugucaaaccaggggacauccugcuaaucaauaguaccggaaaccucauugcaccgagggguuacuucaagauacggucuggcaaauccagcaucaugcgcucggaugcccccauugggaaguguaauucugcuugcaucacgccuaacggauccauaccaaaugacaagcccuuucagaacgugaaucgaauuacuuacggcgccuguccuagauaugugaaacaaaacacacugaaacuugcaaccgguaugaggaaugucccagagaagcagacucgggggaucuucggagcuaucgccggcuuuauugaaaacggcugggaggggaugguugacggaugguacgguuuccgucaccaaaauucagagggccgcgggcaggcggccgaucugaagaguacacaggcagcuaucgaccagauuaacggaaaauugaacagacucauaggcaagaccaaugaaaaauuccaucagaucgagaaggaauuuagcgagguggaagguaggauucaagaucuggagaaguauguagaggacacgaaaaucgauuuaugguccuacaacgccgaacugcucguggcucuugagaaucagcacaccaucgaccugacagauucugaaaugaacaaguuguucgagaaaacuaagaaacagcuacgggaaaaugccgaggacauggggaacggcugcuuuaagauuuaucauaagugugauaaugcaugcauaggaagcauccgaaacggcaccuacgaccacuaugucuaccgcgaugaggcccugaauaacagauuccagauuaaagggguggaacucaagucaggauacaaagacuggauccuguggauuaguuuugcuacauccugcuuccuucuguguguugcguugcucgguuuuaucaugugggcaugccaaaagggcaauauaagguguaacaucugcauuuga

SEQ ID NO: 132044 - RNA, 1701 nt, Artificial Sequence; identical to SEQ ID NO: 132042
  derived and/or modified sequence opt3 from hemagglutinin__InfluenzaA__AGL09774

SEQ ID NO: 132045 - RNA, 1701 nt, Artificial Sequence; identical to SEQ ID NO: 131884
  derived and/or modified sequence opt3 from hemagglutinin__InfluenzaA__AGL09775

SEQ ID NO: 132046 - RNA, 1701 nt, Artificial Sequence; identical to SEQ ID NO: 132042
  derived and/or modified sequence opt3 from hemagglutinin__InfluenzaA__AGL09776

SEQ ID NO: 132047 - RNA, 1701 nt, Artificial Sequence; identical to SEQ ID NO: 132042
  derived and/or modified sequence opt3 from hemagglutinin__InfluenzaA__AGL09777

SEQ ID NO: 132048 - RNA, 1701 nt, Artificial Sequence
  derived and/or modified sequence opt3 from hemagglutinin__InfluenzaA__AGL09778
augaagaccaucauugcccugagcuacauacucugccuuaucuucgcucagaaacugcccggcaacgacaauuccacagcaacuuuguguuuagggcaccaugccgugccuaacggaacgauugucaagaccaucacaaaugauagaauugagguuacuaacgcgaccgaacuggugcaaaauucuucaaucggugagauaugcgacaguccacaccagauccuagauggcgaaaacuguacacucauugacgcucugcuuggggauccgcagugcgacggauuucagaauaaaaagugggaucuguucguagagaggagcaaagccuauuccaacuguuaccccuaugacgugccugauuacgcaucuuugcggucgcucgucgccucaagcggcacccuggaauuuaauaacgagaguuucaauugggcuggugugacucaaaacgggacauccucugcaugcauccgcggaagcaauuccucauuuuucagucgacugaacuggcucacccauuuaaauuuuaaguauccagcccugaacguuacgaugcccaacaaugagcaguucgacaaacuuuacauuuggggcgugcaccauccuggcacugauaaggaccagaucuuuuuguaugcucagagcucugggcguauaaccgucuccacaaagagaucacaacaggccgugauuccaaacaucggaagcaggccccggauucgcaauaucccuaguagaaucucuauuuacuggacuauaguaaaaccaggugauauccugcuaauuaacuccaccggcaaucucaucgcgccgaggggguacuucaagauacggagcggaaaaucgucuauuaugcgcuccgacgcacccaucggcaaguguaagucagaaugcaucacaccuaacgguaguauuccaaaugacaaacccuuucagaacguuaaucgaaucaccuauggggccuguccuagauacgugaagcagagcacgcugaaacuugcuacuggaaugaggaacgucccagagaagcaaacacggggcauuuucggcgccauagcaggguuuaucgaaaauggaugggaggguaugauggauggcugguauggguuccgucaccagaacuccgagggacgcggccaggcugccgaccugaaaucuacccaagcggccauugaucagaucaaugguaaguugaacagacucaucgggaaaacuaaugaaaaguuccaccagauugagaaggaauuuagcgagguggaaggcaggauacaggaccuggagaaauacguggaggauacaaagaucgacuuauggucauauaacgcagaacugcucgucgcucuugagaaccaacauaccauugaucugacggacagugaaaugaauaaauuguucgagaagaccaaaaagcagcuacgggaaaacgccgaggauaugggaaauggcugcuuuaagaucuaccacaaaugugacaacgcuugcauuggguccauccgaaauggaacauaugaucaugacguuuaccgcgacgaggcccugaacaauagauuccagauaaaggguguggaacucaaaagcggcuacaaggauuggauccuguggauuucuuuugcaaucucaugcuuccuucuguguguagccuugcucggguuuauuaugugggcuugccagaaaggaaacaucagguguaauauaugcauuuga

SEQ ID NO: 132049 - RNA, 1701 nt, Artificial Sequence
  derived and/or modified sequence opt3 from hemagglutinin__InfluenzaA__AGL09779
augaagaccaucauugcccugagcuacauacucugccuuguguucgcucagaaacugcccggcaacaauaacuccacagcaacuuuguguuuagggcaccaugccgucccuaauggaacgaucguuaagaccauuacaaacgacagaaucgaggugacuaaugcgaccgaacugguacaaaacucuucaauuggugagaucugcgauaguccacaccagauacuagacggcgaaaauuguacacucaucgaugcucugcuuggggacccgcagugcgauggauuucagaacaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaacgugacgaugcccaauaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgaugcacccauuggcaaguguaagucagaaugcaucacaccuaaugguaguaucccaaacgacaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaacgcagaacugcucguggcucuugagaaucaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugauguauaccgcgacgaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 132050 - RNA, 1701 nt, Artificial Sequence
  derived and/or modified sequence opt3 from hemagglutinin__InfluenzaA__AGL09780
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuugacaaugagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgauaaacuuuacaucuggggcguccaccauccuggcacugacaaggaucagauuagcuuguaugcucagucuuccgggcguaucaccgugucaacaaagagaagccaacaggccguaauaccaaauauuggaaguaggccccggauccgcaacauuccuucuagaaucuccaucuacuggacuauuguuaaaccaggugacauacugcuaaucaauagcaccggcaaccucauugcgccgaggggguacuuuaagauccggucgggaaaaucuuccauaaugcgcucagacgcacccauuggcaaguguaagagugaaugcaucacaccuaaugguagcaucccaaacgauaaacccuuccagaaugugaaccgaauuaccuauggggccuguccuagauacgucaagcaguccacgcugaaacuugcuacuggaaugaggaaugugccagagaagcaaacacggggcaucuuuggcgccauugcaggguucauagaaaacggaugggaggguaugguggacggcugguauggguuucgucaccaaaauucugagggacgcggccaggcugccgaucugaaaagcacccaggcggccaucgaccagauuaacgguaaguugaauagacucaucgggaaaacuaacgaaaaguuccaccagaucgagaaggaguucucagaagucgaaggcaggauucaggaucuggagaaauacguugaggacacaaagauagauuuauggaguuauaaugcagaacugcucguggcucuugagaaccaacauaccaucgaccugacggauuccgaaaugaacaaauuguuugagaagaccaaaaagcagcuacgggaaaaugccgaggacaugggaaacggcugcuucaagauuuaccacaaaugugauaaugcuugcaucgggagcauucgaaacggaacauaugaccaugacguauaccgcgaugaggcccugaauaacagauuucagaucaaggguguggaacucaaaucuggcuacaaggacuggauacuguggaucucauucgcaauuaguugcuuucuucugugugucgccuugcucggguucaucaugugggcuugccagaaaggaaauauuagguguaacaucugcauauga

SEQ ID NO: 132051 - RNA, 1701 nt, Artificial Sequence; identical to SEQ ID NO: 132009
  derived and/or modified sequence opt3 from hemagglutinin__InfluenzaA__AGL09781

SEQ ID NO: 132052 - RNA, 1701 nt, Artificial Sequence; identical to SEQ ID NO: 131874
  derived and/or modified sequence opt3 from hemagglutinin__InfluenzaA__AGL09782

SEQ ID NO: 132053 - RNA, 1701 nt, Artificial Sequence
  derived and/or modified sequence opt3 from hemagglutinin__InfluenzaA__AGL09783
augaagaccaucauugcccugagcuacauacucugccuuguguucgcucagaaacugcccggcaacgacaauuccacagcaacuuuguguuuagggcaccaugccgucccuaacggaacgguugugaagaccaucacaaaugauagaauugagguaacuaacgcgaccgaacuggugcaaaauucuucaaucggugagauuugcgacaguccacaccagauccuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauuggacuggugugacacaaaacgggaccuccucugcuugcauccgccgaagcaauaacuccuuuuucucacgucugaauuggcucacgcauuuaaacuuuaaguauccagcacugaacgucacuaugcccaauaacgagcaguucgacaaacuuuacauuuggggagugcaccauccuggcaccgauaaggaccagaucuuuuuguaugcccagaguagcggcagaauuacaguaucuacuaagaggucccaacaggcuguuaucccaaauauagggucacggccccgcauuagaaacaucccuagcaggauuaguaucuacuggaccaucgugaaaccaggagauauucugcuaauaaauucuacagguaaccucaucgccccgcggggcuacuucaagauucgcuccgggaaaagcucgaucaugcgaucugacgcgcccauaggaaaguguaaguccgaaugcauuaccccuaauggcucaaucccaaacgacaaacccuuucagaaugucaacagaaucacguauggugcauguccuagguacgugaagcagaguacucugaaacuugccacagggaugcggaaugugccagagaagcaaacccguggaauuuucggcgcuaucgccggcuuuauugaaaacgggugggagggaauggucgaugguugguauggcuuccgccaccagaauagcgaggggagaggacaggcagcugaccugaaauccacucaagccgcgauagaucagaucaacggcaaguugaauaggcucauugguaaaacaaacgaaaaguuccaccagaucgagaaggaauuuucugagguugaagggcggacccagaaccuggagaaauacguggaggacacgaagaucgauuuauggagcuauaaugccgaacugcucguagcacuugagaaccaacauaccauugaccugacagauucagaaaugaauaaauuguucgagaagacuaaaaagcagcuacgagaaaacgcugaggacaugggcaauggaugcuuuaagauauaccacaaaugugauaacgccugcaucggcaguauucgcaaugggaccuaugaccaugauguguacagagacgaggcucugaacaauagguuccagaucaagggagucgaacucaaauccgguuacaaggacuggauucuguggaucagcuuugccauaucuugcuuccuucugugugugguuuugcucggcuuuaucaugugggcaugccagaaagggaacauucgguguaauaucugcauuuga

SEQ ID NO: 132054 - RNA, 1701 nt, Artificial Sequence; identical to SEQ ID NO: 131884
  derived and/or modified sequence opt3 from hemagglutinin__InfluenzaA__AGL09785

SEQ ID NO: 132055 - RNA, 1701 nt, Artificial Sequence
  derived and/or modified sequence opt3 from hemagglutinin__InfluenzaA__AGL09786
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuugacaaugagaguuucaacugggcugguguuacucaaaaugggacauccucugcaugcauucgcggaagcaaguccucauuuuucagucgacugaacuggcucacccauuuaaauuuuaaguauccagcccugaacgugacgaugcccaauaacgagcaguucgauaaacuuuacaucuggggcguccaccauccuggcacugacaaggaucagauuagcuuguaugcucagucuuccgggcguaucaccgugucaacaaaaagaagccaacaggccguaauaccaaacauuggaaguaggccccggauccgcaauauuccuucuagaaucuccaucuacuggacuauuguuaagccaggugacauacugcuaaucaacagcaccggcaaucucauugcgccgaggggguacuuuaaaauccggucgggaaagucuuccauaaugcgcucagacgcacccauuggcaaguguaaaagugaaugcaucacaccuaacgguagcaucccaaaugauaagcccuuccagaacgugaaucgaauuaccuauggggccuguccuagauacgucaaacaguccacgcugaagcuggcuacuggaaugaggaacgugccagagaaacaaacacggggcaucuuuggcgccauugcaggguucauagaaaauggaugggaggguaugguggacggcugguauggguuucgucaccagaacucugagggacgcggccaggcugccgaucuuaagagcacccaagcggccaucgaccagauuaaugguaaauugaacagacucaucgggaagacuaaugaaaaguuccaccagaucgagaaagaguucucagaagucgaaggcaggauucaggaucuggagaaguacguugaggacacaaaaauagauuuauggaguuauaacgcagaacugcucguggcucuugagaaucaacauaccaucgaccugacggauuccgaaaugaacaaguuguuugagaaaaccaagaagcagcuacgggaaaacgccgaggacaugggaaauggcugcuucaaaauuuaccacaagugugauaacgcuugcaucgggagcauucgaaauggaacauaugaccaugacguauaccgcgaugaggcccugaacaauagauuucagaucaaagguguggaacucaagucuggcuacaaagacuggauacuguggaucucauucgcaauuaguugcuuucuucugugugucgccuugcucggguucaucaugugggcuugccagaagggaaacauuagguguaauaucugcauauga

SEQ ID NO: 132056 - RNA, 1701 nt, Artificial Sequence
  derived and/or modified sequence opt3 from hemagglutinin__InfluenzaA__AGL09787
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucucaauccuauauaaacgauaagggcaaggaaguacugguucuuuggggcauccaccaccccucaacgacugcugaccagcagagcuuguaccagaaugccgaugcguacguguucgucgggaccagucgcuauucuaaaaaguuuaaaccugagauugcaauccgaccaaaggugcgugaccaagagggaagaaugaacuacuauuggacacugguggaacccggugauaaaauuacuuucgaggccaccggcaaccuagucguuccuagguacgcuuuuacaauggaacggaaugccggguccggaaucauaauuagcgacaccccagugcaugauugcaacacgacuugucagacaccggagggcgcaaucaauaccucgcuccccuuccagaacauucacccuaucacuaucgguaagugcccaaaauauguaaagucuacaaagcugcgccuugcuaccgggcugagaaaugugcccuccauucagucaaggggauuguuuggcgccauagcgggcuucaucgaagggggauggacggguauggucgacggcugguacggguaucaucaccaaaacgagcagggaaguggcuacgccgcagaccucaaaagcacccagaaugcuauugauaagaucacaaacaaaguuaauuccgugauagagaagaugaacacucaguuuaccgccguggguaaagaguucaaucaccuggagaagcggauugaaaacuuaaauaagaaagucgacgauggguuccuggacaucuggacauacaacgcugagcuccuugugcuguuggaaaaugagcgcacucuagauuaucaugacucuaacguaaagaaccuguacgagaaaguucgaaaucaacucaagaacaaugccaaagaaaucggcaacggauguuuugaguucuaucacaagugcgauaauaccuguauggaaagcgugaagaacggcacauacgacuauccuaaauacucagaggaagcaaagcugaauagagagaaaauugauggggucaaacuugagaguaccaggaucuaucagauucuggccauauacuccacuguggcuagcucuuugguccucgugguuucacugggagcgaucaguuuuuggaugugcagcaacgguuccuuacagugccggauuuguaucuga

SEQ ID NO: 132057 - RNA, 1701 nt, Artificial Sequence; identical to SEQ ID NO: 132056
  derived and/or modified sequence opt3 from hemagglutinin__InfluenzaA__AGL09788

SEQ ID NO: 132058 - RNA, 1701 nt, Artificial Sequence; identical to SEQ ID NO: 132056
  derived and/or modified sequence opt3 from hemagglutinin__InfluenzaA__AGL09789

SEQ ID NO: 132059 - RNA, 1701 nt, Artificial Sequence; identical to SEQ ID NO: 132010
  derived and/or modified sequence opt3 from hemagglutinin__InfluenzaA__AGL09790

SEQ ID NO: 132060 - RNA, 1701 nt, Artificial Sequence
  derived and/or modified sequence opt3 from hemagglutinin__InfluenzaA__AGL09791
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacaugacuaugcccaacaaugagcaguucgacaaacuuuacaucuggggagugcaccauccuggcaccgauaaagaccagauuagcuuguaugcccagucuuccggcagaaucacagucucaacuaagaggagccaacaggcugugauaccaaacauugggagucggccccgcaucagaaauauuccuucuaggaucuccaucuacuggaccauuguaaaaccaggagauauacugcuaaucaacagcacagguaaucucauugccccgcggggcuacuuuaagauccgcucggggaaaucuuccauaaugcgaucagacgcgcccauuggaaaguguaagagugaaugcaucaccccuaacggcagcaucccaaaugacaaacccuuccagaacguuaauagaauuacguauggugcauguccuagguacgugaagcaguccacucugaaacuugccacagggaugcggaacgucccagagaagcaaacccguggaaucuuuggcgcuauugccggcuucauagaaaaugggugggagggaaugguggaugguugguauggcuuucgccaccagaacucugaggggagaggacaggcagcugaccugaaaagcacucaagccgcgaucgaucagauuaauggcaaguugaacaggcucaucgguaaaacaaaugaaaaguuccaccagaucgagaaggaguucucagaaguggaagggcggauucaggaccuggagaaauacgucgaggauaccaagauagacuuauggaguuauaacgccgaacugcucguugcacuugagaaccaacauacgaucgaucugaccgacuccgaaaugaauaaauuguuugagaagacaaagaagcagcuacgagaaaacgcugaggauaugggcaauggaugcuucaagauuuaccacaaaugugacaacgccugcaucggcagcauucgcaaugggacuuaugaucauaacguguacagagacgaggcucugaauaacagguuucagaucaagggaguagaacucaaaucugguuacaaggacuggauacuguggaucucauucgccauuaguugcuuucuucuguguguggcauugcucggcuucaucaugugggccugccagaaagggaauauucgguguaacaucugcauauga

SEQ ID NO: 132061 - RNA, 1701 nt, Artificial Sequence; identical to SEQ ID NO: 132010
  derived and/or modified sequence opt3 from hemagglutinin__InfluenzaA__AGL09792

SEQ ID NO: 132062 - RNA, 1701 nt, Artificial Sequence
  derived and/or modified sequence opt3 from hemagglutinin__InfluenzaA__AGL09794
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacacacccauuggcaaguguaagucagaaugcaucaccccuaacgguaguaucccaaaugacaaacccuuucagaacgugaaucgaauuacguauggggcauguccuagauacgucaagcagagcacucugaaacuugccacaggaaugaggaacgugccagagaagcaaacccggggcaucuucggcgcuauugccggguuuauagaaaauggaugggaggguaugguggauggcugguauggguuccgucaccagaacuccgagggacgcggccaggcagcugaccugaaaucuacucaagccgcgaucgaucagauuaaugguaaguugaacagacucaucgggaaaacaaaugaaaaguuccaccagaucgagaaggaauuuagcgaggucgaaggcaggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgggaaaacgcugaggauaugggaaauggcugcuuuaagauuuaccacaaaugugacaacgccugcaucggguccauucgaaauggaacuuaugaucaugacguauaccgcgacgaggcucugaacaauagauuccagaucaaggguguggaacucaaaagcggcuacaaggauuggauacuguggaucucuuuugccauuucaugcuuccuucugugugucgcauugcucggguuuaucaugugggccugccagaaaggaaacauuagguguaauaucugcauauga

SEQ ID NO: 132063 - RNA, 1701 nt, Artificial Sequence; identical to SEQ ID NO: 132010
  derived and/or modified sequence opt3 from hemagglutinin__InfluenzaA__AGL09795

SEQ ID NO: 132064 - RNA, 1701 nt, Artificial Sequence
  derived and/or modified sequence opt3 from hemagglutinin__InfluenzaA__AGL09797
augaagaccaucauugcccugagcuacauacucugccuuguguucucccagaaacugcccggcaacgacaauucuacagcuacuuuguguuuagggcaccaugcagucccuaacggaacgaucguuaagaccauuacaaaugauagaaucgaggugacuaacgccaccgaacugguacaaaauucaaguauuggugagaucugcgacagcccacaccagauacuagauggcgaaaacuguacacucaucgacgcgcugcuuggggauccgcagugcgacggauuucagaauaaaaagugggaucuguucguggagagguccaaggcuuauucuaacuguuaccccuaugacgucccugauuacgccucguugcggucacucguggcaagcaguggcacccuggaauuuaauaacgaguccuucaauugggccgguguuacucaaaacgggacaucuagcgcuugcauucgcggauccaauucaaguuucuuuagccgacugaacuggcucacccauuuaaauuuuaaguauccagcacugaacgugacgaugcccaacaaugagcaguucgacaaacuuuacaucuggggcguccaccauccuggcacugauaaagaccagaucuuuuuguaugcccagucuuccgggcguauuaccgugucaacaaagagaagccaacaggcuguaauaccaaacauuggaaguaggccccggauccgcaauauuccuucuagaaucuccaucuacuggacuauuguuaaaccaggugauauacugcuaaucaacagcaccggcaaucucauugccccgaggggguacuucaagauccggucgggaaaaucuuccauaaugcgcucagacgcgcccauuggcaaguguaagagugaaugcaucacaccuaacgguagcaucccaaaugacaaacccuuucagaacgugaaucgaauuaccuauggggcauguccuagauacgucaagcaguccacgcugaaacuugccacuggaaugaggaacgugccagagaagcaaacacggggcaucuucggcgcuauugccggguuuauagaaaauggaugggaggguaugguggauggcugguauggguuccgucaccagaacucugagggacgcggccaggcagcugaccugaaaagcacccaagccgcgaucgaucagauuaaugguaaguugaacagacucaucgggaaaacuaaugaaaaguuccaccagaucgagaaggaauuuucagaggucgaaggcaggauucaggaccuggagaaauacguugaggauacaaagauagacuuauggaguuauaacgccgaacugcucguggcacuugagaaccaacauaccaucgaucugacggacuccgaaaugaauaaauuguucgagaagaccaaaaagcagcuacgggaaaacgcugaggauaugggaaauggcugcuuuaagauuuaccacaaaugugacaacgccugcaucgggagcauucgaaauggaacauaugaucaugacguauaccgcgacgaggcucugaacaauagauuccagaucaaggguguggaacucaaaucuggcuacaaggauuggauacuguggaucucauuugccauuaguugcuuccuucugugugucgcauugcucggguuuaucaugugggccugccagaaaggaaacauuagguguaauaucugcauauga

SEQ ID NO: 132065 - RNA, 1701 nt, Artificial Sequence
  derived and/or modified sequence opt3 from hemagglutinin__InfluenzaA__AGL09798
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuucgagggacgcggccaggcugccgaccugaaauccacccaagcggccaucgaucagauuaaugguaaguugaacagacucaucgggaaaacuaaugaaaaguuucaccagaucgagaaggaguucucugaagucgaaggcaggauucaggaccuggagaaauacguugaggauacaaagauagacuuauggagcuauaacgcagaacugcucguggcucuugagaaccaacauaccaucgaucugacggacucagaaaugaauaaauuguuugagaagaccaaaaagcagcuacgggaaaacgccgaggauaugggaaauggcugcuucaagauuuaccacaaaugugacaacgcuugcaucgggaguauucgaaauggaacauaugaucauuacguauaccgcgacgaggcccugaacaauagauuucagaucaaggguguggaacucaaauccggcuauaaggacuggauacuguggaucagcuucgcaauuucuugcuuucuucugugugucgccuugcucggguucaucaugugggcuugccagaaaggaaacauuagguguaauaucugcauauga

SEQ ID NO: 132066 - RNA, 1701 nt, Artificial Sequence; identical to SEQ ID NO: 132064
  derived and/or modified sequence opt3 from hemagglutinin__InfluenzaA__AGL09799

SEQ ID NO: 132067 - RNA, 1701 nt, Artificial Sequence; identical to SEQ ID NO: 132010
  derived and/or modified sequence opt3 from hemagglutinin__InfluenzaA__AGL09800

SEQ ID NO: 132068 - RNA, 1701 nt, Artificial Sequence; identical to SEQ ID NO: 131874
  derived and/or modified sequence opt3 from hemagglutinin__InfluenzaA__AGL09801

SEQ ID NO: 132069 - RNA, 1701 nt, Artificial Sequence; identical to SEQ ID NO: 131874
  derived and/or modified sequence opt3 from hemagglutinin__InfluenzaA__AGL09802

SEQ ID NO: 132070 - RNA, 1701 nt, Artificial Sequence
  derived and/or modified sequence opt3 from hemagglutinin__InfluenzaA__AGL09803
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagcggacucugaaacuugccacagggaugcguaacgugccagagaagcaaacccgcggaaucuucggcgcuauugccggcuuuauagaaaaugggugggagggaaugguggaugguugguauggcuucagacaccagaacagcgaggggaggggacaggcagcugaccugaaauccacucaagccgcgaucgaucagauuaauggcaaguugaaccggcucaucgguaaaacaaaugaaaaguuccaccagaucgagaaggaauuuucugaggucgaagggcgcauucaggaccuggagaaauacguugaggauaccaagauagacuuauggagcuauaacgccgaacugcucguggcacuugagaaccaacauacgaucgaucugaccgacucagaaaugaauaaauuguucgagaagacaaagaagcagcuacgagaaaacgcugaggauaugggcaauggaugcuuuaagauuuaccacaaaugugacaacgccugcaucggcaguauuagaaaugggacuuaugaucaugacguauacagggacgaggcucugaacaaucgguuccagaucaagggaguggaacucaaauccgguuacaaggauuggauacuguggaucagcuuugccauuucuugcuuccuucugugugucgcauugcucggcuuuaucaugugggccugccagaaagggaacauucgcuguaauaucugcauauga

SEQ ID NO: 132071 - RNA, 1701 nt, Artificial Sequence; identical to SEQ ID NO: 131907
  derived and/or modified sequence opt3 from hemagglutinin__InfluenzaA__AGL09804

SEQ ID NO: 132072 - RNA, 1701 nt, Artificial Sequence; identical to SEQ ID NO: 132013
  derived and/or modified sequence opt3 from hemagglutinin__InfluenzaA__AGL09805

SEQ ID NO: 132073 - RNA, 1701 nt, Artificial Sequence; identical to SEQ ID NO: 132042
  derived and/or modified sequence opt3 from hemagglutinin__InfluenzaA__AGL09806

SEQ ID NO: 132074 - RNA, 1701 nt, Artificial Sequence; identical to SEQ ID NO: 132013
  derived and/or modified sequence opt3 from hemagglutinin__InfluenzaA__AGL09807

SEQ ID NO: 132075 - RNA, 1701 nt, Artificial Sequence
  derived and/or modified sequence opt3 from hemagglutinin__InfluenzaA__AGL09808
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucaaagcucugggcgaaucaccguguccacaaagcguucacagcaggccguaauaccaaacguuggaagcagacccaggauucggaauaucccuagucgcauuucuaucuacuggacuaucgugaaaccaggugauauucugcuaauaaacuccaccggcaaucucaucgcgccgagaggguacuucaagauuaggagcggaaaaucgucuaucaugcgguccgacgcacccauaggcaaguguaagucagaaugcauuacaccuaacgguaguaucccaaaugacaaacccuuucagaacgucaaucgcaucaccuauggggccuguccucgauacgugaagcaaagcacgcugaaacuugcuacuggaaugagaaacgugccagagaagcagacaaggggcauuuucggcgccaucgcaggguuuauugaaaauggaugggaggguauggucgauggcugguauggguuccggcaccagaacuccgagggacguggccaagcugccgaccugaaaucuacccaggcggccauagaucagaucaaugguaaguugaaccgccucauugggaaaacuaaugaaaaguuccaccagaucgagaaggaauuuagcgagguugaaggcagaauccaagaccuggagaaauacguggaggauacaaagauugacuuauggucauauaacgcagaacugcucguagcucuugagaaccagcauaccauagaucugacggacagugaaaugaauaaauuguucgagaagaccaaaaagcagcuaagggaaaacgccgaggauaugggaaauggcugcuuuaagaucuaccacaaaugugacaacgcuugcauuggguccauccggaauggaacauaugaucaugacguguaccgagacgaggcccugaacaaucgcuuccagauuaagggugucgaacucaaaagcggcuacaaggauuggauccuguggauaucuuuugcaaucucaugcuuccuucuguguguggccuugcucggguuuauuaugugggcuugccaaaaaggaaacaucagauguaauauuugcaucuga

SEQ ID NO: 132076 - RNA, 1701 nt, Artificial Sequence
  derived and/or modified sequence opt3 from hemagglutinin__InfluenzaA__AGL09809
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuggaucggacaacggcacuugcuauccaggugauuuuaucgacuacgaagaguugagggagcagcucucaagcgugaguuccuucgaacgguuugagauuuucccgaagacaucuagcuggcccaaucacgauuccaacaagggggucaccgccgcuuguccucaugcaggagccaaaggcuuuuauaagaaucugaucuggcuggugaaaaagggcaacucauacccaaaacucaguauaagcuauaucaaugacaaggggaaggaaguauuaguucugugggguauucaccaccccucuacgacugcugaucaacagucccuuuaccagaacgccgacaccuacguguucgucggaacaucacgcuauagcaaaaaguuuaaaccugagaucgcgauucgaccaaaggugcgugaucaggagggcagaaugaauuacuauuggacuuugguggaacccggggacaaaaucaccuucgaggcaacaggaaaccuggucguuccuagguacgccuuugcuauggaacggaacgccggcagugguauaauuaucucugauaccccagugcaugacugcaauacgacuugucaaacaccgaagggggcaauuaacaccucccuacccuuccagaauauccacccuaucacuauuggaaaaugcccaaaguauguaaagagcacaaaacuccgccuggcuaccggccuuagaaacgugcccucgauacagucuaggggccuguuuggggccaucgcgggauucauugaggguggcuggacggggauggucgacggaugguacggcuaucaucaccagaaugaacaagguuccggguacgccgcagauuugaagucaacccagaacgcuaucgacaaaauaacaaauaaggugaacaguguuauugagaaaaugaauacucaguuuaccgccgugggcaaggaguucaaccaccucgaaaagcggaucgagaaucugaacaaaaaggucgaugacggauucuuagauaucuggacauacaaugcugaacugcucgugcuucuggagaacgaacgcacuuuggacuaucaugauagcaauguuaaaaaccuauacgagaagguacgaaaccagcugaaaaauaacgccaaggagauuggcaauggguguuuugaguucuaucacaagugcgacaacaccuguauggaauccgugaaaaauggaacauacgauuauccuaaguacucugaagaggcaaaacucaacagagaagagaucgacggugucaagcuggagagcaccaggauuuaucaaauacuugccaucuacucaacugcugcgaguucccugguguuggucgugagccucggcgcaauuucuuuuuggaugugcucaaaugggagucugcagugccggaucuguaucuga

SEQ ID NO: 132077 - RNA, 1701 nt, Artificial Sequence
  derived and/or modified sequence opt3 from hemagglutinin__InfluenzaA__AGL09810
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaguaaugaguccuucaacuggacugguguuacacaaaaugggaccucuagcgcuugcauucgccgauccaacucaaguuucuuuagccgucugaauuggcucacgcauuuaaacuuuaaguauccagcacugaaugugacuaugcccaacaacgagcaguucgacaaguuguacaucuggggaguccaccauccuggcaccgauaaagaccagauuuuucuuuaugcccagucuuccggcagaaucacagugucaacuaagaggagccaacaggcuguaauaccaaauauugggagucggccccgcaucagaaacauuccuucuaggaucuccaucuacuggaccauuguuaaaccaggagauauacugcuaaucaauagcacagguaaccucauugccccgcggggcuacuucaagauccgcucggggaaaucuuccauaaugcgaucagacgcgcccauuggaaaguguaagagugaaugcaucaccccuaauggcagcaucccaaacgacaaacccuuucagaaugugaacagaauuacguaugguacuuguccuagguacgucaagcaguccacacugaaacuugcaaccgggaugcggaaugugccagagaagcaaacucguggaaucuucggcgccauugcuggcuuuauagaaaacgggugggagggaaugguggaugguugguauggcuuccgccaccaaaauucugaggggagaggacaggccgcagaccugaaaagcacacaggcugccaucgaucagauuaacggcaaguugaauaggcucaucgguaaaaccaacgaaaaguuccaccagaucgagaaggaauuuucagaggucgaagggcggauucaggaccuggagaaauacguugaggauacgaagauagacuuauggaguuauaaugcggaacugcucguggcccuugagaaccaacauaccaucgaucugacagacuccgaaaugaacaaauuguucgagaagacuaaaaagcagcuacgagaaaaugcagaggauaugggcaacggaugcuuuaagauuuaccacaaaugugacaaugcuugcaugggcagcauccgcaacgggaccuaugaucaugacguauacagagacgaggcccugaauaacagguuccagauuaagggaguggaacucaaaucugguuacaaggauuggauccuguggauaucauuugcuaucaguugcuuccuucugugugucgccuugcucggcuuuauuaugugggcaugccagaaagggaauauccgguguaacauuugcaucuga

SEQ ID NO: 132078 - RNA, 1701 nt, Artificial Sequence; identical to SEQ ID NO: 131874
  derived and/or modified sequence opt3 from hemagglutinin__InfluenzaA__AGL09811

SEQ ID NO: 132079 - RNA, 1701 nt, Artificial Sequence
  derived and/or modified sequence opt3 from hemagglutinin__InfluenzaA__AGL09812
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucaggauaaaaagugggaccuguucguggagaggagcaaagccuauuccaauuguuaccccuaugaugucccugacuacgcaucuuugcggucgcucguggccucaagcggcacccuggaauuuaacaaugagaguuucaacugggcugguguuacucaaaaugggacauccucugcaugcauucgcggaagcaacuccucauuuuucagucgacugaauuggcucacccauuuaaacuuuaaguauccagcccugaaugugacgaugcccaacaacgagcaguucgauaaguuguacaucuggggcguccaccauccuggcacugacaaagaucagauuuuucuuuaugcucagagcucugggcguaucaccguguccacaaagagaucacaacaggccguaauaccaaauauuggaagcaggccccggauccgcaacauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgacgcacccauuggcaaguguaagucagaaugcaucacaccuaaugguaguaucccaaacgauaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaaugcagaacugcucguggcucuugagaaccaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugacguauaccgcgaugaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 132080 - RNA, 1701 nt, Artificial Sequence; identical to SEQ ID NO: 131851
  derived and/or modified sequence opt3 from hemagglutinin__InfluenzaA__AGL09813

SEQ ID NO: 132081 - RNA, 1701 nt, Artificial Sequence; identical to SEQ ID NO: 131899
  derived and/or modified sequence opt3 from hemagglutinin__InfluenzaA__AGL09814

SEQ ID NO: 132082 - RNA, 1701 nt, Artificial Sequence
  derived and/or modified sequence opt3 from hemagglutinin__InfluenzaA__AGL09815
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaguauuccuucuaggaucuccaucuacuggaccauuguuaaaccaggagauauacugcuaaucaauagcacagguaaccucauugccccgcggggcuacuucaagauccgcucggggaaaucuuccauaaugcgaucagacgcgcccauuggaaaguguaagagugaaugcaucaccccuaauggcagcaucccaaacgacaaacccuuucagaaugugaacagaauuacguauggugcauguccuagguacgucaagcaguccacucugaaacuugccacagggaugcggaaugugccagagaagcaaacccguggaaucuucggcgcuauugccggcuuuauagaaaacgggugggagggaaugguggaugguugguauggcuuccgccaccaaaauucugaggggagaggacaggcagcugaccugaaaagcacucaggccgcgaucgaucagauuaacggcaaguugaauaggcucaucgguaaaacaaacgaaaaguuccaccagaucgagaaggaauuuucagaggucgaagggcggauucaggaccuggagaaauacguugaggauaccaagauagacuuauggaguuauaaugccgaacugcucguggcacuugagaaccaacauacgaucgaucugaccgacuccgaaaugaacaaauuguucgagaagacaaagaagcagcuacgagaaaaugcugaggauaugggcaacggaugcuuuaagauuuaccacaaaugugacaaugccugcaucggcagcauucgcaacgggacuuaugaucaugacguauacagagacgaggcucugaauaacagguuccagaucaagggaguggaacucaaaucugguuacaaggauuggauacuguggaucucauuugccauuaguugcuuccuucugugugucgcauugcucggcuuuaucaugugggccugccagaaagggaauauucgguguaacaucugcauauga

SEQ ID NO: 132083 - RNA, 1701 nt, Artificial Sequence; identical to SEQ ID NO: 131899
  derived and/or modified sequence opt3 from hemagglutinin__InfluenzaA__AGL09816

SEQ ID NO: 132084 - RNA, 1701 nt, Artificial Sequence
  derived and/or modified sequence opt3 from hemagglutinin__InfluenzaA__AGL09817
augaagaccaucauugcccugagcuacauacucugccuuguguucgcucaggagcugcccggcaacgacgauuccacagcaacuuuguguuuagggcaccaugccgucccuaauggaacgaucguuaaaaccauuacaaacgaccaaaucgaagugacuaaugcgaccgagcugguacagucuucaaguacaggugaaauuugcaacagcccacaccagauccuagauggcgagaauuguacccucauagacgcucugcuuggggauccgcagugcgacggauuucaaaacaagaaaugggaucuguucguggaaagauccaaggcccauucuaauuguuaucccuacgacgucccugauuaugcaucguugaggucacucguggccagcaguggcacucuggaguuuaacuccgagucuuucaauuggacagguguuacccagaacgggacgagcuccgcuugcauccggcgcucaaauaacagcuuuuucagucgacugaauuggcucacucacuuaaacuuuaaauacccagcacugaaugugaccaugcccaacaacgaacaguucgacaaacuuuauauuuggggaguccaucacccuggcacagauaaggaccagaucuuuuuguacgcccaggcuucuggccguauuacuguguccaccaagagaucacaacaggccguaaucccaaauauagggagcaggccccggguucgcaacauuccuaguagagugucuaucuauuggacaauugucaagccaggagauauccugcuaaucaauuccaccgguaaccucauugcgccgaggggcuacuucaaaauacggagcgggaagucgucuaucaugcgcuccgacgcacccauuggaaaauguaauucagccugcaucacgccuaacggcaguauaccaaaugacaagcccuuucagaacgugaaucgaauuacuuacggugcuuguccuagauaugugaagcaaaacacacugaaacuugccaccgggaugaggaaugucccagagaagcagacucggggaaucuucggcgcaaucgcuggcuuuauugaaaacgggugggagggaaugguugaugguugguacggcuuccgucaccagaauagcgaggggcgcggacaagccgcggaccugaaauccacacaggccgcaaucgaucagauuaacggcaaguugaauagacucauagguaaaaccaacgaaaaguuccaucagaucgagaaagaauuuucugagguggaagggaggauucaagaccuggagaaguauguagaggauacgaagaucgacuuauggagcuacaacgcugaacugcucguggcccuugagaaucagcacaccaucgaucugacagacucagaaaugaacaaauuguucgagaagacuaaaaagcagcuacgggaaaaugcugaggauaugggcaacggaugcuuuaaaauuuaucauaagugugacaaugccugcauaggcaguauccgaaacgggaccuacgaucacgacgucuaucgcgacgaggcacugaauaacagauuccagauuaagggaguggaacucaaauccgguuacaaggauuggauccuguggauuagcuuugccaucucuugcuuccuucuguguguugcuuugcucggcuuuauaaugugggcgugccaaaaagggaauaucagguguaacauuugcaucuga

SEQ ID NO: 132085 - RNA, 1701 nt, Artificial Sequence; identical to SEQ ID NO: 131899
  derived and/or modified sequence opt3 from hemagglutinin__InfluenzaA__AGL09818

SEQ ID NO: 132086 - RNA, 1701 nt, Artificial Sequence; identical to SEQ ID NO: 132010
  derived and/or modified sequence opt3 from hemagglutinin__InfluenzaA__AGL09819

SEQ ID NO: 132087 - RNA, 1701 nt, Artificial Sequence
  derived and/or modified sequence opt3 from hemagglutinin__InfluenzaA__AGL09820
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauuggacugguguuacacagaacgggaccuccucugcuugcauucggggaagcaauuccucauuuuucagucgccugaacuggcucacgcauuuaaauuuuaaguauccagcacugaacgugacuaugcccaacaaugagcaguucgacaaacuuuacaucuggggcguccaccauccuggcaccgauaaagaccagaucuuuuuguaugcccaaagcucugggcgaauuacaguguccacuaagcguucacagcaggcuguaauaccaaacauuggaagcagacccaggauccggaauauuccuagucgcaucucuaucuacuggaccauuguuaaaccaggugauauacugcuaaucaacuccacaggcaaucucauugccccgagaggguacuucaagaucaggagcggaaaaucgucuauaaugcgguccgacgcgcccauuggcaaguguaagucagaaugcaucaccccuaacgguaguaucccaaaugacaaacccuuucagaacgugaaucgcauuacguauggggcauguccucgauacgucaagcaaagcacucugaaacuugccacaggaaugagaaacgugccagagaagcagaccaggggcaucuucggcgcuauugccggguuuauagaaaauggaugggaggguaugguggauggcugguauggguuccggcaccagaacuccgagggacguggccaagcagcugaccugaaaucuacucaggccgcgaucgaucagauuaaugguaaguugaaccgccucaucgggaaaacaaaugaaaaguuccaccagaucgagaaggaauuuagcgagauugaaggcagaauacaagaccuggagaaauacgucgaggauaccaagaucgacuuauggucauauaacgccgaacugcucguugcacuugagaaccagcauacgauugaucugaccgacagugaaaugaauaaauuguucgagaagacaaagaagcagcuaagggaaaacgcugaggauaugggaaauggcugcuuuaagaucuaccacaaaugugacaacgccugcauuggguccauccggaauggaacuuaugaucaugacguguaccgagacgaggcucugaacaaucgcuuccagauaaaggguguagaacucaaaagcggcuacaaggauuggauccuguggauuucuuuugccaucucaugcuuccuucuguguguggcauugcucggguuuauuaugugggccugccaaaaaggaaacaucagauguaauauaugcauuuga

SEQ ID NO: 132088 - RNA, 1701 nt, Artificial Sequence
  derived and/or modified sequence opt3 from hemagglutinin__InfluenzaA__AGL09821
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaauagaacucaaaagcgguuacaaggacuggauccuguggauuucuuuugccaucucaugcuuccuucuguguguggcauugcucggcuuuauuaugugggccugccagaaagggaauauccgguguaacauaugcauuuga

SEQ ID NO: 132089 - RNA, 1701 nt, Artificial Sequence; identical to SEQ ID NO: 132013
  derived and/or modified sequence opt3 from hemagglutinin__InfluenzaA__AGL09822

SEQ ID NO: 132090 - RNA, 1701 nt, Artificial Sequence; identical to SEQ ID NO: 132056
  derived and/or modified sequence opt3 from hemagglutinin__InfluenzaA__AGL09823

SEQ ID NO: 132091 - RNA, 1701 nt, Artificial Sequence
  derived and/or modified sequence opt3 from hemagglutinin__InfluenzaA__AGL09824
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcagggacgaaaaguuuuuauaagaaccugaucuggcucgugaaaaagggaaauagcuacccaaaauuaucuaaguccuauauaaacgauaagggcaaagaaguacugguucuuuggggcauccaccaccccucaacuaccgccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugauugaacccggugauaagaucaccuucgaggcaacaggcaaccuaguggucccuagguacgccuuugcuauggaacggaaugccggguccggaauaauuaucagcgacaccccaguucaugauugcaacacgacuugucaaacaccggagggcgcaauuaauaccucgcuccccuuccagaacauccacccuaucacuauugguaaaugcccaaaguaugugaagucuacaaaacugcgccuugcuaccgggcugagaaauguacccuccauacagucaaggggauuguuuggcgccaucgcgggcuucauugaagggggauggacggguaugguggacggcugguacggguaucaucaccagaacgagcaaggaaguggcuacgccgcagaccucaagagcacccagaaugcuaucgauaaaauaacaaacaaggucaauuccgugauugagaaaaugaacacucaguuuaccgccguugguaaggaguucaaucaccuggagaagcggaucgaaaacuuaaauaaaaagguggacgauggguuccuggacaucuggacauacaacgcugagcuccuuguccuguuggaaaaugagcgcacucuagauuaucaugacucuaacgugaaaaaccuguacgagaagguacgaaaucagcucaaaaacaaugccaaggaaauuggcaacggauguuuugaguucuaucacaagugcgauaauaccuguauggaaagcguuaaaaacggcacauacgacuauccuaaguacucagaggaagcaaaacugaauagagagaagaucgauggggugaaacuugagaguaccaggauuuaucaaauacuggccaucuacuccacugucgcuagcucuuuggugcucgucgugucacugggagcgauuaguuuuuggaugugcagcaacgguuccuuacagugccggaucuguaucuga

SEQ ID NO: 132092 - RNA, 1701 nt, Artificial Sequence; identical to SEQ ID NO: 132010
  derived and/or modified sequence opt3 from hemagglutinin__InfluenzaA__AGL09825

SEQ ID NO: 132093 - RNA, 1701 nt, Artificial Sequence; identical to SEQ ID NO: 132091
  derived and/or modified sequence opt3 from hemagglutinin__InfluenzaA__AGL09826

SEQ ID NO: 132094 - RNA, 1701 nt, Artificial Sequence; identical to SEQ ID NO: 131884
  derived and/or modified sequence opt3 from hemagglutinin__InfluenzaA__AGL09827

SEQ ID NO: 132095 - RNA, 1701 nt, Artificial Sequence
  derived and/or modified sequence opt3 from hemagglutinin__InfluenzaA__AGL09828
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagagaagcaaagccuauuccaacuguuaccccuaugacgucccugauuacgcaucuuugaggucgcucguggccucaagcggcacccuggaauuuaauaacgagaguuucaauugggcugguguuacucagaacgggacauccucugcaugcauucggggaagcaauuccucauuuuucagucgccugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucaaagcucugggcgaaucaccguguccacaaagcguucacagcaggccguaauaccaaacauuggaagcagacccaggauccggaauauuccuagucgcaucucuaucuacuggacuauuguuaaaccaggugauauacugcuaaucaacuccaccggcaaucucauugcgccgagaggguacuucaagaucaggagcggaaaaucgucuauaaugcgguccgacgcacccauuggcaaguguaagucagaaugcaucacaccuaacgguaguaucccaaaugacaaacccuuucagaacgugaaucgcauuaccuauggggccuguccucgauacgucaagcaaagcacgcugaaacuugcuacuggaaugagaaacgugccagagaagcagacaaggggcaucuucggcgccauugcaggguuuauagaaaauggaugggaggguaugguggauggcugguauggguaccggcaccagaacuccgagggacguggccaagcugccgaccugaaaucuacccaggcggccaucgaucagauuaaugguaaguugaaccgccucaucgggaaaacuaaugaaaaguuccaccagaucgagaaggaguucagcgaagucgaaggcaggauucaagaccuggagaaauauguugaggauacaaagauagacuuauggucauacaacgcagaacugcucguggcucuugagaaccagcauaccaucgaucugacggacagugaaaugaauaaauuguuugagaagaccaaaaagcagcuaagagaaaacgccgaggauaugggaaauggcugcuucaagauuuaucacaaaugugacaacgcuugcaucggguccauucggaauggaacauacgaucaugacguauaccgagacgaggcccugaacaaucgcuuucagaucaaggguguggaacucaaaagcggcuauaaggauuggauacuguggaucucuuucgcaauuucaugcuuucuucugugugucgccuugcucggguucaucaugugggcuugccaaaaaggaaacauuagauguaauaucugcauauga

SEQ ID NO: 132096 - RNA, 1701 nt, Artificial Sequence
  derived and/or modified sequence opt3 from hemagglutinin__InfluenzaA__AGL09829
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaacuuuacaucuggggcguccaccauccuggcacugauaaagaccagaucuuuuuguaugcucagagcucugggcguauuaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugguggauggcugguauggguuccgucaccagaacuccgagggacgcggccaggcugccgaccuggaaucuacccaagcggccaucgaucagauuaaugguaaauugaacagacucaucgggaagacuaaugagaaauuccaccagaucgaaaaggaguuuagcgaagucgagggcaggauucaggaccuggagaaguacguugaagauacaaaaauagacuuauggucauauaacgcagagcugcucguggcucuugaaaaccaacauaccaucgaucugacggacagugagaugaauaaguuguucgaaaagaccaagaaacagcuacgggagaacgccgaggauaugggaaauggcugcuuuaagauuuaccacaagugugacaacgcuugcaucggguccauucgaaauggaacauaugaucaugacguauaccgcgacgaagcccugaacaauagauuccagaucaaagguguggagcucaagagcggcuacaaagauuggauacuguggaucucuuuugcaauuucaugcuuccuucugugugucgccuugcucggguuuaucaugugggcuugccagaagggaaacauuagguguaauaucugcauauga

SEQ ID NO: 132097 - RNA, 1701 nt, Artificial Sequence; identical to SEQ ID NO: 131899
  derived and/or modified sequence opt3 from hemagglutinin__InfluenzaA__AGL09830

SEQ ID NO: 132098 - RNA, 1701 nt, Artificial Sequence; identical to SEQ ID NO: 132009
  derived and/or modified sequence opt3 from hemagglutinin__InfluenzaA__AGL09831

SEQ ID NO: 132099 - RNA, 1701 nt, Artificial Sequence
  derived and/or modified sequence opt3 from hemagglutinin__InfluenzaA__AGL09832
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauagcaauuuuaaguauccagcauuaaacgugacuaugcccaacaaugagcaguucgacaagcuguacaucuggggaguccaccauccuggcaccgauaaagaccagauuuuucuuuaugcccagucuuccggcagaaucacagugucaacuaagaggagccaacaggcuguaauaccaaacauugggagucggccccgcaucagaaauauuccuucuaggaucuccaucuacuggaccauuguuaaaccaggagauauauugcugaucaacagcacagguaaucuaauugccccgcggggcuacuucaagauccgcucggggaaaucuuccauaaugcgaucagacgcgcccauuggaaaguguaagagugaaugcaucaccccuaacggcagcaucccaaaugacaaacccuuucagaacgugaauagaauuacguauggugcauguccuagguacgucaagcaguccacucucaaacuggccacagggaugcggaacgugccagagaagcaaacccguggaaucuucggcgcuauugccggcuuuauagaaaaugggugggagggaaugguggaugguugguauggcuuccgccaccagaacucugaggggagaggacaggcagcugaccuuaaaagcacucaagccgcgaucgaucagauuaauggcaagcugaacagguugaucgguaaaacaaaugaaaaguuccaccagaucgagaaggaauuuucagaggucgaagggcggauucaggaccucgagaaauacguugaggauaccaagauagaccuguggaguuauaacgccgaauuacugguggcacucgagaaccaacauacgaucgaucuuaccgacuccgaaaugaauaaacuguucgagaagacuaaaaagcaguugcgagaaaacgcugaggauaugggcaauggaugcuuuaagauuuaccacaaaugugacaacgccugcaucggcacaauucgcaaugggaccuaugaucauaacguauacagagacgaggcucuaaauaacagguuccagaucaagggaguggaacugaaaagcgguuacaaggacuggauacucuggaucucuuuugccauuucaugcuuccugcuuugugucgcacuguugggcuuuaucaugugggccugccagaaagggaauauucgguguaacaucugcauauga

SEQ ID NO: 132100 - RNA, 1701 nt, Artificial Sequence; identical to SEQ ID NO: 132010
  derived and/or modified sequence opt3 from hemagglutinin__InfluenzaA__AGL09833

SEQ ID NO: 132101 - RNA, 1701 nt, Artificial Sequence
  derived and/or modified sequence opt3 from hemagglutinin__InfluenzaA__AGL09881
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacggggcauccucugccugcauucgcggaagcaauuccucauuuuucagucgacugaacuggcucacacauuuaaauuuuaaguauccagcucugaacgugaccaugcccaacaaugagcaguucgacaaguuguacaucuggggcguccaccauccuggcacggauaaagaccagauuuuucuuuaugcccagagcucugggcguaucacuguguccaccaagagaucacaacaggcgguaauaccaaacauuggaagcaggccccggauccgcaauauuccuaguagaaucucuaucuacuggacaauuguuaaaccaggugauauacugcuaaucaacuccacuggcaaucucauugcaccgaggggguacuucaagauccggagcggaaaaucgucuauaaugcgcuccgacgcccccauuggcaaguguaagucagaaugcaucaccccuaacgguaguaucccaaaugacaaacccuuucagaacgugaaucgaauuacauauggggcuuguccuagauacgucaagcagagcacccugaaacuugccacgggaaugaggaacgugccagagaagcaaacucggggcaucuucggcgcaauugcuggguuuauagaaaauggaugggaggguaugguggauggcugguauggguuccgucaccagaacuccgagggacgcggccaggccgcggaccugaaaucuacacaagccgcaaucgaucagauuaaugguaaguugaacagacucaucgggaaaaccaaugaaaaguuccaccagaucgagaaggaauuuagcgaggucgaaggcaggauucaggaccuggagaaauacguugaggauacuaagauagacuuauggucauauaacgcugaacugcucguggcccuugagaaccaacauacaaucgaucugaccgacagugaaaugaauaaauuguucgagaagacgaaaaagcagcuacgggaaaacgcugaggauaugggaaauggcugcuuuaagauuuaccacaaaugugacaacgccugcaucggguccauucgaaauggaaccuaugaucaugacguauaccgcgacgaggcacugaacaauagauuccagaucaaggguguggaacucaaaagcggcuacaaggauuggauacuguggaucucuuuugccauuucaugcuuccuucugugugucgcuuugcucggguuuaucaugugggcgugccagaaaggaaacauuagguguaauaucugcauauga

SEQ ID NO: 132102 - RNA, 1701 nt, Artificial Sequence; identical to SEQ ID NO: 131874
  derived and/or modified sequence opt3 from hemagglutinin__InfluenzaA__AGL09882

SEQ ID NO: 132103 - RNA, 1701 nt, Artificial Sequence; identical to SEQ ID NO: 131851
  derived and/or modified sequence opt3 from hemagglutinin__InfluenzaA__AGL09883

SEQ ID NO: 132104 - RNA, 1701 nt, Artificial Sequence; identical to SEQ ID NO: 131851
  derived and/or modified sequence opt3 from hemagglutinin__InfluenzaA__AGL09884

SEQ ID NO: 132105 - RNA, 1683 nt, Artificial Sequence; identical to SEQ ID NO: 132004
  derived and/or modified sequence opt3 from hemagglutinin__InfluenzaA__AGL44438

SEQ ID NO: 132106 - RNA, 1701 nt, Artificial Sequence
  derived and/or modified sequence opt3 from hemagglutinin__InfluenzaA__AGN69267
augaaggccauccuggugguccuccuuuacaccuucacaacuggcaacgcugacacgcugugcauuggguaucacgcaaauaacagcaccgauacaguugacacuguguuggagaagaauguaaccgugacacauuccgucaacuuacuggaagauagacacaauggaaagcuauguaaacucagggguguggcgccccugcaucuuggcaagugcaacauagccggguggcuguugggaaauccugagugugaacuccuguuuaccgcuucuucauggaguuacaucguugagacuagcaacuccgacaauggcacaugcuauccaggugauuucauuaacuacgaagaacugcgggagcagcucucuucggugaguagcuuugaacgcuucgagaucuuuccgaaagccaguuccuggcccaaucacgaaaccaaccgaggggucacggcagccuguccuuaugcuggagcaaauucuuucuaccguaacuuaauuuggcuggugaagaagggcaauagcuauccaaaacuuuccaagucauacaucaacaacaaagagaaggagguauugguucuguggggcauacaucaucccccuacuucaaccgaccaacagagccuauaccagaaugccgaugcuuauguguuugucgggucuuccaaauacucaaagaaguucaaaccagaaaucgccacaagacccaaggugaggggacaggcgggucggaugaacuauuacuggacucucguggagccuggcgacaccauuacauuugaagcaaccgggaaucuggucguuccacgcuaugccuucgcuaugaaaagaggaagcggcagugguaucauuaucucugauacgccggugcacgacugcaacacuacaugucaaacccccaagggggccauaaauacuucccuuccuuuucagaacauucacccaguaacaaucggagagugccccaaauacgucaagagcaccaaacugaggauggcaacgggcuugcggaauauuccuucgauccagucucgcggccucuucggggcuaucgccggauuuauugaagguggcuggaccgggaugauagauggaugguauggcuaccaccaucagaacgagcaagguuccggguacgcggccgaccgaaagucaacacagaaugcaaucgauggcauuacuaacaaggugaauagugugaucgagaaaaugaacacccaguucacagcuguuggaaaggaguucaaucaccuggagaaaagaauagaaaacuuaaauaagaaaguggacgacggccugcucgaugucuggacuuauaacgccgagcuucugguguugcuagaaaacgagaggacccuggacuaccacgauagcaauguaaagaaccucuaugagaagguucggucccagcugaaaaauaacgcuaaggaaauugggaauggauguuuugaguucuaccauaaaugcgacgauacauguauggaaucugugaagaacgguaccuaugacuacccaaaauauagcgaggaagccaaacuuaaucgugaggagaucgauggcgucaagcuggaaucaacucgcaucuaccaaauuuuggcaaucuacaguacgguggccuccagccucguccuguuagugucucugggggcuauuucauuuuggaugugcaguaacggaagccuacagugcagaauauguaucuga

SEQ ID NO: 132107 - RNA, 1701 nt, Artificial Sequence
  derived and/or modified sequence opt3 from hemagglutinin__InfluenzaA__AGN69278
augaaggccauccuggugguccuccuuuacaccuucacaacugcuaacgcagacacgcugugcauuggcuaucacgccaauaacagcaccgauacaguugacacuguguuggagaagaauguaaccgugacacauuccgucaacuuacuggaagauagacacaaugggaagcuauguaaacucaggggaguggcgccccugcaucuugguaagugcaacauagcuggcuggcuguuggggaauccugagugugaacuccuguuuaccgccucuucauggaguuacaucguugagacuagcaacuccgacaauggaacaugcuauccaggcgauuucauuaacuacgaagaacugcgggagcagcucucuucggugucuagcuuugaacgcuucgagaucuuuccgaaagcaaguuccuggcccaaucacgaaccuaaccgaggugucaccgccgcuuguccauaugcaggggccaauucuuucuaccguaacuuaauuuggcuggugaagaagggaaauagcuaucccaaacuuuccaagucauacaucaacaacaaagagaaggagguauugguucuguggggcauacaucacccuccaacgaguacugaccaacagagccuauaccagaaugcugaugccuauguguuugucggcucauccaaauacaacaagaaguucaaacccgaaaucgcgaccagaccuaaggugagggggcaggcaggacggaugaauuauuacuggacacucguggagccaggugacacuauuaccuuugaagccacaggcaaccuggucguuccgcgcuaugcuuucgccaugaaaagagggucaggaagcggcaucauuaucagugauacccccgugcacgacugcaauacgacuugucaaacaccuaagggugcaauaaacaccucucuuccauuucagaauauucaucccguaacuaucggggagugcccuaaauacgugaaguccacaaaacugaggauggcuaccggauugcggaacauuccaagcauccagucgcgcggccucuucggcgccaucgcgggguuuauugaaggagguuggacgggcaugauagaugggugguauggauaccaccaucagaaugagcaaggcucugguuacgccgcagaccgaaaguccacccagaacgcuaucgaugggauuacaaauaaggucaacucagugaucgagaaaaugaauacucaguucaccgccguuggcaaggaguucaaccaccuggagaaaagaauagaaaauuuaaacaagaaaguggacgacggacugcucgaugucuggacauauaacgcugagcuucugguguugcuagaaaaugagaggacucuggacuaccacgauaguaacguaaagaaucucuaugagaagguucggagccagcugaaaaacaaugccaaggaaauuggcaacggguguuuugaguucuaccauaaaugcgacgauaccuguauggaauccgugaagaauggaacauaugacuaccccaaauauucugaggaagcaaaacuuaaccgugaggagaucgauggugucaagcuggaaagcacccgcaucuaccaaauuuuggccaucuacucaacuguggcuaguucccucguccuguuagugagccugggcgcgauuucuuuuuggaugugcucaaaugggagucuacagugcagaauauguaucuga

SEQ ID NO: 132108 - RNA, 1701 nt, Artificial Sequence
  derived and/or modified sequence opt3 from hemagglutinin__InfluenzaA__AGN69302
auggaggccaagcuguucgugcucuuuugcgcuuucaccgcacuuaaagccgacacaaucugugucggcuaccacgcgaacaauagcacugauacgguugacaccauucuggaaaagaacgugacaguaacucauuccgugaauuuguuagagaacucucacaaugggaaacugugcucacuaaacggaaagauaccccuccagcuggguaauuguaacgucgcuggcuggauccuugggaauccuaaaugcgaucuguugcucaccgccaacaguuggagcuauauuaucgaaacauccaauucuaaggacggagcauguuacccaggcgaguuugccgauuaugaagaacugaaggagcaacugucgaccgugaguagcuucgaaagauuugagauuuucccgaaagcuacuucauggcccaaccaugacacaaccagggguacgacuguugcaugcucccacucuggggccaauagcuuuuaccggaaccucuuauggaucgugaagaaaggaaauuccuauccuaagcugucaaaaaguuacaccaacaacaagggcaaggaaguccuugugauauggggcguacaucacccacccacagauagcgaccagcagacuuuguaucagaauaaccacaccuacguuucugugggguccucaaaauacuauaagcgcuucacaccugagaucgucgcucgaccaaaagugcgugagcaagccggaagaaugaauuacuauuggacccugcuagaucagggugacacgauuacuuuugaagcgacaggcaaccucaucgcacccuggcaugccuucgcucugaagaaagggagcaguucuggaauuaugauguccgaugcccaggugcacaauuguaccacuaagugccagacaccucauggcgcacuuaaagguaaccugccauuucaaaauguccacccgguuaccaucggggagugucccaaguacguaaagagcacgcaguugaggauggcuaccggacuccggaacauaccuucgauucagucucgcggccuguucggcgccaucgcgggguuuauugaaggagguuggacaggcaugguggacgggugguauggauaccaccaucagaaugagcaaggcuccgguuaugccgcagaucagaaaucaacucagaucgcuaucgacgggauuaguaacaaggugaauagcgucauagagaaaaugaacauccaauucaccuccgugggcaaggaguucaauucuuuagagaaaagaauggaaaaccugaauaagaagguugacgauggauuucucgacguguggacauacaacgccgagcuucugauuuugcuagaaaacgagaggacucuggauuuccacgaccucaaugucaaaaaccuguacgaaaaggugaaaagccagcuucggaauaacgcuaaggagaucggcaaugggugcuuugaguucuaucauaaaugugauaacgaaugcauggagucaguaaagaauggaaccuacaacuauccaaaguacagugaagaguccaaacugaaucgcgaagagauagacgguguuaaguuggagagcaugggcauucaccagauccucgccaucuauucuacaguggcaucaagucuggucuuacuggugagccuaggggccauuuccuuuuggaugugcucuaacggaucgcuccagugucgagucugcaucuga

SEQ ID NO: 132109 - RNA, 1701 nt, Artificial Sequence; identical to SEQ ID NO: 132108
  derived and/or modified sequence opt3 from hemagglutinin__InfluenzaA__AGN69314

SEQ ID NO: 132110 - RNA, 1701 nt, Artificial Sequence; identical to SEQ ID NO: 132108
  derived and/or modified sequence opt3 from hemagglutinin__InfluenzaA__AGN69326

SEQ ID NO: 132111 - RNA, 1701 nt, Artificial Sequence
  derived and/or modified sequence opt3 from hemagglutinin__InfluenzaA__AGN69338
auggaggccaagcuguucgugcucuuuugcgcuuucaccgcacuuaaagccgacacaaucugugucggcuaccacgcgaacaauagcacugauacgguugacaccauucuggaaaagaacgugacaguaacucauuccgugaauuuguuagagaacucucacaaugggaaacugugcucacuaaacggaaagauaccccuccagcuggguaauuguaacgucgcuggcuggauccuugggaauccuaaaugcgaucuguugcucaccgccaacaguuggagcuauauuaucgaaacauccaauucuaagaacggagcauguuacccaggcgaguuugccgacuaugaggaacugaaggagcaacugucgaccgugaguagcuucgaaagauuugagauuuucccgaaagcuacuucauggcccaaucaugauacaaccagggguacgacuguugcaugcucccacucuggggccaacagcuuuuaccggaaucucuuauggaucgugaagaaaggaaacuccuauccuaagcugucaaaaaguuacaccaacaauaagggcaaggaaguccuugugauauggggcguacaucacccacccacagacagcgaucagcagacuuuguaucagaacaaucacaccuacguuucugugggguccucaaaauacuauaagcgcuucacaccugagaucgucgcucgaccaaaagugcgugagcaagccggaagaaugaacuacuauuggacccugcuacaucagggugacacgauuacuuuugaagcgacaggcaaucucaucgcacccuggcacgccuucgcucugaacgaggggagcaguucuggaauuaugagguccgaugcccaggugcauaauuguaccacuaagugccagacaccucacggcgcacuuaaagguaaccugccauuucaaaauguccacccgguuaccaucggggaaugucccaaguacgugaaaagcacgcaguugcggauggcuaccggacuccgcaacauaccuucgauucagucuagaggccuguucggcgccaucgcgggguuuauugagggagguuggacaggcaugguagacgggugguauggauaccaucacaggaaugaacagggcuccgguuaugccgcagaucaaaagucaacucagaucgcuaucgacgggauuaguaacaaggugaauagcgucauagagaaaaugaacauccaguucaccuccgugggcaaggagugcaauucuuuagaaaaacggauggagaaccugaacaagaaaguugaugacggauuccucgacguguggacauacaaugccgaacuucugauuuugcuagagaacgaacgcacucuggauuuucaugaccucaaugucaagaaccuguacgagaaggugaaaagccaacuucgaaauaacgcuaaggagaucggcaauggguguuucgaauuuuaucacaaaugcgauaacgagugcauggaaucaguaaagaauggaaccuacaacuauccaaaauacagugaggaauccaagcugaauagagaggagauagacgguguuaaguuggaaagcaugggcauucaucagauccucgccaucuauucuacaguggcaucaagucuggucuuacuggugagccuaggggccauuuccuucuggauguguucuaacggaucgcuccagugcagggucuguaucuga

SEQ ID NO: 132112 - RNA, 1701 nt, Artificial Sequence
  derived and/or modified sequence opt3 from hemagglutinin__InfluenzaA__AGO00265
augaaggccagacugcucgugcuucugugcgcuaucgcagccaccgacgcggauacaauuuguauaggcuaccacgcuaacaauagcacugacacggucgauaccaucuuggagaaaaacguuacagugacucauuccguaaauuuacuggaagacucucacaacgggaagcuaugcaggcucaaaggaauugcaccccugcagcuugguaaguguaauaucgccggcuggauucuggggaacccugagugcgaaucauugcucagugagcggagcugguccuauaucguggaaaccccaaauucugagaacggaacauguuacccgggcgauuucauagacuaugaggaacugcgcgagcaacugucgucagucaccagcuuugaacgauucgagaucuuucccaaagagacaaguuggccuaagcauaauacuaccaagggugugacggccgcuugcucccacgcagggaaauguucuuucuaccguaaccucuuauggcugacugaaaaggauggaagcuauccaaaucuuaacaauuccuacguuaacaaaaagggcaaagagguguugguccuguggggcgugcaucaccccucaaauauuaaggaccagcagacccuauaucagaaggaaaacgccuacguaaguguugugagcucuaacuacaauagaagguuuacaccugagaucgcugaacggccaaaaguccgcgggcaagccggaagaaugaacuauuacuggacucuccuggagcccggugauaccauuaucuucgaggcgaauggcaaccuuauagcaccuugguaugccuuugcucuguccaggggguucggaucaggcauuaucacaagcaaugccaguaugcacgaaugcaacaccaagugucagacgccacagggugcaauuaauucuuccuugccguuucagaacauccaucccgugacuaucggggagugcccuaaauacgugcggagcacaaagcuccgcauggucaccggacugcgaaauauuccaucgauacaaucuagaggcuuauucggcgcuaucgccggguuuauugaaggagguuggacuggcaugaucgacgggugguauggauaccaccaucagaacgagcagggcuccgguuaugcggccgaucagaaaucaacacaaaaugcaauaaacgggauuaccaauaagguuaacagugugaucgagaaaaugaauacgcaguucaccgcuguaggcaaggaauuuaacaaccuggagaagaggauggaaaaucucaacaaaaagguggacgauggauuccuugacaucuggacauacaaugccgagcuguugguccuacuggaaaacgagcggacucucgacuuccacgauagcaaugugaaaaaccuguacgaaaagguuaaaucccagcuucguaauaacgcuaaggagauuggcaauggguguuuugaguucuaucacaagugcaacaaugaaugcauggagucugugaaaaacggaaccuacgacuaucccaaguacagcgaagagucaaaacugaaucgcgagaagaucgauggugucaaauuggaaaguaugggcguguaucaaauucucgccauauacuccacaguagcaagcucucugguuuuacuggugucacuaggggccaucaguuuuuggauguguagcaacggaucccuccagugcagaauuuguaucuga

SEQ ID NO: 132113 - RNA, 1701 nt, Artificial Sequence
  derived and/or modified sequence opt3 from hemagglutinin__InfluenzaA__AGO00277
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaucgcuccccuucagcuggguaaauguaauauugccggcuggaucuuggggaacccugagugcgaaagucuccugagcaagagguccuggucuuauauugcagagaccccaaauucggaaaacggaacauguuacccgggcgauuucgccgacuaugaggagcugcgggaacaacucucaagcgugaguuccuuugagcgcuucgaaaucuuucccaaggagcgaucuuggccuaaucauaacauaaauaucggugucaccgcugcaugcagccacgccgggaaauccucauucuacaagaacuuacuguggcuuacugagaaagauggaaguuauccaaauuugaacaagagcuacgugaauaaaaaggaaaaggagguucuggugcuauggggcguccaucaccccucuaacauugaaaaccagaaaacacucuaucguaaggagaaugcuuacguguccguaguuucaagcaacuacaauagaagguuuaccccugaaaucgccgagcggccaaaagugcgcggccaggcggggagaaugaacuauuacuggacgcugcuugagcccggagacacuauuaucuucgaagcaaaugguaaccugauagccccuugguaugcuuuugccuugaguaggggccucgggucuggaauuaucaccuccaaugcaagcauggaugagugugacacaaagugccagacuccacaaggcgcuauuaacucgucucugccguuccagaauauccaccccuuuaccaucggugaauguccuaaauacguccgguccacaaaguuacgcauggugaccgggcugcgaaacauuccaucaauacagaguagaggacucuucggcgccaucgcgggcuuuauugaagggggaugggccgguaugaucgauggcugguauggguaccaucaccagaaugaacaaggaagcggcuaugcagcugaccagaaauccacgcagaacgccauaaaugguauuacuaacaaggucaauucugugaucgagaagaugaacacacaguucaccgcuguugggaaagaguuuaacaaacuugaaaagaggauggagaaucugaacaagaaaguggaugacggcuucuuggacaucuggacuuacaaugccgaacuacugguacuccuggagaacgaacggacacuugauuuccaugacagcaaugugaagaaccuguacgagaaggucaaaaaucaauugcguaacaaugcaaaggagauuggaaacggcugcuuugaguucuaucacaaauguaauaacgagugcauggaaucagugaagaaugggaccuacgauuaucccaaauacagugaggaguccaagcucaaccgcgaaaagaucgacggaguuaaacuggagagcauggguguguaucagauuuuagccauauacucuacggucgcuucaagucuggugcuacucguaagccugggcgcgaucuccuuuuggaugugcucuaaugggucgcuucaguguagaauuugcaucuga

SEQ ID NO: 132114 - RNA, 1701 nt, Artificial Sequence; identical to SEQ ID NO: 123650
  derived and/or modified sequence opt3 from hemagglutinin__InfluenzaA__AGO00289

SEQ ID NO: 132115 - RNA, 1698 nt, Artificial Sequence
  derived and/or modified sequence opt3 from hemagglutinin__InfluenzaA__AGO00301
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaaagcuccccuucagcuggguaauuguaacaucgccggcuggguguuggggaauccugagugcgaaagucuccugagcaacagguccuggucuuauauugcagagaccccaaauucggaaaacggaacauguuacccgggcgauuucgccgacuaugaggagcugcgggaacaacucucaagcgucaguuccuuugagcgcuucgaaaucuuucccaaggagcgaucuuggccuaaucauaccacucguggugugacagcugcaugcccacacgccagaaagagcuccuucuacaaaaacuuaguuuggcugaccgaggcuaaugggucauaucccaaccuuaguaggagcuacgugaauaaccaggaaaaggaggucuuggugcuguggggaguacaucacccuucuaacauugaggaacagcgggcccuauaucgcaaagauaaugcguacguuuccguggucucaagcaacuacaauagaagguuuacgccagaaaucgcaaagcggcccaaagugcgcgaccagaguggccgaaugaacuauuacuggacucuccuggagccuggcgauaccauaaucuucgaggccacagggaaucuuauugcuccaugguaugccuuugcacugucuagaggaccggguuccggcaucauuacuagcaacgcucccuuggacgaaugugauaccaagugccaaacaccucagggggccaucaauucgucucucccauuccagaacauacaccccgugaccauuggagaguguccuaaguacgucagguccacgaaacugcggaugguuacuggcuuacguaauaucccaucagugcagagucgcggucuguuuggggcgauugccggauucaucgaaggcggcuggacagggaugauggacggaugguaugguuaccaucaccaaaacgagcagggcagcggguaugcagcugaucagaaguccacccagaaugccaucaacggaauuacuaauaaaguaaacucugugauagaaaagaugaauacacaauuuaccgcugucggcaaagaguucaacaagcucgagaaaagaauggaaaaccuuaauaagaagguggacgacgguuuuauggauaucuggacguacaacgccgagcuguugguucuacuggaaaaugagaggacccucgacuuccaugauagcaacgugaaaaaucuguacgaaaaggucaaaaaccagcuucggaauaacgcaaaggagcuggggaauggcugcuucgaguuuuaucacaaaugugacaacgaaugcauggagucagugaagaauggaacauacgauuaucccaaguacagugaagaguccaaauugaaccgagagaagauugacggcguaaaacucgaaagcauggggguuuaucgcauccuggccauauacucuacuguggcuucaaguuuaguccugcuagugagccucggagcgauuuccuucuggaugugcucuaaugguucgcugcaguguagaaucugcaucuga

SEQ ID NO: 132116 - RNA, 1701 nt, Artificial Sequence
  derived and/or modified sequence opt3 from hemagglutinin__InfluenzaA__AGO00313
augaagaccaucauugcccugagcuacauauucugccaggugcucgcucaaaaccuucccggcaaugacaacuccacagcaacucuguguuuggggcaccaugccgucccuaauggaacguuaguuaaaaccaucacaaacgaucagauugaggugacuaaugcgaccgaacugguacagucuucaaguacagguagaaucugcgacagcccacacaggauucuagauggcaagaacuguacccucaucgacgcucugcuuggggauccgcauugcgacggauuucagaaugagaaaugggaucuguucguggaacgguccaaggccuuuucuaacuguuaucccuacgacgucccugauuaugcaucguugcgcucacucguggccagcaguggcacucuggaguucauaaaugaagguuuuaacuggacagggguuacccaaaauggaggcuccuacgcuugcaaacgaggcccagacaacucuuucuuuagccgucugaauuggcucuauaaguccgagucaacguaccccguguuaaacgucacuaugccuaauaacgauaacuucgacaagcuguauaucuggggagugcaccauccaaguaccgauaaagagcagacaaaucuuuacguacaggcaagcgggagaguuacugugucuaccaagaggucccagcaaacaauuauccccaacgucgguucacggccuugggugcgcggcuugagcagugggauuucuaucuacuggaccauagugaaaccaggagacauucugcuaaucaauuccaacggcaaucucauugccccgagagguuauuuuaagaucaggacggggaaaagcucgaucaugcggucugacgcucccauuggaacuuguuccucagaaugcauaacaccuaacggcaguaucccaaaugauaagcccuuccagaacgucaauaagauuaccuacggcgccuguccuaaauauguuaagcagaacacucugaaacuugcgacagggaugcgcaaugugccagagaagcagacccgaggaaucuuuggugcaauagccggcuucauugaaaacgggugggagggaaugaucgacggcugguacgguuuuagacaccaaaauagcgaggggacgggccaggcugccgaucugaaauccacccaggcagcuaucgaccaaauuaacggaaaguugaauaggguaaucgagaaaacaaacgaaaaguuccaccagauugaaaaggaguucucugaaguggagggccggauacaggaucucgagaaauaugucgaagacacuaagaucgaucuguggagcuacaacgccgaguuacugguggcgcucgaaaaucagcauaccauugaccuuacagauucagagaugaacaaacuguuugaaaagacucgucgccaauugagagagaaugccgaggacauggggaacggaugcuucaaaaucuaucacaagugugauaaugcaugcaucgguaguauuaggaacggcaccuacgaccaugacguuuaccgggaugaagcucuaaauaaccgauuucagauaaaggggguggagcugaaauccggauauaaggacuggauccucuggauuagcuucgccaucucuugcuuucugcuuugugucgugcuguugggcuucauuaugugggcuugccagaaagguaauauccgcuguaacauaugcaucuga

SEQ ID NO: 132117 - RNA, 1704 nt, Artificial Sequence; identical to SEQ ID NO: 131113
  derived and/or modified sequence opt3 from hemagglutinin__InfluenzaA__AGO00325

SEQ ID NO: 132118 - RNA, 1698 nt, Artificial Sequence
  derived and/or modified sequence opt3 from hemagglutinin__InfluenzaA__AGO00337
augaaggccaaccugcucgugcuucugagcgcuuuggcagccgcggacgcugauaccaucugcauuggcuaccacgccaauaacuccacagacacugucgauacgguuuuagagaaaaaugugaccguaacacauucugugaaccugcuagaagacucacacaaugggaagcucuguagacugaaaggaauagcaccccuucagcuggguaagugcaacaucgccggcugguugcucgggaauccugagugugauccacugcugccggucaggaguuggagcuauauuguggaaacucccaacuccgagaauggaaucugcuacccuggcgacuucauugauuaugaagaacuccgggagcaauuaucuucgguuaguagcuuugaacgcuucgagaucuuuccaaaagaaaguuccuggcccaaccauaauaccaacggugugacagcugcauguucucacgagggaaagagcuccuucuaccgaaaucugcuuugguugaccgagaaggaagggucauauccuaaacugaagaacaguuacgucaauaaaaagggcaaagaggugcuaguacucuggggcauacaucacccacccaacagcaaggaacagcagaaccuguaucagaaugagaacgccuacguuucuguggucacuuccaauuacaaccguagauuuacaccugaaaucgcugagaggccaaaggugcgggaccaagccgggcgcaugaauuauuacuggacccuucugaaaccgggagauacgauuaucuucgaggcgaacgguaauuugauugcacccauguaugccuuugcucucucaagaggcuucgggagcggaaucauaacuucaaacgccucuaugcacgaaugcaauaccaagugucagacaccucugggcgcaauuaacuccagcuuaccauaccagaaugugcaucccgucacuaucggugagugcccuaaauauguuaggucggcuaagcugcggauggugaccgggcuccgcaacacaccaucuauucagucccgaggacuuuuuggcgccaucgcgggcuucaucgaagggggauggaccgguaugauugacggcugguacggguaucaccaucaaaaugagcagggaucaggcuacgccgcagaucagaaaaguacgcagaacgcuauaaaugguaucacuaacaagguaaacacagugauugagaaaaugaauauccaauuuaccgccgucgggaaggaguucaacaagcuggagaaaagaauggaaaauuugaacaagaaaguggacgauggcuuucuagacauauggacuuacaaugcugagcugcucguucugcuugaaaacgagaggacacuggacuuccacgauagcaaugugaagaacuuguaugaaaaagucaagucccagcucaagaauaacgccaaagagauuggaaauggcuguuucgaguuuuaccacaagugcgacaacgaauguauggagucugugcggaaugggaccuaugauuaccccaaauauagcgaagagucaaagcugaaccgugagaaaguagacggaguuaaguuagaaaguauggguaucuaccagauccuggcaauuuauuccacgguggccagcucucuaguccuccuggugucacuuggcgcuaucaguuucuggaugugcagcaauggguccuugcaaugccgcauuuguauauga

SEQ ID NO: 132119 - RNA, 1698 nt, Artificial Sequence; identical to SEQ ID NO: 125294
  derived and/or modified sequence opt3 from hemagglutinin__InfluenzaA__AGO00349

SEQ ID NO: 132120 - RNA, 1698 nt, Artificial Sequence
  derived and/or modified sequence opt3 from hemagglutinin__InfluenzaA__AGO00373
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccgaccauaacaccaauggugugacagcugcaugcucccacgaggggaagucuagcuucuaccgaaaccugcuuugguugaccgagaaggaauccucauauccuaaacugaagaauaguuacgucaacaaaaagggaaaagaggugcuaguacucuggggcauacaucacccacccaauagcaaggaacagcagaaccuguaucagaacgagaaugccuacguuucuguggucacuuccaacuacaaucguagauuuacaccugaaaucgcugagaggccaaaggugcgggaucaagccggccgcaugaacuauuacuggacccuucugaaaccgggggacacgauuaucuucgaggcgaauggaaacuugauugcacccauguaugccuuugcucucucaagagguuucggcagcgggaucauaaccaguaaugccucuaugcacgaauguaacacuaagugccagacaccucugggagcaauuaauuccagcuuaccauaccagaacauccaucccgugacuauuggcgaguguccuaaauaugucaggucggcuaagcugcggaugguuaccggucuccgcaauaucccaucuauccagucccgagggcuuuuuggagccauugcgggcuucauagaaggcggguggacaggaaugaucgaugguugguacggcuaucaccaucaaaacgagcaggggucaggauacgccgcagaccagaaaaguacccagaaugcuauuaacggcaucacgaauaaggugaacacuguaauagagaaaaugaacauucaauuuacagccguggguaaggaguucaauaagcuggagaaaagaauggaaaacuugaauaagaaagucgaugacggguuucuagacaucuggaccuacaacgcugagcugcucgugcugcuugaaaaugagaggacucuggauuuccacgacagcaacaugaagaauuuguaugaaaaaguuaagucccagcucaagaacaaugccaaagagaucggcaacggaugcuucgaguuuuaccacaagugugauaaugaaugcauggagucugugcggaacggcacauaugacuaccccaaauauagcgaagagucaaagcugaaucgugagaaagucgauggggugaaguuagaaaguaugggaauuuaccagauccuggcaauuuauuccaccguagccagcucucuaguucuccuggugucacuuggugcuauaaguuucuggaugugcagcaacggcuccuugcaaugucgcaucugcauuuga

SEQ ID NO: 132121 - RNA, 1698 nt, Artificial Sequence
  derived and/or modified sequence opt3 from hemagglutinin__InfluenzaA__AGO00385
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaagaacucagggagcaauuauccucuguuucgucauuugaacgguucgagaucuuuccaaaagaaagcaguuggcccgaccauaacaccaauggggugacagcugcaugcucccacgagggaaagucuagcuucuaccgcaaccugcuuugguugaccgagaaggaauccucauauccuaaacugaagaauaguuacgucaacaaaaagggcaaagaggugcuaguacucuggggcauacaucacccacccaauagcaaggaacagcagaaccuguaucagaacgagaaugccuacguuucuguggucacuuccaacuacaaucgacguuuuacaccugaaaucgcugagagaccaaaggugagggaucaagccgggcggaugaacuauuacuggacccuucugaaaccgggagacacgauuaucuucgaggcgaaugguaacuugauugcacccauguaugccuuugcucucucacgcggcuucgggagcggaaucauaaccaguaaugccucuaugcacgaauguaacacuaagugccagacaccucugggcgcaauuaauuccagcuuaccauaccagaacauccaucccgugacuauuggugaguguccuaaauaugucagaucggcuaagcugaggaugguuaccgggcuccggaauaucccaucuauccagucccgcggacuuuuuggcgccauugcgggcuucauagaagggggauggacagguaugaucgauggcugguacggguaucaccaucaaaacgagcagggaucaggcuacgccgcagaccagaaaaguacccagaaugcuauuaacgguaucacgaauaaggugaacacuguaauagagaaaaugaacauucaauuuacagccguggggaaggaguucaauaagcuggagaaacgaauggaaaacuugaauaagaaagucgaugacggcuuucuagacaucuggaccuacaacgcugagcugcucgugcugcuugaaaaugagagaacucuggauuuccacgacagcaacguuaagaauuuguaugaaaaagugaagucccagcucaagaacaaugccaaagagaucggaaacggcugcuucgaguuuuaccacaagugugauaaugaaugcauggagucugucaggaacgggacauaugacuaccccaaauauagcgaagagucaaagcugaaucgggagaaaguggauggaguaaaguuagaaaguauggguauuuaccagauccuggcaauuuauuccaccguugccagcucucuagugcuccuggucucacuuggcgcuauaaguuucuggaugugcagcaacggguccuugcaaugucguaucugcauuuga

SEQ ID NO: 132122 - RNA, 1698 nt, Artificial Sequence
  derived and/or modified sequence opt3 from hemagglutinin__InfluenzaA__AGO00397
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaggaacucagggagcaauuauccucuguuucgucauuugaacgguucgagaucuuuccaaaagaaagcaguuggcccgaccauaacaccaauggggugacagcugcaugcucccacgagggaaagucuagcuucuaccgcaaccugcuuugguugaccgagaaggaauccucauauccuaaacugaagaauaguuacgucaacaaaaagggcaaagaggugcuaguacucuggggcauacaucacccacccaauagcaaggaacagcagaaccuguaucagaacgagaaugccuacguuucuguggucacuuccaacuacaaucgacguuuuacaccugaaaucgcugagagaccaaaggugaaagaucaagccgggaggaugaacuauuacuggacccuucugaagccgggagacacgauuaucuucgaggcgaaugguaacuugauugcacccauguaugccuuugcucucucacggggcuucgggagcggaaucauaaccaguaaugccucuaugcacgaauguaacacuaaaugccagacaccucugggcgcaauuaauuccagcuuaccauaccagaacauccaucccgugacuauuggugaguguccuaaguauguccgcucggcuaaacugagaaugguuaccgggcucaggaauaucccaucuauccagucccggggacuuuuuggcgccauugcgggcuucauagaagggggauggacagguaugaucgauggcugguacggguaucaccaucaaaacgagcagggaucaggcuacgccgcagaccagaagaguacccagaaugcuauuaacgguaucacgaauaaagugaacacuguaauagaaaagaugaacauucaauuuacagccguggggaaggaguucaauaaacuggagaagcgcauggaaaacuugaauaaaaaggucgaugacggcuuucuagacaucuggaccuacaacgcugagcugcucgugcugcuugaaaaugagcgaacucuggauuuccacgacagcaacguuaaaaauuuguaugaaaaggugaagucccagcucaaaaacaaugccaaggagaucggaaacggcugcuucgaguuuuaccacaaaugugauaaugaaugcauggagucugucagaaacgggacauaugacuaccccaaguauagcgaagagucaaaacugaauagggagaagguggauggaguaaaguuagaaaguauggguauuuaccagauccuggcaauuuauuccaccguugccagcucucuagugcuccuggucucacuuggcgcuauaaguuucuggaugugcagcaacggguccuugcaaugucggaucugcauuuga

SEQ ID NO: 132123 - RNA, 1698 nt, Artificial Sequence
  derived and/or modified sequence opt3 from hemagglutinin__InfluenzaA__AGO00409
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaggaacucagggagcaauuauccucuguuucgucauuugaacgguucgagaucuuuccaaaagaaagcaguuggcccgaccauaacaccaauggggugacagcugcaugcucccacgagggaaagaacucuuucuaccgcaaucugcuuugguugaccgagaagaaaagcuccuauccugaacugaagaacucauacgucaauaaaaagggcaaagaggugcuaguacucuggggcauacaucacccacccaacaguaaggaacagcagaaccuguaucagaaugagaacgccuacguuagcguggucacuucuaauuacaaccgacguuuuacaccugaaaucgcugagagaccaaaggugaaagaucaagccgggaggaugaauuauuacuggacccuucugaagccgggagacacgauuaucuucgaggcgaacgguaauuugauugcacccauguaugccuuugcucucucccggggcuucgggucaggaaucauaacuagcaacgccaguaugcacgaauguaauaccaaaugccagacaccucugggcgcaauuaacucuuccuuaccauaccagaauauccaucccgugacuauuggugaguguccuaaguauguccgcagcgcuaaacugagaaugguuaccgggcucaggaacaucccaucgauccagucucggggacuuuuuggcgccauugcgggcuucauagaagggggauggacagguaugaucgauggcugguacggguaucaccaucaaaaugagcagggauccggcuacgccgcagaccagaagucaacccagaacgcuauuaaugguaucacgaacaaagugaacacuguaauagaaaagaugaauauucaauuuacagccguggggaaggaguucaacaaacuggagaagcgcauggaaaauuugaacaaaaaggucgaugacggcuuucuagacaucuggaccuacaaugcugagcugcucgugcugcuugaaaacgagcgaacucuggauuuccacgacaguaauguuaaaaacuuguaugaaaaggucaagagccagcucaaaaauaacgccaaggagaucggaaauggcugcuucgaguuuuaccacaaaugugauaacgaaugcauggaguccgugagaaaugggacauaugacuaccccaaguauucugaagagagcaaacugaacagggagaagguggauggaguaaaguuagaaucaauggguauuuaccagauccuggcaauuuauaguaccguugccuccagccuagugcuccuggucucucuuggcgcuauaucauucuggaugugcaguaaugggagcuugcaaugucggaucugcauuuga

SEQ ID NO: 132124 - RNA, 1698 nt, Artificial Sequence
  derived and/or modified sequence opt3 from hemagglutinin__InfluenzaA__AGO00421
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcaaacugaagggaauagcaccccuucagcuggguaaauguaacaucgccggcugguugcucgggaauccuggaugcgauccacugcugccggucggcucauggaguuauauuguggagacucccaacagcgaaaaugguaucuguuacccuggggacuucauugauuaugaggaacucagagagcaauuauccucuguuucgucauuugagagguucaagaucuuuccaaaggaaagcaguuggcccgaccauaacaccacaggagugaccgcugcaugcucccacgagggcaaaaauucuuucuaccggaaccugcuuugguugacuaagaaagaaagcuccuauccugagcugaagaauagcuacgucaacaaaaagcgcaaggaggugcuaguacucuggggcauacaucacccacccaauaguaaagaacagcagaaccuguaucagaacgagaaugccuacguuagcguggucacaucuaacuacaaucgacguuuuaccccugaaaucgcugagagaccaaaggugaaagggcaagccggaaggaugaacuauuacuggacgcuucugaagccgggugauacuauuaucuucgaagcgaauggcaacuugauugcacccauguaugccuuugcucucucccggggguucggaucaggcaucauaaccagcaaugccaguaugcacgaguguaacacaaaaugccagacuccucugggugcaauuaauucuuccuuaccauaccagaacauccaucccgugaccauuggggaguguccuaaguauguccgcagcgcuaaacugagaaugguuacaggacucaggaauaucccaucgauccagucucggggccuuuuuggcgccauugcgggguucauagaaggagguuggaccggcaugaucgacgggugguacggauaucaccaucaaaacgagcagggcuccgguuacgccgcagaucagaagucaacgcagaaugcuauuaacgggaucacuaauaaggugaacacaguaauagaaaagaugaacauucaauuuaccgccgugggcaaggaguucaauaaacuggaaaagcgcauggagaacuugaauaaaaaggucgacgauggauuucuagacaucuggacuuacaacgcugagcugcucgugcugcuugaaaaugagcgaacacuggacuuccacgauaguaacguuaagaauuuguaugaaaaagugaaaagccagcucaaaaacaaugccaaggagaucggcaacgggugcuucgaauuuuaccacaaaugugacaaugagugcauggaguccgucagaaacggaaccuaugauuaccccaaguauucugaagagagcaagcugaauagggaaaaaguggacgguguaaaguuagagucaaugggcauuuaccagauccuggcaauuuauaguacgguugccuccagccuagugcuccuggucucucuuggggcuauaucauucuggaugugcaguaacggaucauugcaaugucggaucugcauuuga

SEQ ID NO: 132125 - RNA, 1698 nt, Artificial Sequence
  derived and/or modified sequence opt3 from hemagglutinin__InfluenzaA__AGO00433
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggagcuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacuggagaacucauacgucaauaagaaaggcaaggaagugcuaguacucuggggcauacaucacccacccaacaguaaagagcagcagaaccuguaucagaaugaaaacgccuacguuagcguggucacuucuaauuacaaccguagauuuacaccugagaucgcugagaggccaaaggugcgggaccaagccgggcgcaugaauuauuacuggacccuucugaagccgggagauacgauuaucuucgaagcgaacgguaauuugauugcacccauguaugccuuugcucucuccagaggcuucgggucaggaaucauaacuagcaacgccaguaugcacgaguguaauaccaaaugccagacaccucugggcgcaauuaacucuuccuuaccauaccagaauauccaucccgugacuauuggugaauguccuaaguaugucaggagcgcuaaacugcggaugguuaccgggcuccgcaacaucccaucgauccagucucgaggacuuuuuggcgccauugcgggcuucauagaagggggauggacagguaugaucgacggcugguacggguaucaccaucaaaaugaacagggauccggcuacgccgcagaucagaagucaacccagaacgcuauuaaugguaucacgaacaaagugaacacuguaauagagaagaugaauauucaauuuacagccguggggaaagaguucaacaagcuggaaaagagaauggagaauuugaacaaaaaggucgacgauggcuuucuagacaucuggaccuacaaugcugaacugcucgugcugcuugagaacgaaaggacucuggacuuccacgauaguaauguuaaaaacuuguaugagaaggugaaaagccagcucaagaauaacgccaaggagaucggaaauggcugcuucgaauuuuaccacaaaugugacaacgagugcauggaauccguccggaaugggacauaugauuaccccaaguauucugaggagagcaaacugaaccgugaaaagguggacggaguaaaauuagagucaauggguauuuaccagauccuggcaauuuauaguaccguugccuccagccuagugcuccuggucucucuuggcgcuauaucauucuggaugugcaguaaugggagcuugcaaugucgcaucugcauuuga

SEQ ID NO: 132126 - RNA, 1698 nt, Artificial Sequence
  derived and/or modified sequence opt3 from hemagglutinin__InfluenzaA__AGO00445
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaggaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuacucugaaaaacucauacgucaauaagaaaggcaaggaggugcuaguacucuggggcauacaucacccacccaacaguaaagaacagcagaaccuguaucagaaugagaacgccuacguuagcguggucacaucuaauuacaaccguagauuuaccccugaaaucgcugagaggccaaaggugcgggaccaagccgggcgcaugaauuauuacuggacgcuucugaagccgggagauacuauuaucuucgaggcgaacgguaauuugauugcacccauguaugccuuugcucucuccagaggcuucgggucaggaaucauaaccagcaacgccaguaugcacgaauguaauacaaaaugccagacuccucugggcgcaauuaacucuuccuuaccauaccagaauauccaucccgugaccauuggugaguguccuaaguaugucaggagcgcuaaacugcggaugguuacagggcuccgcaacaucccaucgauccagucucgaggacuuuuuggcgccauugcgggcuucauagaagggggauggaccgguaugaucgacggcugguacggguaucaccaucaaaaugagcagggauccggcuacgccgcagaucagaagucaacgcagaacgcuauuaaugguaucacuaacaaagugaacacaguaauagaaaagaugaauauucaauuuaccgccguggggaaagaguucaacaagcuggagaagagaauggaaaauuugaacaaaaaggucgacgauggcuuucuagacaucuggacuuacaaugcugagcugcucgugcugcuugaaaacgagaggacacuggacuuccacgauaguaauguuaaaaacuuguaugaaaaggugaaaagccagcucaagaauaacgccaaggagaucggaaauggcugcuucgaguuuuaccacaaaugugacaacgaaugcauggaguccguccggaaugggaccuaugauuaccccaaguauucugaagagagcaaacugaaccgugagaagguggacggaguaaaauuagaaucaauggguauuuaccagauccuggcaauuuauaguacgguugccuccagccuagugcuccuggucucucuuggcgcuauaucauucuggaugugcaguaaugggagcuugcaaugucgcaucugcauuuga

SEQ ID NO: 132127 - RNA, 1701 nt, Artificial Sequence
  derived and/or modified sequence opt3 from hemagglutinin__InfluenzaA__AGO02696
augaaggccauccugguggucaugcucuacaccuucgcuacagcaaacgccgacacucuuugcauuggcuaucacgcgaauaacagcacggauaccguugacacagugcuggagaaaaauguaacugugacccauuccgucaacuuguuagaagauaagcacaaugggaaacuguguaagcuaagaggaguggcuccccuccaucuggguaaaugcaacauagccggcuggauccuugggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaggauuuuauaagaaucugaucuggcuggugaaaaagggcaacaguuacccaaaacucagcauaucuuauaucaaugacaagggcaaggaaguauuaguucugugggggauucaccaccccuccacgacugcugaucaacagucacuuuaccagaacgccgacaccuacguguucgucggaacaagccgcuauaguaaaaaguuuaaaccugagaucgcgauucgaccaaaggugcgugaucaggaggguagaaugaauuacuauuggacuuugguggaacccggcgacaaaaucaccuucgaggcaacagggaaccuggucguuccuagguacgccuuugcuauggaacggaacgccggaucuggcauaauuaucuccgauaccccagugcaugacugcaauacgacuugucaaacaccgaagggugcaauuaacaccagccuacccuuccagaauauccacccuaucacuauugggaaaugcccaaaguauguaaagucgacaaaacuccgccuggcuaccggacuuagaaacgugcccucuauacaguccaggggccuguuuggcgccaucgcgggguucauugagggagguuggacgggcauggucgacgggugguacggauaucaucaccagaaugaacaaggcucagguuacgccgcagauuugaagaguacccagaacgcuaucgacaaaauaacaaauaaggugaacagcguuauugagaaaaugaauacucaguuuaccgccguggggaaggaguucaaccaccucgaaaagcggaucgagaaucugaacaaaaaggucgaugacggcuucuuagauaucuggacauacaaugcugaacugcucgugcuucuggagaacgaacgcacuuuggacuaucaugauuccaauguuaaaaaccuauacgagaagguacgaaaccagcugaaaaauaacgccaaggagauuggaaauggcuguuuugaguucuaucacaagugcgacaacaccuguauggaaucugugaaaaaugggacauacgauuauccuaaguacagcgaagaggcaaaacucaacagagaagagaucgacggagucaagcuggagucaaccaggauuuaucaaauacuugccaucuacaguacugcugcguccagccugguguuggucgugucucucggugcaauuucauuuuggaugugcaguaauggcagccugcagugccggaucuguaucuga

SEQ ID NO: 132128 - RNA, 1701 nt, Artificial Sequence; identical to SEQ ID NO: 132056
  derived and/or modified sequence opt3 from hemagglutinin__InfluenzaA__AGO02697

SEQ ID NO: 132129 - RNA, 1701 nt, Artificial Sequence; identical to SEQ ID NO: 131874
  derived and/or modified sequence opt3 from hemagglutinin__InfluenzaA__AGO02698

SEQ ID NO: 132130 - RNA, 1701 nt, Artificial Sequence; identical to SEQ ID NO: 131874
  derived and/or modified sequence opt3 from hemagglutinin__InfluenzaA__AGO02699

SEQ ID NO: 132131 - RNA, 1701 nt, Artificial Sequence
  derived and/or modified sequence opt3 from hemagglutinin__InfluenzaA__AGO02700
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcaguguguccucuuucgaacgguuugagauuuucccgaagacaagcuccuggcccaaccacgacucaaauaagggugucaccgccgcuuguccucaagcaggggccaaaaguuuuuauaagaaccugaucuggcucgugaaaaagggaaauagcuacccaaaauuaucuaaguccuauauaaacgauaagggcaaagaaguacugguucuuuggggcauccaucaccccucaacgagcgcugaccagcagaguuuguaccagaaugccgaugcguacguguucgucgggacuucuaaguauuccaaaaaguuuaaaccugagauugcagugcgcccaaaggugcgagaccaagagggacguaugaacuacuauuggacccuggucgaacccggugauaaaaucacauucgaggccacuggcaaccuacucguuccuagauacgcuuuugccauggaaaggaaugcagggagcggaauuaucauaucggacaccccagugcacgauugcaacacaaccugucagacgccgaagggcgcuauuaauacuucucugcccuuccagaacauccauccuauuacaaucgguaagugcccaaaauauguaaaguccaccaaacuucggcuggccacuggguugcgcaaugugcccucaauccagaguagaggacucuuuggcgcgauugccggcuucauagaagggggauggacagguauggucgacggcugguacggguaucaccaucaaaacgcacagggaagcggcuacgcugccgaccugaaguccacccagaaugcuaucgauaaaauuacgaacaagguaaauucuguuaucgaaaagaugaacacccaguuuacagccguggguaaagaguucaaucacuuagagaagaggauagaaaaccugaauaaaaaggucgacgauggguuccucgacauuuggacuuacaacgcagagcuucugguguugcuagaaaaugagcggacccuggauuaucacgacagcaacgugaaaaaccucuacgaaaagguucgcucacaacugaagaauaacgccaaagagaucggcaauggauguuuugaguucuaucauaagugcgauaacacauguauggaaagugugaaaaauggcacuuacgacuauccucgauacuccgaggaagcuaaacuuaacagagaggaaaucgaugggauuaagcuggagagcaccaggaucuaucagauuuuggcgauauacucuacagucgcaucaagucucgugcugaucgucagcuuaggagccauuuccuuuuggaugugcucuaaugguucgcugcagugccggaucuguaucuga

SEQ ID NO: 132132 - RNA, 1701 nt, Artificial Sequence
  derived and/or modified sequence opt3 from hemagglutinin__InfluenzaA__AGO02701
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaggagcucagggagcagcugagcagugugucccacuucgaacgguuugagauuuucccgaagacaucuagcuggcccaaccaugacuccaauaagggugucaccgccgcuuguccucacgcaggggccaaaucauuuuauaagaaccugaucuggcucgugaaaaagggaaauaguuacccaaaauuaagcaagucuuauauaaacgauaagggcaaagaaguacugguucuuuggggcauccaccaucccuccacgucagcugaccaacagagcuuguaccagaaugccgaugcguacguguucgucgggacuagcaaguauucuaaaaaguuuaaaccugagauugcagugcgcccaaaggugcgagaccaggagggacguaugaacuacuauuggacccuggucgaacccggugauaaaaucacauucgaggccacuggcaaccuacucguuccuagauacgcuuuugccauggaaaggaaugcaggguccggaauuaucauaagcgacaccccagugcacgauugcaacacaaccugucaaacgccgaagggcgcuauuaauacuucgcugcccuuccagaacauccauccuauuacaaucgguaagugcccaaaauauguaaagucuaccaaacuucggcuggccacuggguugcgcaaugugcccuccauccagucaagaggacucuuuggcgcgauugccggcuucauagaagggggauggacagguauggucgacggcugguacggguaucaccaccagaacggacaaggcagugguuacgcagcugacuuaaagagcacccagaaugccaucgauaaaauuacgaacaagguaaauuccguuaucgaaaagaugaacacccaguuuacagcuguggggaaagaguucaaucaucuggagaagaggauagaaaaccugaauaaaaaggucgacgauggcuuccucgacauuuggacuuacaacgccgagcuucugguguugcuagaaaaugagcggacccuggauuaucacgacucuaacgugaaaaaccucuacgaaaagguucgcagccagcugaagaauaacgcaaaagagaucggaaauggcuguuuugaguucuaucauaagugcgauaacacauguauggaaucagugaaaaaugggacuuacgacuauccuaaguacagugaggaagccaaacuuaaccgagaggaaaucgauggagucaagcuggaguccaccagaauuuaucaaaucuuggcuauuuacagcacaguggcgucuucacucguccuggugguuaguuuaggugcaauaaguuuuuggaugugcuccaauggcucucugcagugcaggaucuguauuuga

SEQ ID NO: 132133 - RNA, 1683 nt, Artificial Sequence; identical to SEQ ID NO: 132004
  derived and/or modified sequence opt3 from hemagglutinin__InfluenzaA__AGO51374

SEQ ID NO: 132134 - RNA, 1701 nt, Artificial Sequence
  derived and/or modified sequence opt3 from hemagglutinin__InfluenzaA__AGO86686
augaagaccaucauugcccugagcuacauacucugccuugcuuucgcacagaaacugcccggcaacgacaauuccacagccacuuuguguuuagggcaccaugcggugccuaacggaacgcuggucaagaccaucacaaaugaucaaauugagguuacuaacgcuaccgagcuagugcagucuucaaguacagguagaaucugcgacagcccacaccagauucucgauggcgaaaauuguacccugaucgacgcccuucugggggauccgcauugcgacggauuucagaacaaagaaugggauuuguucguagagagguccaaggcauauucuaauuguuaccccuaugacgugccugauuacgccucgcuccggucacuggucgcuagcaguggcacucuggaauuuaacaaugaguccuucaacuggacagguguggcacaaaaugggaccucuagcgccugcaaacgccgauccauaaagucauuuuucagucgucucaacugguuacaccagcuggagaauagauauccagcucuuaacguuacgaugcccaauaacgacaaguuugauaaauuguacaucuggggagugcaucacccuagcacugacucugaucagauuuccgucuaugcccaggcgucaggcagggugaccguaagcacaaagcggagucaacagacuguuaucccaaacauuggcucucgccccugggugagagggaucuccagcaggauaucgauuuacuggaccaucgucaaaccuggagacauucugcuaaucaauucuacagguaaccucaucgcaccacggggcuacuucaagauucgcuccgggaaaucaaguauaaugcgaagcgacgccccgaucggaaaguguaauuccgaaugcauuacccccaacggcucuaucccuaaugauaagccauuucagaacgugaauagaauaacguauggugcuugucccagguacgugaaacagaacacucugaaacuugccacagggaugcggaaugucccugagaaacaaacccguggaauuuucggcgcaaucgcuggcuuuaucgaaaacgggugggagggaaugauggacgguugguauggcuuccgccaccagaauagcgaggggacuggacaggccgcggaucugaagucaacacaagccgcaauuaaccagaucaauggcaaauugaacaagcucauugaaaagaccaaugagaaguuucaucagauagaaaaggaguucagugaaguugaggguagaauccaggaccuggagaaauacguggaagauacgaagauugacuuaugguccuauaacgcugagcugcucguagcccuugaaaaccaacacaccaucgaucugacagacagcgagaugaauaaauuguucgaaaggacucggaagcagcuacgagagaacgcugaggauauggggaauggcugcuuuaaaaccuaccauaagugugacaacgccugcaucggaucuauucgcaauggcacauaugaucacgacguguacagagacgaagcacugaacaauagguuccagauaaagggggucgagcucaaaucaggauacaaggauuggauccuguggauuaguuuugccaucagcugcuuccuucugugugugguuuugcucgguuuuauuaugugggcuugccagaaaggcaacauccgguguaauauaugcaucuga

SEQ ID NO: 132135 - RNA, 1701 nt, Artificial Sequence; identical to SEQ ID NO: 132056
  derived and/or modified sequence opt3 from hemagglutinin__InfluenzaA__AGQ16240

SEQ ID NO: 132136 - RNA, 1701 nt, Artificial Sequence; identical to SEQ ID NO: 132056
  derived and/or modified sequence opt3 from hemagglutinin__InfluenzaA__AGQ16241

SEQ ID NO: 132137 - RNA, 1701 nt, Artificial Sequence
  derived and/or modified sequence opt3 from hemagglutinin__InfluenzaA__AGQ16242
augaaggccauccuggugguccuccuuuacaccuucgcuacagcaaacgccgacacucugugcauuggcuaucacgcgaauaacagcacggauaccguugacacaguguuggagaagaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuacguccuauauaaacgauaagggcaaggaaauccugguacuuuggggcauucaccaccccucaacuaccgcugaccaacagagcuuguaccagaaugccgaugcguacguuuucguggggacaagucgcuauucuaaaaaguuuaaaccugagaucgcaauucgaccaaagguccgugaccaggagggaagaaugaacuacuauuggacucugguggaacccggugauaaaaucaccuucgaggccacaggcaaccuaguggucccuagguacgcuuuugccauggaacggaaugcaggguccggaauaauuaucagcgacaccccaguucaugauugcaacacgacuugucaaacaccggagggcgcuauuaauaccucgcuccccuuccagaacauccacccuaucacuauugguaagugcccaaaauaugugaagucuacaaagcugcgccuugccaccgggcugagaaauguacccuccauacagucaaggggauuguuuggcgcgaucgccggcuucauugaagggggauggacggguaugguggacggcugguacggguaucaucaccagaacgagcaaggaaguggcuacgcagcugaccucaaaagcacccagaaugccaucgauaagauaacaaacaaagucaauuccgugauugagaagaugaacacucaguuuaccgcuguugguaaagaguucaaucaccuggagaagcggaucgaaaacuuaaauaagaaaguggacgauggguuccuggacaucuggacauacaacgccgagcuccuuguccuguuggaaaaugagcgcacucuagauuaucaugacucuaacgugaagaaccuguacgagaaaguacgaaaucagcucaagaacaaugcaaaagaaauuggcaacggauguuuugaguucuaucacaagugcgauaauaccuguauggaaagcguuaagaacggcacauacgacuauccuaaauacucagaggaagccaagcugaauagagagaaaaucgauggggugaaacuugagaguaccaggauuuaucaaauacuggcuaucuacuccacugucgcgagcucuuuggugcucgucgugucacugggagcaauuaguuuuuggaugugcagcaacgguuccuuacagugccggaucuguaucuga

SEQ ID NO: 132138 - RNA, 1701 nt, Artificial Sequence; identical to SEQ ID NO: 132076
  derived and/or modified sequence opt3 from hemagglutinin__InfluenzaA__AGQ16243

SEQ ID NO: 132139 - RNA, 1701 nt, Artificial Sequence
  derived and/or modified sequence opt3 from hemagglutinin__InfluenzaA__AGQ16245
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaaugaacuacuauuggacacugauugaacccggugauaagaucacuuucgaggccaccggcaaccuaguggucccuagguacgcuuuugccauggaacggaaugcaggguccggaauaauuaucagcgacacaccaguucaugauugcaacaccacgugucaaacuccggagggcgcuauuaauacaucgcuccccuuccagaacauccacccuaucaccauugguaaaugcccaaaguaugugaagucuacuaaacugcgccuugccacagggcugagaaauguacccuccauacagucaaggggauuguuuggcgcgaucgccggcuucauugaagggggauggaccgguaugguggacggcugguacggguaucaucaccagaacgagcaaggaaguggcuacgcagcugaccucaagagcacgcagaaugccaucgauaaaauaaccaacaaggucaauuccgugauugagaaaaugaacacacaguuuacugcuguugguaaggaguucaaucaccuggagaagcggaucgaaaacuuaaauaaaaagguggacgauggguuccuggacaucuggaccuacaacgccgagcuccuuguccuguuggaaaaugagcgcacacuagauuaucaugacucuaacgugaaaaaccuguacgagaagguacgaaaucagcucaaaaacaaugcaaaggaaauuggcaacggauguuuugaguucuaucacaagugcgauaauacuuguauggaaagcguuaaaaacggcaccuacgacuauccuaaguacucagaggaagccaaacugaauagagagaagaucgauggggugaaacuugagaguacaaggauuuaucaaauacuggcuaucuacuccaccgucgcgagcucuuuggugcucgucgugucacugggagcaauuaguuuuuggaugugcagcaacgguuccuuacagugccggaucuguaucuga

SEQ ID NO: 132140 - RNA, 1701 nt, Artificial Sequence; identical to SEQ ID NO: 132076
  derived and/or modified sequence opt3 from hemagglutinin__InfluenzaA__AGQ16247

SEQ ID NO: 132141 - RNA, 1701 nt, Artificial Sequence
  derived and/or modified sequence opt3 from hemagglutinin__InfluenzaA__AGQ16248
augcaggccauccuggugguccuccuuuacaccuucgcuacagcaacugccgacacgcugugcauuggcuaucacgcgaacaauagcaccgauacaguugacacuguguuggagaagaacguaaccgugacacauuccgucaauuuacuggaagauaaacacaacgggaagcuauguaaacucagaggaguggcuccccugcaucuugguaagugcaauauagccggcuggauccuggggaacccugagugugaaucuuugucaaccgcaaguagcugguccuacauuguugagacuucuucgucagacaauggaacaugcuauccaggcgauuuuaucaacuacgaagaacucagggagcaacugagcaguguguccucuuucgaacgguuugagauuuucccgaaaaccagcuccuggcccaaucacgacucaaacaagggugucacggccgcuuguccucaugcaggggccaagaguuuuuauaaaaaucugaucuggcucgugaagaaaggaaacagcuacccaaaguuaucucaguccuauauaaaugauaaaggcaaggaaguacugguucuuuggggcauccaccaccccucaacuaccgcugaccagcagagcuuguaccaaaacgccgaugcguacguguucgucgggacaagucgcuauucuaagaaauuuaagccugagauugcaauccgaccaaaagugcgugaccaggagggaagaaugaauuacuauuggacucugguggaacccggugauaagauuaccuucgaggccacaggcaaccuagucguuccuagguacgcuuuuaccauggaacggaacgccggguccggaaucauaauuagcgacacgccaauccaugauugcaauacuacaugucagaccccggagggcgcaauuaacacuucgcuccccuuccagaauauccacccuaucacaauugguaaaugcccaaaguaugugaaaucuaccaagcugcgccuugcuacggggcugagaaacguacccuccauacaaucaaggggauuguuuggcgccaucgcgggcuucauugaagggggauggaccgguaugguggacggcugguacggguaucaucaccagaaugagcagggaaguggcuacgccgcagaccucaagagcacacagaacgcuaucgauaaaauaacuaauaaggucaacuccgugauugagaaaaugaauacccaauuuacagccguugguaaggaguucaaccaccuggagaaacggaucgaaaauuuaaacaagaagguggacgauggguuccuggacaucuggacuuacaaugcugagcuccuuguccuguuggaaaacgagcgcacccuagauuaucaugacucuaaugugaaaaaccuguacgagaagguacgaaaccagcucaaaaauaacgccaaggaaauuggcaauggauguuuugaguucuaucacaaaugcgauaacacauguauggaaagcguuaagaauggcaccuacgacuauccuaaguacucagaggaagcaaaacugaacagagagaagaucgauggggugaaacuugagaguacuaggauuuaucagauacuggccaucuacuccacggucgcuagcucuuuggugcucgucgugucacugggagcgauuaguuuuuggaugugcagcaaugguuccuuacaaugccggaucuguaucuga

SEQ ID NO: 132142 - RNA, 1701 nt, Artificial Sequence; identical to SEQ ID NO: 131874
  derived and/or modified sequence opt3 from hemagglutinin__InfluenzaA__AGQ16329

SEQ ID NO: 132143 - RNA, 1701 nt, Artificial Sequence; identical to SEQ ID NO: 131899
  derived and/or modified sequence opt3 from hemagglutinin__InfluenzaA__AGQ16331

SEQ ID NO: 132144 - RNA, 1701 nt, Artificial Sequence; identical to SEQ ID NO: 131874
  derived and/or modified sequence opt3 from hemagglutinin__InfluenzaA__AGQ16332

SEQ ID NO: 132145 - RNA, 1701 nt, Artificial Sequence; identical to SEQ ID NO: 131874
  derived and/or modified sequence opt3 from hemagglutinin__InfluenzaA__AGQ16333

SEQ ID NO: 132146 - RNA, 1701 nt, Artificial Sequence
  derived and/or modified sequence opt3 from hemagglutinin__InfluenzaA__AGQ16335
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccaggugcuagauggcgaaaacuguacacucauagacgcucugcuuggggauccgcagugcgacggauuucagaauaaaaagugggaucuguucgucgagaggagcaaagccuauuccaacuguuaccccuaugacgugccugauuacgcaucuuugcggucgcucguugccucaagcggcacccuggaauuuaauaacgagaguuucaauuggacuggugugacacaaaacgggaccuccucugcuugcauccgccgaagcaauuccucauuuuucagucgucugaacuggcucacgcauuuaaauuuuaaguauccagcacugaacgucacuaugcccaacaaugagcaguucgacaaacuuuacauuuggggagugcaccauccuggcaccgauaaagaccagaucuuuuuguaugcccagagcucuggcagaauuacaguauccacuaagaggucacaacaggcuguuaucccaaacauagggagccggccccgcauuagaaauaucccuaguaggauuucuaucuacuggaccaucgugaaaccaggagauauucugcuaauaaacuccacagguaaucucaucgccccgcggggcuacuucaagauucgcagcgggaaaucgucuaucaugcgauccgacgcgcccauaggaaaguguaagucagaaugcauuaccccuaacggcaguaucccaaaugacaaacccuuucagaacgucaauagaaucacguauggugcauguccuagguacgugaagcagaacacucugaaacuugccacagggaugcggaaugugccagagaagcaaacccguggaauuuucggcgcuaucgccggcuuuauugaaaacgggugggagggaauggucgaugguugguauggcuuccgccaccagaauagcgaggggagaggacaggcagcugaccugaaauccacucaagccgcgauagaucagaucaacggcaaguugaauaggcucauugguaaaacaaacgaaaaguuccaccagaucgagaaggaauuuucugagguugaagggcggauccaggaccuggagaaauacguggaggauaccaagauugacuuauggagcuauaacgccgaacugcucguagcacuugagaaucaacauacgauagaucugaccgacucagaaaugaacaaauuguucgagaagacaaagaagcagcuacgagaaaaugcugaggauaugggcaacggaugcuuuaagaucuaccacaaaugugacaaugccugcauuggcaguauccgcaacgggacuuaugaucaugacguguacagagacgaggcucugaauaacagguuccagauuaagggagucgaacucaaauccgguuacaaggauuggauccuguggaucagcuuugccauaucuugcuuccuucuguguguggcauugcucggcuuuauuaugugggccugccagaaagggaauauccgguguaacauuugcaucuga

SEQ ID NO: 132147 - RNA, 1701 nt, Artificial Sequence
  derived and/or modified sequence opt3 from hemagglutinin__InfluenzaA__AGQ16336
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaaucguuccuuuuucucaagacugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagaguagcggcaggauuacagugucuacuaagcggucccaacaggcuguaauaccaaacauugggucacgccccagaaucaggaauauuccuagccggaucaguaucuacuggaccauuguuaaaccaggagauauacugcuaaucaacucuacagguaaucucauugccccgcgcggcuacuucaagauccgauccgggaaaagcucgauaaugagaucugacgcgcccauuggaaaguguaaguccgaaugcaucaccccuaacggcucaaucccaaaugacaaacccuuucagaacgugaauaggauuacguauggugcauguccucgguacgucaagcagaguacucugaaacuugccacagggaugcguaacgugccagagaagcaaacccgcggaaucuucggcgcuauugccggcuuuauagaaaaugggugggagggaaugguggaugguugguauggcuucagacaccagaacagcgaggggaggggacaggcagcugaccugaaauccacucaagccgcgaucgaucagauuaauggcaaguugaaccggcucaucgguaaaacaaaugaaaaguuccaccagaucgagaaggaauuuucugaggucgaagggcgcauucaggaccuggagaaauacguugaggauaccaagauagacuuauggagcuauaacgccgaacugcucguggcacuugagaaccaacauacgaucgaucugaccgacucagaaaugaauaaauuguucgagaagacaaagaagcagcuacgagaaaacgcugaggauaugggcaauggaugcuuuaagauuuaccacaaaugugacaacgccugcaucggcaguauuagaaaugggacuuaugaucaugacguauacagggacgaggcucugaacaaucgguuccagaucaagggaguggaacucaaauccgguuacaaggauuggauacuguggaucagcuuugccauuucuugcuuccuucugugugucgcauugcucggcuuuaucaugugggccugccagaaagggaacauucgcuguaauaucugcauauga

SEQ ID NO: 132148 - RNA, 1701 nt, Artificial Sequence; identical to SEQ ID NO: 132146
  derived and/or modified sequence opt3 from hemagglutinin__InfluenzaA__AGQ16337

SEQ ID NO: 132149 - RNA, 1701 nt, Artificial Sequence; identical to SEQ ID NO: 131884
  derived and/or modified sequence opt3 from hemagglutinin__InfluenzaA__AGQ16338

SEQ ID NO: 132150 - RNA, 1701 nt, Artificial Sequence
  derived and/or modified sequence opt3 from hemagglutinin__InfluenzaA__AGQ16339
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcaauauuccuaguagaaucucuaucuacuggacuauuguuaaaccaggugauauacugcuaaucaacuccaccggcaaucucauugcgccgaggggguacuucaagauccggagcggaaaaucgucuauaaugcgcuccgacgcacccauuggcaaguguaagucagaaugcaucacaccuaacgguaguaucccaaaugacaaacccuuucagaacgugaaucgaauuaccuauggggccuguccuagauacgucaagcagagcacgcugaaacuugcuacuggaaugaggaacgugccagagaagcaaacacggggcaucuucggcgccauugcaggguuuauagaaaauggaugggaggguaugauggauggcugguauggguuccgucaccagaacuccgagggacgcggccaggcugccgaccugaaaucuacccaagcggccaucgaucagauuaaugguaaguugaacagacucaucgggaaaacuaaugaaaaguuccaccagaucgagaaggaauuuagcgagguggaaggcaggauucaggaccuggagaaauacgucgaggauacaaagauagacuuauggucauauaacgcagaacugcucguugcucuugagaaccaacauaccaucgaucugacggacagugaaaugaauaaauuguucgagaagaccaaaaagcagcuacgggaaaacgccgaggauaugggaaauggcugcuuuaagauuuaccacaaaugugacaacgcuugcaucggguccauucgaaauggaacauaugaucaugacguguaccgcgacgaggcccugaacaauagauuccagaucaaggguguagaacucaaaagcggcuacaagaacuggauacuguggaucucuuuugcaauuucaugcuuccuucuguguguggccuugcucggguuuaucaugugggcuugccagaaaggaaauauuagguguaacaucugcauauga

SEQ ID NO: 132151 - RNA, 1701 nt, Artificial Sequence; identical to SEQ ID NO: 132010
  derived and/or modified sequence opt3 from hemagglutinin__InfluenzaA__AGQ16340

SEQ ID NO: 132152 - RNA, 1701 nt, Artificial Sequence; identical to SEQ ID NO: 131874
  derived and/or modified sequence opt3 from hemagglutinin__InfluenzaA__AGQ16341

SEQ ID NO: 132153 - RNA, 1701 nt, Artificial Sequence; identical to SEQ ID NO: 131884
  derived and/or modified sequence opt3 from hemagglutinin__InfluenzaA__AGQ16342

SEQ ID NO: 132154 - RNA, 1701 nt, Artificial Sequence
  derived and/or modified sequence opt3 from hemagglutinin__InfluenzaA__AGQ16343
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauugggcugguguuacucaaaacgggacauccucugcaugcauucgcggaagcaauuccucauuuuucagucgacugaacuggcucacccauuuaaauuuuaaguauccagcccugaacgugacgaugcccaacaaugagcaguucgacaaguuguacaucuggggcguccaccauccuggcacugauaaagaccagauuuuucuuuaugcucagagcucugggcguaucaccguguccacaaagagaucacaacaggccguaauaccaaacauuggaagcaggccccggauccgcgauauuccuaguagaaucucuaucuacuggacuauuguuaaaccaggugacauacugcuaaucaauuccaccggcaaccucauugcgccgaggggguacuucaagauccggagcggaaaaucgucuauaaugcgcuccgacgcacccauuggcaaguguaagucagaaugcaucacaccuaaugguaguaucccaaacgauaaacccuuucagaaugugaaccgaauuaccuauggggccuguccuagauacgucaagcagagcacgcugaaacuugcuacuggaaugaggaaugugccagagaagcaaacacggggcaucuucggcgccauugcaggguuuauagaaaacggaugggaggguaugguggacggcugguauggguuccgucaccaaaauuccgagggacgcggccaggcugccgaucugaaaucuacccaggcggccaucgaccagauuaacgguaaguugaauagacucaucgggaaaacuaacgaaaaguuccaccagaucgagaaggaauuuagcgaggucgaaggcaggauucaggaucuggagaaauacguugaggacacaaagauagauuuauggucauauaaugcagaacugcucguggcucuugagaaccaacauaccaucgaccugacggauagugaaaugaacaaauuguucgagaagaccaaaaagcagcuacgggaaaaugccgaggacaugggaaacggcugcuuuaagauuuaccacaaaugugauaaugcuugcaucggguccauucgaaacggaacauaugaccaugacguauaccgcgaugaggcccugaauaacagauuccagaucaaggguguggaacucaaaagcggcuacaaggacuggauacuguggaucucuuuugcaauuucaugcuuccuucugugugucgccuugcucggguuuaucaugugggcuugccagaaaggaaauauuagguguaacaucugcauauga

SEQ ID NO: 132155 - RNA, 1701 nt, Artificial Sequence; identical to SEQ ID NO: 131884
  derived and/or modified sequence opt3 from hemagglutinin__InfluenzaA__AGQ16344

SEQ ID NO: 132156 - RNA, 1701 nt, Artificial Sequence; identical to SEQ ID NO: 131874
  derived and/or modified sequence opt3 from hemagglutinin__InfluenzaA__AGQ16345

SEQ ID NO: 132157 - RNA, 1701 nt, Artificial Sequence
  derived and/or modified sequence opt3 from hemagglutinin__InfluenzaA__AGQ16346
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaguuguacaucuggggaguccaccauccuggcaccgauaaagaccagauuuuucuuuaugcccagagcucuggcagaaucacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguagaucagaaugcaucaccccuaacggcaguaucccaaaugacaagcccuuucagaacgugaauaggauuacguauggugcauguccucgguacgucaaacagagcacucugaaacuugccacagggaugcguaacgugccagagaagcaaacccgcggaaucuucggcgcuauugccggcuuuauagaaaaugggugggagggaaugguggaugguugguauggcuucagacaccagaacuccgaggggaggggacaggcagcugaccugaagucuacucaagccgcgaucgaucagauuaauggcaaauugaaccggcucaucgguaagacaaaugaaaaauuccaccagaucgagaaggaauuuagcgaggucgaagggcgcauucaggaccuggagaaguacguugaggauaccaaaauagacuuauggucauauaacgccgaacugcucguggcacuugagaaccaacauacgaucgaucugaccgacagugaaaugaauaaguuguucgagaaaacaaagaaacagcuacgagaaaacgcugaggauaugggcaauggaugcuuuaagauuuaccacaagugugacaacgccugcaucggcuccauuagaaaugggacuuaugaucauaacguauacagggacgaggcucugaauaaccgguuccagaucaaaggaguggaacucaagagcgguuacaaagacuggauacuguggaucucuuuugccauuucaugcuuccuucugugugucgcauugcucggcuuuaucaugugggccugccagaaggggaauauucgcuguaacaucugcauauga

SEQ ID NO: 132158 - RNA, 1701 nt, Artificial Sequence; identical to SEQ ID NO: 131874
  derived and/or modified sequence opt3 from hemagglutinin__InfluenzaA__AGQ16347

SEQ ID NO: 132159 - RNA, 1701 nt, Artificial Sequence; identical to SEQ ID NO: 132010
  derived and/or modified sequence opt3 from hemagglutinin__InfluenzaA__AGQ16348

SEQ ID NO: 132160 - RNA, 1701 nt, Artificial Sequence; identical to SEQ ID NO: 131874
  derived and/or modified sequence opt3 from hemagglutinin__InfluenzaA__AGQ16349

SEQ ID NO: 132161 - RNA, 1701 nt, Artificial Sequence
  derived and/or modified sequence opt3 from hemagglutinin__InfluenzaA__AGQ16350
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacggauuucagaauaaaaagugggaucuguucguggagaggagcaaagccuauuccaacuguuaccccuaugacgucccugauuacgcaucuuugcggucgcucguggccucaagcggcacccuggaauuuaauaacgagaguuucaauuggacugguguuacacaaaacgggaccuccucugcuugcauucgccgaagcaauuccucauuuuucagucgucugaacuggcucacgcauuuaaauuuuaaguauccagcacugaacgugacuaugcccaacaaugagcaguucgacaaacuuuacaucuggggaguccaccauccuggcaccgauaaagaccagaucuuuuuguaugcccagagcucuggcagaauuacaguguccacuaagaggucacaacaggcuguaauaccaaacauugggagccggccccgcaucagaaauauuccuaguaggaucucuaucuacuggaccauuguuaaaccaggagauauacugcuaaucaacuccacagguaaucucauugccccgcggggcuacuucaagauccgcagcgggaaaucgucuauaaugcgauccgacgcgcccauuggaaaguguaagucagaaugcaucaccccuaacggcaguaucccaaaugacaaacccuuucagaacgugaauagaauuacguauggugcauguccuagguacgucaagcagagcacucugaaacuugccacagggaugcggaacgugccagagaagcaaacccguggaaucuucggcgcuauugccggcuuuauagaaaaugggugggagggaaugguggaugguugguauggcuuccgccaccagaacuccgaggggagaggacaggcagcugaccugaaaucuacucaagccgcgaucgaucagauuaauggcaaguugaacaggcucaucgguaaaacaaaugaaaaguuccaccagaucgagaaggaauuuagcgaggucgaagggcggauucaggaccuggagaaauacguugaggauaccaagauagacuuauggucauauaacgccgaacugcucguggcacuugagaaccaacauacgaucgaucugaccgacagugaaaugaauaaauuguucgagaagacaaagaagcagcuacgagaaaacgcugaggauaugggcaauggaugcuuuaagauuuaccacaaaugugacaacgccugcaucggcuccauucgcaaugggacuuaugaucauaacguauacagagacgaggcucugaauaacagguuccagaucaagggaguggaacucaaaagcgguuacaaggacuggauacuguggaucucuuuugccauuucaugcuuccuucugugugucgcauugcucggcuuuaucauguggaccugccagaaagggaauauucgguguaacaucugcauauga

SEQ ID NO: 132162 - RNA, 1701 nt, Artificial Sequence
  derived and/or modified sequence opt3 from hemagglutinin__InfluenzaA__AGQ47719
augaaggccauccugcucgugcuucugugcaccuucacagcuacuaacgcagacacguuguguauuggcuaccacgccaauaacagcaccgauacagucgacacuguuuuagagaaaaaugugaccguaacacauuccgugaaccugcuagaagauagacacaaugggaagcucugcaaacugggagguauagcgccccuucaucugggcaaguguaacaucgcugggugguugcucggaaauccugagugcgaacugcuguuuaccgucucuucauggaguuauauuguggagacuagcaacuccgacaauggcacauguuacccaggugauuucaucaacuaugaggaacucagggagcaguuaucuucgguuagcucauuugaacgguucgagauuuuuccgaaaaccaguuccuggcccgaccacgaaacgaaucgcggggugacugccgcaugcccuuacgccggagcuaacucuuucuaucgaaaucugaucuggcuugucaagaagggcaacagcuacccaaaauuguccaagucauaugugaauaacaaaggcaaggagguacugguucuaugggggauacaucaucccccuaccaguacagaucaacagagccucuaccagaacgcagacgccuacguguuugucggaucuuccaaauauaaucguaaguucaagccagagaucgcugccagacccaaagugaggggucaggcgggccggaugaacuacuauuggacucugauugaaccuggggauaccaucacauuugaggcaaccggaaaucuuguggucccacgcuacgccuucgcuaugaacagaggcucagguagcgggauuaucauaagugacgccccgauucacgauuguaauacgaagugccaaacucccaaaggagcaaucaacacaucucugccuuuucagaauauucacccaguuaccaucggcgaaugucccaaguaugugaaauccacuaaguugaggauggcuacaggccuccggaacaucccuagcauucagucgcgcgggcuguucggagccauagcggguuuuaucgagggcggguggaccggaaugauugacggcugguacgguuaucaccaucagaaugggcaaggcucuggauacgccgcagaucagaaauccacgcagaacgcuaucgacggcauaaccaauaagguaaacucagugauugaaaagaugaauacacaguucacugccgucgggaaagaguucaaccacuuagagaagcgaaucgaaaaucugaacaaaaagguggacgauggauuucucgacguuuggaccuacaacgcugagcuucugguguugcuagaaaaugagagaacacuggauuuccacgacaguaacgucaaaaaucucuaugaaaaggugaggagccaacugcggaacaaugccaaggagaucgguaacggcugcuuugaguucuaccauaaaugugaugacacuugcauggaauccguaaagaaugggaccuaugauuacccaaaauauucugaggaaagcaaacuuaaccgugaggaaauugacggaguuaagcuggagucaacacgcaucuaccagauuuuggcaauauauaguaccgccgcuuccagccucgugcuguuagucucucugggcgcgaucucauuuuggaugugcaguaaugguagccuacaguguagaauuugcaucuga

SEQ ID NO: 132163 - RNA, 1698 nt, Artificial Sequence; identical to SEQ ID NO: 124131
  derived and/or modified sequence opt3 from hemagglutinin__InfluenzaA__AGQ47728

SEQ ID NO: 132164 - RNA, 1701 nt, Artificial Sequence
  derived and/or modified sequence opt3 from hemagglutinin__InfluenzaA__AGQ47740
augaaggccagacugcucgugcuucugugcgcuuuggcagccaccgacgcggauacaaucuguauuggcuaccacgcuaacaauagcacugacacggucgauaccuuacuggagaaaaacguuacagugacucauuccguaaaucuacucgaagacucucacaacgggaagcugugcaaacuuaagggaauagccccgcugcaguuggguaaauguaauaucgcaggcuggcuccuggggaacccugagugcgauucacugcucccagccaggaguuggagcuauauuguggaaacccccaauuccgagaacggagcuuguuaccccggcgacuucaucgauuaugaagaguuacgggagcaacugucuucggucucaagccuugaacgcuuugagauuuucccuaaggaaaguuccuggccaaaucauaacacaaucaagggugugaccgcaucuugcagccaccgagggcaguccucauuuuaccguaauuugcuguggcuaacuaaaaagggagacaguuaucccaaacucaacaauagcuacguuaacaauaagggcaaagaggugcugguccuuuggggcgugcaucacccuucuuccucaaacgagcagcagagccuguauagaaacgaaaaugccuacguaaguguugugucuuccaacuacaauaggcgguucacaccagagauagcugcccgccccaaggucagagaucaaaccgggaggaugaacuauuacuggacguugcucgaaccuggagacacuaucauguuugaggcgaccgguaaucugauugcaccaugguaugccuucgcuuuaagccggggcuuugggucgggaaucauuacaucuaacgccuccaugcacgaauguaauacuaagugccagaccccgcagggcgcaaucaacucaagucugcccuuccagaauauacauccugugacaauuggugaguguccaaaauacgugcgcagcaccaagcuccgaauggucacggggcuuagaaacauccccuccauucaaucuaggggacuguuuggcgcuaucgccggcuucaucgaagggggauggacugguaugauugauggcugguauggguaccaccaucagaaugaacagggaagcggcuaugcggccgaccagaaaucaacacaaaacgcaauaaaugguaucaccaacaagguuaauagugugauugagaaaaugaacacucaguuuacagcuguagggaaggaguucaacaauuuggagaaacggauggaaaaccuaaauaagaagguggaugacggcuuucuggacaucuggaccuacaacgccgagcuccugguccuucuggagaaugaacguacguuggauuuccacgaccucaacgugaaaaaucuguacgagaagguuaaaucccaguuaaagaacaaugcuaaagaaauaggaaacggcugcuucgaguuuuaucacaagugugauaaugaaugcauggagagcgugcgcaacgggaccuacgacuauccuaaguacucugaggaaucaaaacugaauagagagaagauugauggagucaaacuagaaaguauggguguguaucaaauccucgccaucuacagcacaguagcauccucucugguucuuuuggugucgcugggcgccauuagcuucuggaugugcuccaacgggucacuccaguguaggaucugcauuuga

SEQ ID NO: 132165 - RNA, 1701 nt, Artificial Sequence
  derived and/or modified sequence opt3 from hemagglutinin__InfluenzaA__AGQ47752
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaaagcuccccuucagcuggguaaguguaauaucgccggcuggguguuggggaacccugagugcgaaagucuccugagcaauagguccuggucuuauauugcagagaccccaaacucggaaaauggaaucuguuacccgggcgauuucgccgacuaugaggagcugcgggaacaacucucaagcgucaguuccuuugagcgcuucgaaauuuuucccaaggagcgaucuuggccuaaacauaacacaauccguggugugaccgcugcaugcagccacgccgggaaguccucauucuacaaaaauuuaguuuggcugacugaggcuaacggaaguuauccagcccuuagcacaucuuacgugaauaaccaggaaaaggaggucuuggugcuguggggcguacaucaccccuccaauauagaggaacagagaacccuauauaggaaagauaacgcguacguuucaguggucagcaguaacuacaaucggcgcuuuacgccugaaaucgcaaagagaccaaaggugagggaccagcccggccggaugaacuauuacuggacucuccuggagccuggggauaccauuaucuucgaggccacaggaaaucuuauugcuccaugguaugccuuugcacugucucgcgguccgggcuccgggaucauaacuagcaacgcucccauggacgaaugugauaccaaaugccaaacaccucagggagccauuaauucgucuuugccauuccagaacauccaccccgugaccauuggcgaguguccuaaguacguccgauccacgaaacucagaaugguuacuggucugaggaauaucccaucaauccagagucggggguuauuuggagcgauugccggcuucauagaaggcggguggacaggaaugauggacgguugguauggcuaccaucaccaaaacgagcaggggagcggauaugcagcugaucagaaguccacccagaaugccaucaacggcauuacuaauaaagugaacucuguaaucgaaaagaugaauacacaauuuaccgcuguggguaaagaguucaacaagcuggagaagcguauggaaaaucucaacaaaaaggucgacgacggguuucuugauauauggacguacaacgccgagcuguuggugcuacuggaaaaugagcgcacccucgacuuccaugauagcaacguuaaaaaucuguacgaaaaggugaaaaaccagcuuagaaauaacgcaaaggagcugggcaauggaugcuucgaguuuuaucacaagugugacaacgaaugcauggagucagucaaaaauggcacauacgauuaucccaaguacagugaagaguccaaauugaacagggagaagauugacggggugaaacucgaaagcaugggaguauaucggauccuggccaucuacucuacuguugcuucaaguuuagugcugcuagucagccucggugcgauuuccuucuggaugugcucuaauggcucgcugcagugucgaaucugcauuuga

SEQ ID NO: 132166 - RNA, 1701 nt, Artificial Sequence
  derived and/or modified sequence opt3 from hemagglutinin__InfluenzaA__AGQ47764
augaaggccaaacugcucauccuucugugcgcuuugaccgcaacagacgccgauacuauuuguauaggcuaccacgcgaacaauagcacggacaccguggauacagucuuagagaagaacguuacugugacccauuccguaaaucugcuagaagacucucacaacgggaaacucugcagacugaagggaaucgcuccccuucagcuggguaaauguaauauugccggcuggaucuuggggaacccugagugcgaaucacuccugaguaagaggagcugguccuauauugcagagacaccaaauucugaaaacggagccuguuacccgggcgauuucgcugacuaugaggagcugcgggaacaacucucgucagugagcaguuuugagcgcuucgaaaucuuucccaaggagcgauccuggccuaaacauaauauaacccguggugucacugcagccugcucucacgcugggaaaagcuccuucuacaaaaacuuacuguggcuuacagagaccgauggaucauauccaaaguugaguaaaagcuacgugaauaacaaggaaaaggagguucuggugcuauggggcguccaucaccccucuaauaucgaagaccagaaaacgcucuauagaaaggagaacgccuacguguccguaguuucaagcaauuacaacaggcgguuuacuccugaaauugcggagcgcccaaaagugagaggccaggcagggaggaucaacuauuacuggacccugcuugagcccggagauacaauuaucuucgaagccaaugguaaccugauagcuccuugguaugccuuugcauugagucgggacuucggcucugggauuaucacuuccaaugcuagcauggaugagugugacaccaagugccagacaccacaaggagccauuaacucgucucucccguuucagaauauccaccccgucaccaucggcgaauguccuaaauacgugaaguccacgaaacugcgcauggugacugguuuacgaaacauuccaucaauacagaguagagggcuguucggagcgaucgccggcuuuauugagggcggguggacaggaaugaucgaugguugguauggcuaccaucaccagaaugaacaagggagcggauaugcagcugaccagaaguccacccagaacgccauaaauggcauuacuaacaaggucaauucuguuaucgagaaaaugaacacacaguucaccgcuguggguaaggaguuuaauaaacucgaaaagaggauggagaaccuuaauaaaaagguagacgauggguuccuggacaucuggacguacaacgccgaauugcuagugcugcucgagaacgaacggacccuggauuuccaugacagcaaugucaagaaccuuuacgagaaagugaagaaucaacugcguaacaaugcaaaagagauuggcaacggaugcuuugaguucuaucacaaguguaauaacgaaugcauggaaucaguuaaaaauggcacauacgauuaucccaaguacagugaggaguccaaguugaaccgcgaaaagaucgacggggugaagcucgagagcaugggagucuaucagauucuggccauauacucuacuguggcuucaaguuuaguacugcuaguuagccucggugcgaucuccuuuuggaugugcucuaauggcucgcugcaguguagaauuugcaucuga

SEQ ID NO: 132167 - RNA, 1701 nt, Artificial Sequence
  derived and/or modified sequence opt3 from hemagglutinin__InfluenzaA__AGQ47776
augaaggccaaacugcucauccuucugugcgcuuugagcgcaaccgacgccgauacaauuuguauaggcuaccacgcgaacaauuccacugacacgguggauaccgucuuagagaagaacguuacagugacucauucuguaaaucugcuagaagacucacacaacgggaaacucugcagacugaagggaaucgcuccccuucagcuggguaaauguaauauugccggcuggaucuuggggaacccugagugcgaaagucuccugagcaagagguccuggucuuauauugcagagaccccaaauucggaaaacggaacauguuacccgggcgauuucgccgacuaugaggagcugcgggaacaacucucaagcgugaguuccuuugagcgcuucgaaaucuuucccaaggagcgaucuuggccuaaacauaauauaaacaucggugucaccgcugcaugcagccacgccgggaaguccucauucuacaaaaauuuacuguggcuuacugagaaggauggaaguuauccaaacuugaauaaaagcuacgugaacaagaaggaaaaagagguucuggugcuauggggcguccaucaccccucuaauauugaagaccagaagacacucuaucguaaagagaacgcuuacguguccguaguuucaagcaacuacaauagaagguuuaccccugaaaucgccgagcggccaaaggugcgcggccaggcggggagaaugaacuauuacuggacgcugcuugagcccggagauacuauuaucuucgaagcaaaugguaaccugauagccccuugguaugcuuuugccuugaguaggggccucgggucuggaauuaucaccuccaaugcaagcauggacgagugugauacaaaaugccagacuccacaaggcgcuauuaacucgucucugccguuccagaauauccaccccuuuaccaucggugaauguccuaaguacguccgguccacaaaauuacgcauggugaccgggcugcgaaacauuccaucaauacagaguagaggacucuucggcgccaucgcgggcuuuauugaagggggauggacggguaugaucgacggcugguauggguaccaucaccagaaugaacaaggaagcggcuaugccgcagaucagaaguccacucagaacgcuauaaaugguauuacaaacaaggucaauucugugaucgagaaaaugaacacccaguucacugccguugggaaggaguuuaauaaacuugaaaagaggauggagaaccugaacaaaaagguggacgacggcuucuuggauaucuggacauacaaugcugaacuacugguacuccuggagaacgaacggacccuugacuuccaugauagcaaugugaagaaccuguacgagaaagucaagaaucaauugcguaacaaugccaaagagauuggaaacggcugcuuugaguucuaucacaaguguaauaacgagugcauggaaucagugaaaaaugggacguacgacuaucccaaguacagugaggaguccaagcucaaccgcgagaaaaucgauggaguuaagcuggaaagcauggguguguaucagauuuuagcaauauacucuaccgucgccucaagucuggugcuacucguaagccugggcgcuaucuccuuuuggaugugcucuaaugggucgcuucaguguagaauuugcaucuga

SEQ ID NO: 132168 - RNA, 1701 nt, Artificial Sequence
  derived and/or modified sequence opt3 from hemagglutinin__InfluenzaA__AGQ47788
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaauaucgccggcuggauuuuggggaacccugagugcgaaagucucuucagcaagaaguccuggucuuauaucgcagagaccccaaauucggaaaacggaacauguuacccgggcuauuuugccgauuacgaggagcugagggaacaacugucaagcgucaguuccuucgagcgguuugaaauuuuccccaaagagcgcucuuggccuaagcauaaugugacccgagguguuacugcugcaugcagccacaaagggaaguccucauuuuaucguaaccucuuauggcugacagagaaagacggaaguuacccaaaucuuagcaagucuuaugugaacaauaaggaaaaagaggucuuggugcuguggggcguacaucaccccuccaacaucgaagaucagaagacccuauacagaaaagagaaugccuacguuucaguggucagcaguaacuauaacaggcgguucacgccugaaauagcugagcgcccaaaggugagaggccaggccgggaggaucaauuacuauuggacucuccuggagcccggagacaccauuaucuuugaagcgaacgguaaucuuauugcaccuuggcacgccuucgcucugucucggggcuuuggguccggaaucauaacaagcaacgccucgauggaugagugugacacuaaaugccagaccccacaaggcgcaauuaauucuuccuugccguuccagaacauccaucccgugacaauuggugaauguccuaaguacguccgcucaaccaaacuccgaaugguuacggggcugagaaauaucccaaguauccagagcaggggauuauuuggcgcuauugccggcuucauagaagggggauggacugguaugaucgauggcugguauggguaccaccaucagaacgagcaaggauccggcuaugcggccgaccagaagucuacacagaaugcaauuaacgguaucaccaauaaggugaacagcguaauagagaaaaugaauacucaguuuacagcuguggggaaggaguucaacaaacuggaaaagcggauggagaaucucaacaaaaaggucgaugacggcuuccuugacauuuggaccuacaacgccgaacuguuggugcuacuggagaaugaacguacgcucgauuuucacgacucaaacguuaagaaucuguacgagaaagugaagagucaacuuaaaaacaaugcuaaggagaucggaaacggcugcuucgaauuuuaucacaaauguaauaacgagugcauggaauccgucaagaaugggaccuacgauuaucccaaguacagcgaggagucuaaacugaaccgcgaaaagaucgacggagugaaauuggagucaauggguguauaucagauucucgccaucuacaguacaguugcaagcucccugguguuacuggucucucuaggcgccauuucguucuggaugugcagcaaugggucccuccaguguagaauaugcaucuga

SEQ ID NO: 132169 - RNA, 1701 nt, Artificial Sequence
  derived and/or modified sequence opt3 from hemagglutinin__InfluenzaA__AGQ47800
augaaggccagacugcucgugcuucugugcgcuuuggcagccaccgacgcggauacaaucuguauuggcuaccacgcuaacaauagcacugacacggucgauaccauauuagagaaaaacguuacagugacucauuccguaaaucugcuagaagacucucacaacgggaagcucugcaggcugaaaggaaucgcaccccuucagcuggguaaguguaauauugccggcuggaucuuggggaacccugagugcgaaucacuccugagugagcggagcugguccuauauuguggaaaucccaaauucugagaacggaaccuguuacccgggcgauuucacagacuaugaggaacugcgcgagcaacucucgucagucagcaguuuugaacgauucgagauauuucccaaagaguccucuuggccuaagcauaauaccgcccguggugugacugcugcaugcagccacgccgggaaguccucauucuacagaaacuuacuguggcuuacagaaaaagauggaaguuauccaaauuugaagaacagcuacguuaauaaaaagggcaaagaggugcugguccuauggggcgugcaucaccccucuuccaucaaggaacagcagacccucuaucagaaggagaacgcuuacguaucaguugugagcaguaauuacaacaggcgguuuacgccugaaauugccgagcgcccaaaagucagagaccaagcggggaggaugaacuauuacuggacucugcuugagcccggagauaccaucauuuucgaagcaaaugguaaccugaucgccccuugguaugcuuuugccuugucucggggcuucggguccggaauaauuacaagcaaugcaucgaugcacgagugugacacuaagugccagaccccacagggcgcuaucaacucuucccucccguuucagaauauucaucccgugacaaucggugaauguccuaaauacgugcgcucaaccaagcugcgaauggucacgggguuaagaaacaucccaaguauucaaagcaggggacuguucggcgccauagcgggcuuuaucgaagggggauggacugguaugauugauggcugguauggguaccaccaucagaaugaacagggauccggcuaugccgcagaccagaaaucuacacaaaacgcuaucaaugguauaaccaacaagguuaauagcgugauugagaaaaugaacacucaguucacagccguagggaaggaguuuaauaaccucgaaaagcggauggagaaucuuaacaaaaagguggaugacggcuuccuggacaucuggaccuacaacgcugaauugcuaauccugcucgagaaugaacguacgcuggauuuccacgacucaaacgucaaaaaucuuuacgagaaggugaaaagucagcugcgcaacaaugccaaggagauuggaaacggcugcuuugaguucuaucacaaguguaauaacgagugcauggaauccguuaaaaaugggaccuacgauuaucccaaguacagcgaggagucuaaauugaacagagaaaagaucgacggagugaaacucgagucaaugggugucuaucaaauucuggcaauauacaguacaguggccagcuccuuaguacugcuaguuucucucggcgcuaucucguuuuggaugugcagcaaugggucccugcaguguaggauuugcaucuga

SEQ ID NO: 132170 - RNA, 1701 nt, Artificial Sequence
  derived and/or modified sequence opt3 from hemagglutinin__InfluenzaA__AGQ47811
augaaggccaaacugcucgugcuucugugcgcuuugagcgcaaccgacgccgauacaaucuguauuggcuaccacgcgaacaauuccacugacacggucgauaccguuuuagagaagaacgugacaguaacucauucugugaaucugcuagaagacucacacaacgggaaacucugcagacugaagggaauagcuccccuucagcuggguaaauguaauaucgccggcuggauuuuggggaacccugagugcgaaagucucuucagcaagaaguccuggucuuauaucgcagagaccccaaauucggaaaacggaacauguuacccgggcuuuuucgccgauuaugaggagcugagggaacaacugucaagcgucaguuccuuugagcgguucgaaauuuuucccaaagagcgcucuuggccuaagcauaaugugacccgagguguuacugcugcaugcagccacaaagggaaguccucauucuaccguaaccucuuauggcugacagagaaaaauggaaguuauccaaaccuuagcaagucuuacgugaauaacaaggaaaaagaggucuuggugcuguggggcguacaucaccccuccaauaucgaagaccagaagaccauauauagaaaagagaacgccuacguuucaguggucagcaguaacuacaauaggcgguuuacgccugaaaucgcugagcgcccaaaggugagaggccaggccgggaggauuaacuauuacuggacucuacucgagcccggagauaccaucauuuucgaagcgaaugguaaccugaucgcaccuuggcacgccuuugcucuuucucggggcuucggguccggaauaauuacaagcaaugccucgauggacgagugugauacuaaaugccagaccccacaaggcgcaaucaacucuucccugccguuucagaauauucaucccgugacaaucggugaauguccuaaguauguccgcucaaccaaauugcgaaugguuacggggcucagaaacaucccaaguauucagagcaggggacuguucggcgcuauagccggcuuuaucgaagggggauggacugguaugauugacggcugguacggguaucaccaucagaaugaacaaggauccggcuacgcggccgaucagaagucuacacagaacgcaaucgacgguauaaccaauaaggugaacagcguaauugagaaaaugaauacucaguucacagcuguggggaaggaguucaacaaauuagaaaagcggauggagaaucugaacaaaaaggucgaugacggcuuucucgacaucuggaccuauaacgccgaacuucugguguugcuagagaaugaacguacgcuggauuuccacgacucaaacguuaagaaucucuacgagaaagugaagagucaacugaaaaacaaugcuaaggagaucggaaacggcugcuuugaguucuaccacaaauguaauaacgagugcauggaauccgucaagaaugggaccuaugauuaccccaaguauagcgaggagucuaaacuuaaccgcgaaaagauugacggagugaaacuggagucaauggguguauaccagaucuuggccauuuauaguacaguugcaagcucccucgugcuguuagucucucugggcgccauaucguuuuggaugugcagcaaugggucccuacaguguagaaucugcauuuga

SEQ ID NO: 132171 - RNA, 1701 nt, Artificial Sequence
  derived and/or modified sequence opt3 from hemagglutinin__InfluenzaA__AGQ47823
augaaggccaaacugcucgugcuucugugcgcuuucaccgcaacauacgccgacacuaucuguauuggcuaucacgcgaacaauagcacggauaccgucgacacaguuuuggagaagaacgugacuguaacccauuccgugaauuuacuggaagauucucacaacgggaaacuaugcagacucaagggaauagcuccccugcagcuugguaauuguucagucgccggcuggauccuggggaacccuaaaugcgagaguuuguuuagcaaggaauccuggucuuacauugcagagacaccaaauccggaaaacggaaccuguuaucccggcuacuucgccgacuaugaggagcucagggaacaacugucgucagugagcaguuuugagcgguucgaaaucuuuccuaaggaguccucuuggccaaaucauacuguuacaaaaggugugaccacgagcugcucccacaacgggaagucaaguuucuaccgcaaucugcucugguuaacugagaaaaacggacuguaucccaaucuuagcaagucuuacgucaacaauaaagaaaaggagguguugguacuguggggcguucaucacccuuccaacauucgagaucagcgugcuaucuaccacaccgaaaacgcauaugugucagucgugagcagucauuacucuagaagguuuacaccagagauagccaagcggcccaaagugcgcggccaggaagggagaaucaauuauuacuggacucuacucgagccuggagacaccauuaucuucgaggcuaacgguaaucugauugccccaugguaugcguuugcacuuuccaggggcuucgggagcggaaucauaacaucgaacgccucuauggaugaaugugacgcuaagugccagaccccgcaaggcgccauuaauuccucacugcccuuucagaacguccacccuguuacgaucggugaguguccaaaauacgugcggaguacuaaguugcgcaugguaacagggcuccgaaauauucccagcauccaguccagaggacuguucggcgcaaucgcuggcuuuauugaagggggauggaccgguaugauagauggcugguauggguaccaucaccagaacgagcaaggaucuggcuacgccgcggaccagaaaagcacucagaaugccaucaacgguauuacaaauaaggugaacucagucaucgaaaagaugaauacccaguucacggcaguggggaaggaguucaacaaguuagagaggcggauggaaaaucugaacaaaaagguugaugacggcuuucucgauauauggaccuauaacgcugagcuucugguguugcuagaaaauggacguacacuggacuuccacgacaguaacgucaaaaaucucuacgagaaggugaaaucccaacugaagaacaaugccaaggaaauuggcaacgggugcuuugaguucuaucauaaauguaauaacgagugcauggaaagcguaaagaauggaacuuacgauuauccuaaauacucugaggaaucaaaacuuaaccgcgguaaaaucgacggcguuaagcuggagaguauggggguguaucagaucuuggcuauuuacagcaccgucgccuccucucucgugcuguuagucucgcugggagcaaucagcuuuuggaugugcuccaauggcucacuacaguguagaauuugcauauga

SEQ ID NO: 132172 - RNA, 1701 nt, Artificial Sequence
  derived and/or modified sequence opt3 from hemagglutinin__InfluenzaA__AGQ47835
augaagaccaucauugcccugagcuacauauucugccucgugcuuggccaggacuuucccgggaacgauaauuccacagcuacucuguguuugggacaccaugcagucccuaacgguacgaucguuaaaaccauuacaaaugaccaaaucgaggugacuaacgccaccgaauuaguacagucuucaaguacaggcaagauuugcaauaacccacacagaauccuggaugggauaaauuguacccuaaucgacgcgcuccugggagauccgcauugcgacggcuuccagaacgagacuugggaucuuuuuguggaaaggagcaaggcuuucuccaauuguuaucccuacuaugucccugacuacgccucucugcggucguugguggcaucaagcgguacacucgaguuuauuaacgaaggguucaauuggaccggaguuacgcagaacggcggcaguaaugccugcaagcgcgggccaaacuccggauuuuucucucgacugaauuggcuguauaaaagcgguacuaccuaccccgugcucaacgucacaaugccuaacaaugauaacuuugacaaguuauauaucuggggcgugcaccauccauccacugaucaagagcagaccaaucuguacguacaggcuucagggcguguuacagugaguaccaagagaagccagcaaacgauuacucccaacaucggaucuaggccuuggguccggggccuuuccucacgcauaagcauuuacuggacaaucgugaaaccaggugacauuuuggugaucaauaguaacgggaaucugaucgcaccgagaggauauuucaagaugaggaccggcaaaucuuccauuaugcggagcgaugcccccauaggcacuuguaucucggagugcauuacaccuaacgggucuaucccaaaugacaagcccuuucagaacgucaauaaaauaaccuacggagcuuguccuaaguauguuaagcagaacacgcuaaaacucgccaccgguaugcgcaaugugccagaaaagcagacacgaggcauuuucggggcgaucgcaggauuuaucgagaacggcugggaagguaugguagacgggugguacggcuucagacaccaaaauuccgagggaacuggccaggccgcugaucugaaaucaacccaggccgcaauugaccaaaucaacgggaaacuuaacagggugauugagaaaacaaaugaaaaguuccaccagauagagaaagaauuuagugaggucgaaggacggauccaggaucuggagaaguauguggaggacacuaagauugauuuguggagcuacaacgcugaacuccugguugccuuagagaaucagcauaccaucgaccugacagauuccgaaaugaacaaacucuucgagaagacccgucgccaacuuagagaaaaugcggaggacauggguaacggcugcuuuaaaaucuaucacaagugugauaaugccugcauugggucuauaaggaacggaacuuacgaccaugauguguaccgggacgaggcacugaauaaccgauuccagaucaaaggcgucgaacuaaagagcgguuauaaggacuggauuuuguggaucucauuugcuauuaguugcuuccugcucugugugguacugcuuggguuuaucaugugggccugccagaaaggcaauauacgcuguaacaucugcauuuga

SEQ ID NO: 132173 - RNA, 1701 nt, Artificial Sequence
  derived and/or modified sequence opt3 from hemagglutinin__InfluenzaA__AGQ47847
augaaggccagacugcucauccuucugugcgcuuuggcagccaccgacgcggauacaauuuguauaggcuaccacgcuaacaauagcacugacacgguggauaccgucuuagagaaaaacguuacagugacucauuccguaaaucugcuagaagacucucacaacgggaagcucugcaggcugaaaggaaucgccccgcuucagcuggguaaguguaauauugcaggcugguugcucgggaacccugagugcgauucacugcugccagccaguagcugguccuauaucguggaaacccccaauucuaaaaacggaauuuguuaccccggcgacuucaucgauuaugaggaacuccgggagcaauuaucgucagucagcaguuuugagcgcuucgaaauauuuccuaaggaguccucuuggccaaagcauaauacaaccaaaggugugacugcugcaugcagccacgccgggaaguccucauucuaccgaaaccugcuuugguugacaaagaaggaagacaguuaucccaaacugagcaauucuuacguuaacaagaagggaaaagaggugcuaguccucuggggcgugcaucacccuuccaauucaaaggagcagcagacccuguaucagaacgaaaaugcuuacguaagcguugugaguucuaacuacaaccguagauuuacgccagagaucgccgaaaggcccaaaguccgggaucaagcgggccgcaugaauuauuacuggacucuucuggagccuggggacaccauuaucuucgaagcaaacggaaauuugauugccccaugguaugcuuuugcccucuccagagguuucggcagcgggaucauaacaucgaacgcaucuaugcacgaguguaauacuaagugccagaccccgcagggagcuauuaacuccucacugcccuuucagaauauccauccugugacaauuggcgaguguccaaaauacgugaagagugccaaauuaaggauggucaccggucugcggaacauccccagcauccaaucccgcggacucuucggggcgauugccggcuuuauagaaggcggguggacgggaaugaucgaugguugguauggcuaccaccaucagaaugagcaggggucuggauaugcagcugaccagaaaagcacucaaaacgccauuaauggcaucacaaacaagguuaauucagugauagagaaaaugaacacccaguucacugcuguagguaaggaauuuaauaaccuugaaaaacgaauggagaaccugaauaagaaaguggaugacggguucuuggacauuuggacauacaacgccgagcuacugguccuccuggaaaaugagagaacccuugauuuccacgacaguaacgugaagaaucuguacgaaaagguuaaaauccaguugaagaacaaugcaaaagagaucggcaacggaugcuuugaguucuaucacaagugugauaaugaaugcauggaguccgugaggaacggcacguacgacuauccuaaauacagcaaggaaucuaagcucaaucgggagaaaauugauggggucaagcuggaaccaaugggaguguaucaaaucuuagccauuuacucaaccguagcuaguagccugguucuacucgugucccugggugcgauaucuuuuuggaugugcucgaacggcagccuucagugucguaucugcauuuga

SEQ ID NO: 132174 - RNA, 1701 nt, Artificial Sequence
  derived and/or modified sequence opt3 from hemagglutinin__InfluenzaA__AGQ47870
augaaggccauccugcucgugcuucugugcaccuucgcugcaacaaacgccgacacuuuguguauuggcuaccacgcgaauaacagcacggauaccgucgacacaguuuuagagaaaaaugugacuguaacccauuccgugaaccugcuagaagauagacacaaugggaagcucugcaaacugggagguauagcuccccuucaucugggcaaguguaacaucgccgggugguugcucggaaauccugagugcgaacugcugcucacagucucuucauggaguuauauuguggagaccagcaacuccgacaauggcacuuguuacccaggugauuuuaucaacuaugaagaguuaagggagcagcugucuucgguuaguagcuucgaacgguuugagauuuucccgaaaacaaguuccuggcccaaucacgaaaccaaccgcggggugacggcagccugcccuuacgcuggagcaaauucuuuuuaucgaaaccuuaucugguuggucaagaagggcaauagcuacccaaaacuguccaagucauaugugaacaacaaaggcaaggaggugcuaguucucugggggauacaucaucccccuacuucaaccgaccaacagagccuguaccagaaugccgaugcuuacguguucgucggaucuuccaaauauaaccguaaguuuaagccagagaucgccgcgagacccaaagugaggggucaggcaggccggaugaauuacuauuggacacuuauugaaccuggggacacuaucaccuucgaggccacaggaaaccugguggucccacgcuacgcuuuugccaugaauagaggcucagguagcgggauuaucauaagugaugcaccgguucacgacuguaacaccaagugccaaacgcccaaaggagcuauuaauacuucuuugccuuuccagaacauccacccagugacaauuggcgaaugucccaaguauguaaaauccaccaagcucaggauggccacuggccugcggaauaucccuagcauccagucgcgcggguuauuuggagcgauugccgguuucauagagggcggguggacaggaaugaucgauggcugguacgguuaucaccaucagaacgaacaagggucuggcuacgcagcugaccagcgauccacccagaaugccauugauggaaucacgaacaaaguaaauucagucauagagaagaugaacacccaguuuacagcugugggcaaggaguucaaucaccuggagaaaagaauugaaaaccucaacaagaaaguugacgacggguuccuugauaucuggacuuacaaugccgaacuguuggugcuacuggagaacgaaaggacccucgacuuucacgauaguaaugucaagaaccuguaugagaaagugcggagccaacuucguaauaacgcaaaggagaucggaaaugguugcuucgaauuuuaccauaagugugacgauacaugcauggaguccguuaaaaacggcacuuaugacuacccaaaguauucugaagagagcaaacugaaucgcgaagagauugaugggguaaaguuggagucaaccagaaucuaccagauucucgccauauauaguacaguggcuuccagccuggucuuacuggugucucuaggagcgaucucauucuggaugugcaguaacggcagccuccaguguaggauuugcaucuga

SEQ ID NO: 132175 - RNA, 1701 nt, Artificial Sequence
  derived and/or modified sequence opt3 from hemagglutinin__InfluenzaA__AGQ47882
augaaggccauccugcucgugcuucugugcaccuucgcugcaacaaacgccgacacuuuguguauuggcuaccacgcgaauaacagcacggauaccgucgacacaguuuuagagaaaaaugugacuguaacccauuccgugaaccugcuagaagauagacacaaugggaagcucugcaaacugggagguauagcuccccuucaucugggcaaguguaacaucgccgggugguugcucggaaauccugagugcgaacugcugcucacagucucuucauggaguuauauuguggagaccagcaacuccgacaauggcacuuguuacccaggugauuuuaucaacuaugaagaguuaagggagcagcugucuucgguuaguagcuucgaacgguuugagauuuucccgaaaacaaguuccuggcccaaucacgaaaccaaccgcggggugacggcagccugcccuuacgcuggagcaaauucuuuuuaucgaaaccuuaucugguuggucaagaaggagaauagcuacccaaaacuguccaagucauaugugaacaacaaaggcaaggaggugcuaguucucuggggcauacaucaucccccuacuucaaccgaccaacagagccuguaccagaaugccgaugcuuacguguucgucgggucuuccaaauauaaccguaaguuuaagccagaaaucgccgcgagacccaaagugaggggacaggcaggucggaugaauuacuauuggacacuuauugagccuggcgacacuaucaccuucgaagccacagggaaccugguggucccacgcuacgcuuuugccaugaauagaggaucaggcagcgguauuaucauaagugaugcaccgguucacgacuguaacaccaagugccaaacgcccaaaggggcuauuaauacuucuuugccuuuccagaacauccacccagugacaauuggagagugucccaaguauguaaaauccaccaagcucaggauggccacuggccugcggaauaucccuagcauccagucgcgcggcuuauuuggggcgauugccggauucauagaagguggcuggacagggaugaucgauggaugguacggcuaucaccaucagaacgagcaagguucuggguacgcagcugaccagcgauccacccagaaugccauugauggcaucacgaacaaaguaaauucagucauagagaagaugaacacccaguuuacagcugugggaaaggaauuuaaucaccuggagaaaagaauugaaaaccucaacaagaaaguugacgacggcuuccuugauaucuggacuuacaaugccgagcuguuggugcuacuggaaaacgagaggacccucgacuuccacgauaguaaugucaagaaccuguaugagaaagugcggagccaacuucguaauaacgcaaaggaaaucgggaauggaugcuucgaguuuuaccauaagugugacgauacaugcauggaauccguuaaaaacgguacuuaugacuacccaaaguauucugaggaaagcaaacugaaucgcgaggagauugauggcguaaaguuggaaucaaccagaaucuaccagauucucgccauauauaguacaguggcuuccagccuggucuuacuggugucucuaggggcgaucucauucuggaugugcaguaacggaagccuccaguguaggauuugcaucuga

SEQ ID NO: 132176 - RNA, 1701 nt, Artificial Sequence; identical to SEQ ID NO: 131111
  derived and/or modified sequence opt3 from hemagglutinin__InfluenzaA__AGQ47894

SEQ ID NO: 132177 - RNA, 1701 nt, Artificial Sequence
  derived and/or modified sequence opt3 from hemagglutinin__InfluenzaA__AGQ47906
augaagaccaucauugcccugagcuacauauucugccucgcucuuggccaggaccugcccgggaacgauaauuccacagcaacuuuguguuuaggacaccaugccgugccuaacgguacgcuggucaaaaccaucacagacgaucaaauugagguuacuaaugcgaccgaacuugugcagucuucaaguacaggcaagaucugcaacaauccacacaggauucucgacgggaucgauuguacccugauagacgcucuacugggagauccgcauugcgacguauuucagaacgagacuugggauuuguucguggaaagaagcaaagccuuuuccaauuguuaucccuacgacgucccugauuaugcaucucuccggucgcugguggccucaagcggcacacuggaguucaucaccgaagguuuuacguggacugggguuacccagaacggaggcaguaaugcuugcaagcgcggcccaggguccggauucuuuucucgacucaacugguuaacaaaaagcgguuccacuuaccccgugcugaaugucaccaugccuaacaaugacaacuucgauaaguuguauauuuggggcauccaccauccaucaacaaaucaagagcagaccaguuuguacgugcaggcaagcgggcguguaacgguuucuacuagaaggucccagcaaacaauuauccccaacauaggaucacggccuugggugcgcggccugagcaguagaauuucuaucuauuggaccauugucaagccaggugacgugcuagugaucaacuccaaugggaaccucaucgccccgaggggauacuuuaaaaugcggacuggcaagagcucgauuaugcgcucugacgcucccauagauacauguaucuccgagugcauuaccccuaauggcucaaucccaaacgacaaacccuuccagaaugucaacaagauaacguacggggccuguccuaaauauguuaagcagaauacccugaaacuugcgacaggaaugcgaaacgugccagaaaagcagacuagaggucuguuuggcgcaauugccggguucaucgagaauggaugggaaggcaugaucgaugguugguacggguuuaggcaccaaaacagugagggcaccggacaggcugccgaccuuaagagcacacaggcagcuauugaucaaaucaauggcaaacucaaccggguaauugagaagacuaaugaaaaauuccaccagauagagaaggaguucuccgaaguggaagggcguauccaggaccuggagaaauaugucgaggauaccaagauugacuuauggucuuacaacgccgaacugcucguggcgcuugagaaucagcauacaaucgaucugaccgacagcgaaaugaacaaguuguuugagaaaacucgcagacaacuaagggaaaacgccgaggauaugggaaaugguugcuucaagaucuaucacaaaugugacaacgcaugcauugagucaauacggaauggcacguacgaccaugauguuuaucgagacgaagcucugaacaaucgcuuucagaucaaggggguggagcucaaaaguggauacaaggauuggauucuguggaucuccuucgccauuagcugcuuucuucugugugucguguugcucggcuucaucaugugggcuugccagagagguaacauaagguguaauaucugcauuuga

SEQ ID NO: 132178 - RNA, 1701 nt, Artificial Sequence
  derived and/or modified sequence opt3 from hemagglutinin__InfluenzaA__AGQ47918
augaagaccaucauugcccugagcuacauauucugccucgcucuuggccaggaccugcccgggaacgauaauaacacagcaacuuuguguuuaggacaccaugccgugccuaaugguacgcuggucaaaaccaucacagacgaucaaauugagguuacuaacgcgaccgaacuugugcaguccucuucaacaggcaagaucugcaauaacccacacaggauucucgacgggaucgauuguacccugauagacgcucuacugggagauccgcauugcgacguauuucagaaugagacuugggauuuguucguggaaagaaguaaagccuuuagcaacuguuaucccuacgacgucccugauuaugcaucccuccggucucugguggccucgucaggcacacuggaguucaucaccgaagguuuuacguggacugggguuacccagaauggaggcagcaacgcuugcaagcgcggcccagggaguggauucuuuucccgacucaauugguuaacaaaaucugguagcacuuaccccgugcugaacgucaccaugccuaauaacgacaauuucgauaaacuuuauauuuggggcgugcaccauccauccacaaaccaagagcagaccucauuguacguacaggcaagugggcguguuacggugagcacuagaaggucucagcaaacaaucauucccaacaucggaucccggccuuggguccgcggccugucaagcagaauaaguauuuauuggaccaucgugaagccaggugacgugcuagucauuaauucuaacgggaaucucaucgccccgaggggauacuuuaagaugcggacuggcaaguccagcaucaugcgcucggacgcucccauugauacauguauaucugagugcaucaccccuaacggcuccauuccaaaugacaaacccuuccagaacguuaauaagaucacguacggggccuguccuaaauaugugaagcagaacacccugaaacuugcgacaggaaugcgaaauguaccagaaaagcagacuagaggucuguuuggcgcaauagccggguucauugagaacggaugggaaggcaugaucgaugguugguacggguuuaggcaccaaaauucagagggcaccggacaggcugccgacuugaagaguacacaggcagcuaucgaucaaauuaacggcaaacucaaucgggugaucgagaagacuaacgaaaaauuccaccagauugagaaggaguucagcgaagucgaagggcguauacaggaccuggagaaauauguggaggauaccaagaucgacuuaugguccuacaaugccgaacugcucguugcgcuugagaaccagcauacaauugaucugaccgacucugaaaugaacaaguuguuugagaaaacucgcagacaacuaagggaaaaugccgaggauaugggaaacgguugcuucaagaucuaucacaaaugugacaaugcaugcaucgagagcauucggaacggcacguacgaccaugauguguaucgagacgaagcucugaauaaccgcuuucagauaaagggggucgagcucaaaucaggauacaaggauuggauccuguggauuaguuucgccaucuccugcuuucuucugugugugguauugcucggcuucauuaugugggcuugccagagagguaauaucagguguaacauaugcaucuga

SEQ ID NO: 132179 - RNA, 1701 nt, Artificial Sequence
  derived and/or modified sequence opt3 from hemagglutinin__InfluenzaA__AGQ47930
augaaggccaaccugcucgugcuucugugcgcuuuggcagccgcggacgcugauaccaucuguauuggcuaccacgccaauaacagcacagacacugucgauacggcauuagagaaaaauguuaccgugacacauuccguaaaccugcuagaagacucucacaaugggaagcucugcagacugaaaggaauagcuccccuucagcuggguaaguguaacaucgccggcugguugcucgggaauccugagugcgauccacugcugccggugaggucauggaguuauauugucgaaacucccaacagcgagaauggaaucuguuacccuggcgacuucauugauuaugaagaacuccgggagcaauuauccucugugucgucauuugaacgcuucgagaucuuuccaaaagaaagcaguuggcccaaccauaauaccaacaaggguguuacagcagccugcucccacgcugggaagucuagcuucuaccgaaaucugcuuugguugaccgagaaagagggauccuauccuaagcugaaaaacucauacgugaauaagaaaggcaaggaaguccuagugcucuggggcauacaucacccaaguaacagcaaggaccagcagaaccuguaucagaaugagaacgccuacguaucuguugugacuuccaauuacaaccguagauuuacacccgaaaucgcggagaggccuaaaguccgggaucaagcagggcgcaugaauuauuacuggacccuucugaagccaggagacacgauuaucuucgaagccaacgguaauuugauugcuccgauguaugccuuugcacucucaagaggcuucgggagcggaaucauaacuucaaacgcuucuaugcacgaguguaauaccaaaugccagacaccccugggcgccauuaacuccagcuuaccuuuucagaauauccauccagugacuauuggugagugucccaaguacgugaggucggcgaaacugcggauggucaccgggcuccgcaacaucccuucuauccagucccgaggacuuuucggcgccauugcaggcuuuauagaagggggauggacagguaugaucgauggcugguauggguaccaccaucaaaaugagcagggaucaggcuaugcugccgaccagaagaguacccagaacgcuauuaaugguaucacgaacaaaguuaacagcgugauagaaaagaugaauauucaauucacugccguagggaaggaguuuaacaaacuggaaaagagaauggagaauuugaacaaaaagguggaugacggcuuccuagacaucuggacauacaaugcagagcugcucguccugcuugaaaacgagaggacccuggauuuccacgacuccaaugugaaaaacuuguacgaaaagguuaagucucagcucaaaaauaacgccaaggagaucggaaauggcugcuuugaguucuaucacaaaugugauaacgagugcauggagagcgugcggaaugggacuuacgacuauccaaaguacucagaagagaguaaacugaaccgugaaaaggucgauggagugaaguuagaguccauggguauuuaucagauccuggcuauuuacagcacaguagcgucuagucuaguucuccuggugagucuuggcgcaaucagcuuuuggaugugcuccaaugggucuuugcaaugucgcauaugcauuuga

SEQ ID NO: 132180 - RNA, 1698 nt, Artificial Sequence; identical to SEQ ID NO: 125294
  derived and/or modified sequence opt3 from hemagglutinin__InfluenzaA__AGQ47942

SEQ ID NO: 132181 - RNA, 1698 nt, Artificial Sequence
  derived and/or modified sequence opt3 from hemagglutinin__InfluenzaA__AGQ47954
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucaggucauggaguuauauuguggaaacucccaacagcgagaauggaaucuguuacccuggcgacuucauugauuaugaagaacuccgggagcaauuauccucuguuucgucauuugaacgcuucgagaucuuuccaaaagaaagcaguuggcccaaccauaauaccaacggugugacagcugcaugcucccacgaggggaagucuagcuucuaccgaaaucugcuuugguugaccgagaaggaaggauccuauccuaaacugaagaacucauacgucaauaaaaagggcaaagaggugcuaguacucuggggcauacaucacccacccaacaguaaggaacagcagaaccuguaucguaaugagaacgccuacguuagcguggucacuucuaauuacaacagaagguuuacaccugaaaucgcugagcggccaaaggugcgcgaccaggccgggagaaugaauuauuacuggacccuucugaaaccgggagauacgauuaucuucgaggcgaacgguaauuugauugcacccauguaugccuuugcucucuccaggggcuucgggucaggaaucauaacuagcaacgccaguaugcacgaauguaauaccaagugccaaacaccucugggcgcaauuaacucuuccuuaccauaccagaauauccaucccgugacuauuggugaguguccuaaauauguccggagcgcuaagcugcgcaugguuaccgggcuccgaaacaucccaucgauccagucuagaggacuuuuuggcgccauugcgggcuucauagaagggggauggacagguaugaucgacggcugguacggguaucaccaucagaaugagcaaggauccggcuacgccgcagaucagaaaucaacccagaacgcuauuaaugguaucacgaacaaggugaacacuguaauagagaaaaugaauauucaguuuacagccguggggaaggaguucaacaagcuggagaaaaggauggaaaauuugaacaagaaagucgacgauggcuuucuagacaucuggaccuacaaugcugagcugcucgugcugcuugaaaacgagcggacucuggacuuccacgauaguaauguuaagaacuuguaugaaaaagucaagagccaacucaagaauaacgccaaagagaucggaaauggcugcuucgaguuuuaccacaagugugacaacgaaugcauggaguccgugcguaaugggacauaugauuaccccaaauauucugaagagagcaagcugaaccgcgagaaaguggacggaguaaaguuagaaucaauggguauuuaccagauccuggcaauuuauaguaccguugccuccagccuagugcuccuggucucucuuggcgcuauaucauucuggaugugcaguaaugggagcuugcaguguagaaucugcauuuga

SEQ ID NO: 132182 - RNA, 1698 nt, Artificial Sequence
  derived and/or modified sequence opt3 from hemagglutinin__InfluenzaA__AGQ47966
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaggaacucagggagcaauuauccucuguuucgucauuugaacgguucgagaucuuuccaaaagaaagcaguuggcccgaccauaacaccaauggggugacagcugcaugcucccacgagggaaagaacucuuucuaccgcaaucugcuuugguugaccgagaaggaaagcuccuauccuaaacugaagaacucauacgucaauaaaaagggcaaagaggugcuaguacucuggggcauacaucacccacccaacaguaaggaacagcagaaccuguaucagaaugagaacgccuacguuagcguggucacuucuaauuacaaccgacguuuuacaccugaaaucgcugagagaccaaaggugaaagaucaagccgggaggaugaauuauuacuggacccuucugaagccgggagacacgauuaucuucgaggcgaacgguaauuugauugcacccauguaugccuuugcucucucccggggcuucgggucaggaaucauaacuagcaacgccaguaugcacgaauguaauaccaaaugccagacaccucugggcgcaauuaacucuuccuuaccauaccagaauauccaucccgugacuauuggugaguguccuaaguauguccgcagcgcuaaacugagaaugguuaccgggcucaggaacaucccaucgauccagucucggggacuuuuuggcgccauugcgggcuucauagaagggggauggacagguaugaucgauggcugguacggguaucaccaucaaaaugagcagggauccggcuacgccgcagaccagaagucaacccagaacgcuauuaaugguaucacgaacaaagugaacacuguaauagaaaagaugaauauucaauuuacagccguggggaaggaguucaacaaacuggagaagcgcauggaaaauuugaacaaaaaggucgaugacggcuuucuagacaucuggaccuacaaugcugagcugcucgugcugcuugaaaacgagcgaacucuggauuuccacgacaguaauguuaaaaacuuguaugaaaaggucaagagccagcucaaaaauaacgccaaggagaucggaaauggcugcuucgaguuuuaccacaaaugugauaacgaaugcauggaguccgugagaaaugggacauaugacuaccccaaguauucugaagagagcaaacugaacagggagaagguggauggaguaaaguuagaaucaauggguauuuaccagauccuggcaauuuauaguaccguugccuccagccuagugcuccuggucucucuuggcgcuauaucauucuggaugugcaguaaugggagcuugcaaugucggaucugcauuuga

SEQ ID NO: 132183 - RNA, 1698 nt, Artificial Sequence
  derived and/or modified sequence opt3 from hemagglutinin__InfluenzaA__AGQ47978
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaggaacucagggagcaauuauccucuguuucgucauuugaacgguucgagaucuuuccaaaagaaagcaguuggcccgaccauaacaccaauggggugacagcugcaugcucccacgagggaaagaacucuuucuaccgcaaucugcuuugguugaccaagaaagagagcuccuauccugaacugaagaacucauacgucaauaaaaagggcaaagaggugcuaguacucuggggcauacaucacccacccaacaguaaggaacagcagaaccuguaucagaaugagaacgccuacguuagcguggucacuucuaauuacaaccgacguuuuacaccugaaaucgcugagagaccaaaggugaaagaucaagccgggaggaugaauuauuacuggacccuucugaagccgggagacacgauuaucuucgaggcgaacgguaauuugauugcacccauguaugccuuugcucucucccggggcuucgggucaggaaucauaacuagcaacgccaguaugcacgaauguaauaccaaaugccagacaccucugggcgcaauuaacucuuccuuaccauaccagaauauccaucccgugacuauuggugaguguccuaaguauguccgcagcgcuaaacugagaaugguuaccgggcucaggaacaucccaucgauccagucucggggacuuuuuggcgccauugcgggcuucauagaagggggauggacagguaugaucgauggcugguacggguaucaccaucaaaaugagcagggauccggcuacgccgcagaccagaagucaacccagaacgcuauuaaugguaucacgaacaaagugaacacuguaauagaaaagaugaauauucaauuuacagccguggggaaggaguucaacaaacuggagaagcgcauggaaaauuugaacaaaaaggucgaugacggcuuucuagacaucuggaccuacaaugcugagcugcucgugcugcuugaaaacgagcgaacucuggauuuccacgacaguaauguuaaaaacuuguaugaaaaggucaagagccagcucaaaaauaacgccaaggagaucggaaauggcugcuucgaguuuuaccacaaaugugauaacgaaugcauggaguccgugagaaaugggacauaugacuaccccaaguauucugaagagagcaaacugaacagggagaagguggauggaguaaaguuagaaucaauggguauuuaccagauccuggcaauuuauaguaccguugccuccagccuagugcuccuggucucucuuggcgcuauaucauucuggaugugcaguaaugggagcuugcaaugucggaucugcauuuga

SEQ ID NO: 132184 - RNA, 1698 nt, Artificial Sequence
  derived and/or modified sequence opt3 from hemagglutinin__InfluenzaA__AGQ47990
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaggagcucagggagcaauuauccucuguuucgucauuugaacgguucaaaaucuuuccaaaggagagcaguuggcccgaccauaacaccaauggggugacagcugcaugcucccacgaaggaaagaacucuuucuaccgcaaucugcuuugguugaccaaaaaggagagcuccuauccugagcugaaaaacucauacgucaauaagaaaggcaaggaagugcuaguacucuggggcauacaucacccacccaacaguaaggagcagcagaaccuguaucagaaugaaaacgccuacguuagcguggucacuucuaauuacaaccgacguuuuacaccugagaucgcugaaagaccaaaagugaaggaucaagccgggaggaugaauuauuacuggacccuucugaaaccgggagacacgauuaucuucgaggcgaacgguaauuugauugcacccauguaugccuuugcucucucccggggcuucgggucaggaaucauaacuagcaacgccaguaugcacgaguguaauaccaagugccagacaccucugggcgcaauuaacucuuccuuaccauaccagaauauccaucccgugacuauuggugaauguccuaaauauguccgcagcgcuaagcugagaaugguuaccgggcucaggaacaucccaucgauccagucucggggacuuuuuggcgccauugcgggcuucauagaagggggauggacagguaugaucgauggcugguacggguaucaccaucaaaaugaacagggauccggcuacgccgcagaccagaaaucaacccagaacgcuauuaaugguaucacgaacaaggugaacacuguaauagagaagaugaauauucaauuuacagccguggggaaagaguucaacaagcuggaaaaacgcauggagaauuugaacaagaaagucgaugacggcuuucuagacaucuggaccuacaaugcugaacugcucgugcugcuugagaacgaacgaacucuggauuuccacgacaguaauguuaagaacuuguaugagaaggugaaaagccagcucaagaauaacgccaaagaaaucggaaauggcugcuucgaguuuuaccacaagugugauaacgagugcauggaauccgucagaaaugggacauaugacuaccccaaauauucugaggaaagcaagcugaacagggagaagguggauggaguaaaauuagagucaauggguauuuaccagauccuggcaauuuauaguaccguugccuccagccuagugcuccuggucucucuuggcgcuauaucauucuggaugugcaguaaugggagcuugcaaugucggaucugcauuuga

SEQ ID NO: 132185 - RNA, 1698 nt, Artificial Sequence
  derived and/or modified sequence opt3 from hemagglutinin__InfluenzaA__AGQ48002
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccugagugcgauccacugcugccggucggaucauggaguuauauuguggaaacucccaacagcgagaauggcaucuguuacccuggugacuucauugauuaugaagaacucagggagcaauuauccucuguuucgucauuugaacgguucaaaaucuuuccaaaggagagcaguuggcccgaccauaacaccaauggggugacagcugcaugcucccacgaaggaaagaacucuuucuaccgcaaucugcuuugguugaccaaaaaggagagcuccuauccugagcugaaaaacucauacgucaauaagaaacgaaaggaagugcuaguacucuggggcauacaucacccacccaacaguaaggagcagcagaaccuguaucagaaugaaaacgccuacguuagcguggucacuucuaauuacaaccguagauuuacaccugagaucgcugaaaggccaaaagugaaggaucaagccggccggaugaauuauuacuggacccuucugaaaccgggggacacgauuaucuucgaggcgaacggaaauuugauugcacccauguaugccuuugcucucucccgcgguuucggcucagggaucauaacuagcaacgccaguaugcacgaguguaauaccaagugccagacaccucugggagcaauuaacucuuccuuaccauaccagaauauccaucccgugacuauuggcgaauguccuaaauaugucagaagcgcuaagcugaggaugguuaccggucuccggaacaucccaucgauccagucucgcgggcuuuuuggagccauugcgggcuucauagagggcggguggacaggaaugaucgaugguugguacggcuaucaccaucaaaaugaacagggguccggauacgccgcagaccagaaaucaacccagaacgcuauuaauggcaucacgaacaaggugaacacuguaauagagaagaugaauauucaauuuacagccguggguaaagaguucaacaagcuggagaaacgaauggagaauuugaacaagaaagucgaugacggguuucuagacaucuggaccuacaaugcugaacugcucgugcugcuugagaacgaaagaacucuggauuuccacgacaguaauguuaagaacuuguaugagaaggugaaaagccagcucaagaauaacgccaaagaaaucggcaauggaugcuucgaguuuuaccacaagugugauaacgagugcauggaauccgucaggaauggcacauaugacuaccccaaauauucugaggaaagcaagcugaaccgggagaagguggaugggguaaaauuagagucaaugggaauuuaccagauccuggcaauuuauaguaccguugccuccagccuagugcuccuggucucucuuggugcuauaucauucuggaugugcaguaauggcagcuugcaaugucguaucugcauuuga

SEQ ID NO: 132186 - RNA, 1698 nt, Artificial Sequence
  derived and/or modified sequence opt3 from hemagglutinin__InfluenzaA__AGQ48014
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcagacugaaaggaauagcaccccuucagcuggguaaguguaacaucgccggcugguugcucgggaauccuggaugcgauccacugcugccggucggcucauggaguuauauuguggagacucccaacagcgaaaaugguaucuguuacccuggggacuucauugauuaugaggaacucagggagcaauuauccucuguuucgucauuugagcgguucaaaaucuuuccaaaggaaagcaguuggcccgaccauaacaccaauggagugacagcugcaugcucccacgagggcaagaacucuuucuaccgcaaucugcuuugguugaccaaaaaggaaagcuccuauccugagcugaaaaacucauacgucaauaagaaacgaaaggaggugcuaguacucuggggcauacaucacccacccaacaguaaggaacagcagaaccuguaucagaaugagaacgccuacguuagcguggucacuucuaauuacaaccguagauuuacaccugaaaucgcugagaggccaaaagugaaggaucaagccgggcggaugaauuauuacuggacccuucugaaaccgggagacacgauuaucuucgaagcgaacgguaauuugauugcacccauguaugccuuugcucucucccgcggcuucgggucaggaaucauaacuagcaacgccaguaugcacgaguguaauaccaagugccagacaccucugggcgcaauuaacucuuccuuaccauaccagaauauccaucccgugacuauuggugaguguccuaaauaugucagaagcgcuaagcugaggaugguuaccgggcuccggaacaucccaucgauccagucucgcggacuuuuuggcgccauugcgggcuucauagaagggggauggacagguaugaucgauggcugguacggguaucaccaucaaaaugagcagggauccggcuacgccgcagaccagaaaucaacccagaacgcuauuaaugguaucacgaacaaggugaacacuguaauagaaaagaugaauauucaauuuacagccguggggaaagaguucaacaagcuggaaaaacgaauggagaauuugaacaagaaagucgaugacggcuuucuagacaucuggaccuacaaugcugagcugcucgugcugcuugaaaacgagagaacucuggauuuccacgacaguaauguuaagaacuuguaugaaaaggugaaaagccagcucaagaauaacgccaaagagaucggaaauggcugcuucgaauuuuaccacaagugugauaacgagugcauggaguccgucaggaaugggacauaugacuaccccaaauauucugaagagagcaagcugaaccgggaaaagguggauggaguaaaauuagagucaauggguauuuaccagauccuggcaauuuauaguaccguugccuccagccuagugcuccuggucucucuuggcgcuauaucauucuggaugugcaguaaugggagcuugcaaugucguaucugcauuuga

SEQ ID NO: 132187 - RNA, 1698 nt, Artificial Sequence
  derived and/or modified sequence opt3 from hemagglutinin__InfluenzaA__AGQ48026
augaaggccaaccugcucgugcuucugugcgcuuuggcagccgcggacgcugauaccaucuguauuggcuaccacgccaauaacagcacagacacugucgauacgguuuuagagaaaaaugugaccguaacacauuccgugaaccugcuagaagacucucacaaugggaagcucugcaaacugaagggaauagcaccccuucagcuggguaaauguaacaucgccggcugguugcucgggaauccuggaugcgauccacugcugccggucggcucauggaguuauauuguggagacucccaacagcgaaaaugguaucuguuacccuggggacuucauugauuaugaggaacucagagagcaauuauccucuguuucgucauuugagagguucaagaucuuuccaaaggaaagcaguuggcccgaccauaacaccaauggagugacagcugcaugcucccacgagggcaaaaacucuuucuaccggaaucugcuuugguugaccaagaaagaaagcuccuauccugagcugaagaacucauacgucaauaaaaagcgcaaggaggugcuaguacucuggggcauacaucacccacccaacaguaaagaacagcagaaccuguaucagaaugagaacgccuacguuagcguggucacuucuaauuacaaccgacguuuuacaccugaaaucgcugagagaccaaaggugaaagaucaagccgggaggaugaauuauuacuggacccuucugaagccgggagacacgauuaucuucgaagcgaacgguaauuugauugcacccauguaugccuuugcucucucccggggcuucgggucaggaaucauaacuagcaacgccaguaugcacgaguguaauaccaaaugccagacaccucugggcgcaauuaacucuuccuuaccauaccagaauauccaucccgugacuauuggugaguguccuaaguauguccgcagcgcuaaacugagaaugguuaccgggcucaggaacaucccaucgauccagucucggggacuuuuuggcgccauugcgggcuucauagaagggggauggacagguaugaucgauggcugguacggguaucaccaucaaaaugagcagggauccggcuacgccgcagaccagaagucaacccagaacgcuauuaaugguaucacgaacaaggugaacacuguaauagaaaagaugaauauucaauuuacagccguggggaaggaguucaacaaacuggaaaagcgcauggagaauuugaacaaaaaggucgaugacggcuuucuagacaucuggaccuacaaugcugagcugcucgugcugcuugaaaacgagcgaacucuggauuuccacgacaguaauguuaagaacuuguaugaaaaagugaaaagccagcucaaaaauaacgccaaggagaucggaaauggcugcuucgaauuuuaccacaaaugugauaacgagugcauggaguccgucagaaaugggacauaugacuaccccaaguauucugaagagagcaagcugaacagggaaaaaguggauggaguaaaguuagagucaauggguauuuaccagauccuggcaauuuauaguaccguugccuccagccuagugcuccuggucucucuuggcgcuauaucauucuggaugugcaguaaugggagcuugcaaugucggaucugcauuuga

SEQ ID NO: 132188 - RNA, 1698 nt, Artificial Sequence
  derived and/or modified sequence opt3 from hemagglutinin__InfluenzaA__AGQ48038
augaaggccaaccugcucgugcuucugugcgcuuuggcagccgcggacgcugauaccaucuguauuggauaccacgccaauaacagcacagacacugucgauacgguuuuagagaaaaaugugaccguaacacauuccgugaaccugcuagaagacucucacaaugggaagcucugcaaacugaagggaauagcaccccuucagcuggguaaauguaacaucgccggcugguugcucgggaauccuggaugcgauccacugcugccggucggcucauggaguuauauuguggagacucccaacagcgaaaaugguaucuguuacccuggggacuucauugauuaugaggaacucagagagcaauuauccucuguuucgucauuugagagguucaagaucuuuccaaaggaaagcaguuggcccgaccauaacaccaauggagugacagcugcaugcucccacgagggcaaaaacucuuucuaccggaaucugcuuugguugaccaagaaagaaagcuccuauccugagcugaagaacucauacgucaauaaaaagcgcgaggaagugcuaguacucuggggcauacaucacccacccaacagugaggaacagcagaaccuguaucagaaugagaacgccuacguuagcguggucacuucuaauuacaaccgacguuuuacaccugaaaucgcugagagaccaaaggugaaagggcaagccggaaggaugaauuauuacuggacccuucugaagccgggugauacgauuaucuucgaggcgaacggcaauuugauugcacccauguaugccuuugcucucucccggggguucggaucaggcaucauaacuagcaacgccaguaugcacgaauguaauaccaaaugccagacaccucugggugcaauuaacucuuccuuaccauaccagaauauccaucccgugacuauuggggaguguccuaaguauguccgcagcgcuaaacugagaaugguuaccggacucaggaacaucccaucgauccagucucggggccuuuuuggcgccauugcgggguucauagaaggagguuggacaggcaugaucgacgggugguacggauaucaccaucaaaaugagcagggcuccgguuacgccgcagaucagaagucaacccagaacgcuauuaaugggaucacgaacaaagugaacacuguaauagaaaagaugaauauucaauuuacagccgugggcaaggaguucaacaaacuggagaagcgcauggaaaauuugaacaaaaaggucgacgauggauuucuagacaucuggaccuacaaugcugagcugcucgugcugcuugaaaacgagcgaacucuggacuuccacgauaguaauguuaaaaacuuguaugaaaaggucaagagccagcucaaaaauaacgccaaggagaucggcaaugggugcuucgaguuuuaccacaaaugugacaacgaaugcauggaguccgugagaaauggaacauaugauuaccccaaguauucugaagagagcaaacugaacagggagaagguggacgguguaaaguuagaaucaaugggcauuuaccagauccuggcaauuuauaguaccguugccuccagccuagugcuccuggucucucuuggggcuauaucauucuggaugugcaguaauggcagcuugcaaugucggaucugcauuuga

SEQ ID NO: 132189 - RNA, 1698 nt, Artificial Sequence
  derived and/or modified sequence opt3 from hemagglutinin__InfluenzaA__AGQ48050
augaaggccaaccugcucgugcuucugugcgcuuuggcagccgcggacgcugauaccaucuguauuggauaccacgccaauaacagcacagacacugucgauacgguuuuagagaaaaaugugaccguaacacauuccgugaaccugcuagaagacucucacaaugggaagcucugcaaacugaagggaauagcaccccuucagcuggguaaauguaacaucgccggcugguugcucgggaauccuggaugcgauccacugcugccggucggcucauggaguuauauuguggagacucccaacagcgaaaaugguaucuguuacccuggggacuucauugauuaugaggaacucagagagcaauuauccucuguuucgucauuugagagguucaagaucuuuccaaaggaaagcaguuggcccgaccauaacaccaauggagugacagcugcaugcucccacgagggcaaaaacucuuucuaccggaaucugcuuugguugaccaagaaagaaagcuccuauccugagcugaagaacucauacgucaauaaaaagcgcgaggaagugcuaguacucuggggcauacaucacccacccgauagugaggaacagcagaaccuguaucagaacgagaaugccuacguuagcguggucacuucuaacuacaaucgacguuuuacaccugaaaucgcugagagaccaaaggugaaagggcaagccggaaggaugaacuauuacuggacccuucugaagccgggugacacgauuaucuucaaagcgaauggcaacuugauugcacccauguaugccuuugcucucucccggggguucggaucaggcaucauaacuagcaaugccaguaugcacgaguguaacaccaagugccagacaccucugggugcaauuaauucuuccuuaccauaccagaacauccaucccgugacuauuggggaauguccuaaauauguccgcagcgcuaagcugagaaugguuaccggacucaggaauaucccaucgauccagucucggggccuuuuuggcgccauugcgggguucauagagggagguuggacaggcaugaucgaugggugguacggauaucaccaucaaaacgaacagggcuccgguuacgccgcagaccagaaaucaacccagaaugcuauuaacgggaucacgaauaaggugaacacuguaauagagaagaugaacauucaauuuacagccgugggcaaagaguucaauaagcuggaaaaacgcauggagaacuugaauaagaaagucgaugacggauuucuagacaucuggaccuacaacgcugaacugcucgugcugcuugagaaugaacgaacucuggauuuccacgacaguaacguuaagaauuuguaugagaaggugaaaagccagcucaagaacaaugccaaagaaaucggcaacgggugcuucgaguuuuaccacaagugugauaaugagugcauggaauccgucagaaacggaacauaugacuaccccaaauauucugaggaaagcaagcugaauagggagaagguggaugguguaaaauuagagucaaugggcauuuaccagauccuggcaauuuauaguaccguugccuccagccuagugcuccuggucucucuuggggcuauaucauucuggaugugcaguaacggcagcuugcaaugucggaucugcauuuga

SEQ ID NO: 132190 - RNA, 1689 nt, Artificial Sequence
  derived and/or modified sequence opt3 from hemagglutinin__InfluenzaA__AGQ80946
auggccaucauuuaccugauacuccuuuucaccgcugugagaggcgaccagaucugcauuggguaucacagcaacaauuccacagagaaggucgauacuauccuggaaaggaacguuacggugacccaugcacaagacauuuuggagaaaacacacaauggaaaguuauguaaacugaacgguauacccccucuagaacucggcgauugcucuaucgccggguggcugcuuggaaauccagagugugaccggcuguugacuguaccggaauggucauacaucauggagaaggagaacccccgcaauggccucugcuauccugguaguuuuaacgauuacgaagaacugaaacaucugcucagcuccgugacccacuucgaaaaggucaagauuuuaccaaaagaccgauggacacagcauaccacuacagggggaucucgugcgugugcugugucgggcaaucccucauuuuucagaaacaugguuuggcugaccaagaaaggcccuaauuauccaguggccaaggggagcuacaacaauacgaguggagaucagaugcuuaucauuugggguguccaccaccccaacgacgaggcagagcagaggacuuuguaucaaaaugugggcaccuacguauccguugggacaucuacucugaacaaacggagcgugccugaaaucgccacccgcccaaaggucaacggacagggcgguagaauggaguuuuccuggacaauacuagaugugcucgacaccauuaauuucgaaucaacggggaaccugaucgcuccggaguacggauuuaagauuaguaaaaggggcagcucuggcaucaugaagacugaagggacacuugagaauugcgagaccaaaugucagacuccccugggagcaaucaacacaaccuugccuuuccauaauauucacccacucacgauaggugaaugccccaaguaugugaaauccgagcggcuggucuuagccaccggccugcgcaacguuccucagaucgaaucacgagggcucuuuggagcuauugccggcuucaucgaggguggguggcaaggcaugguggauggaugguacggcuaucaucacagcaaugaccaggggaguggauacgcggcagauaaggaaucuacacagaaagccauagacgguauuacuaacaagguaaauuccgugaucgagaagaugaacacccaguuugaggcugucggcaaagaguucagcaaucuugagaagagacuggaaaacuugaauaaaaagauggaggacggguuucuagauguguggacauauaacgccgaacugcucguucugauggagaaugagaggacucuugacuuccacgauucgaacgugaaaaaccuguacgacaagguccggaugcaauugcgugauaaugcaaaggaacucggaaacggcuguuucgaguuuuaucauaaaugcgacgaugaauguaugaacucugugaagaaugguaccuacgacuacccaaaauaugaggaggaauccaagcugaaucgcaacgagaucaaagggguaaaguuaucaaauaugggcguuuaccagauucuggcuaucuaugccacaguggcgggaagucuaagccucgccauuaugauagcaggcaucucccuguggaugugcucuaacgggagccuucagugcagaauuuguaucuga

SEQ ID NO: 132191 - RNA, 1689 nt, Artificial Sequence
  derived and/or modified sequence opt3 from hemagglutinin__InfluenzaA__AGQ80947
auggccaucauuuaccugauacuccuuuucgcuaccgugagaggcgaccagaucugcauuggguaucacagcaacaauuccacagagaaggucgauacuauccuggaaaggaacauuacgguuacccaugcacaagacaucuuggagaaaacacacaauggaaaguuauguaaacugaacgguauacccccucuagaacucggcaauugcucuaucgccggguggcugcuuggaaacccagagugugaucggcuguugacugugccggaauggucauacauuauggagaaggagaauccccgcgacggccucugcuauccugguaguuuuaacgauuacgaagaacugaaacaucugcucagcuccguaacccacuucgaaaaggugaagaucuuaccaaaagaccgauggacacagcauaccacuacagggggaucucgugcgugugcugucucgggcaaucccucauuuuucagaaacaugguguggcugaccaagaaaggcagcaauuauccuauugccaaggggaguuacaacaauacguccggagagcagaugcuuaucauaugggguguucaccacccaaacgaugacgcagagcagaggacuuuguaucaaaaugugggcaccuacgucucuguggggacaagcacucugaacaaacgguccauucccgaaaucgccacccgcccuaagguaaacggacagggcgguagaauggaguuuucauggacaauucuagauaugcucgacaccaucaauuucgaaaguacggggaaccugaucgcuccagaguacggauuuaagauuagcaaaagggggucuuccggcauaaugaagacugaaggcacacuugagaauugcgagaccaaaugucagacuccgcugggagcaaucaacacaaccuugcccuuccauaauauucacccucucacgaucggugaaugcccaaaguauguuaaaucagagcggcugguguuagccaccggccugcgcaacgucccccagauagaaagccgagggcucuuuggagcuauugccggcuucaucgaggguggguggcaaggcaugguggauggaugguacggcuaucaucacaguaaugaccaggggucuggauacgcggcagauaaggaauccacacagaaagccaucgacgguauuacuaacaaggugaauagcgucaucgagaagaugaacacccaguuugaggcuguuggcaaagaguucaauaaccuugagaagagacuggaaaauuugaacaaaaagauggaggacggguuucuagauguguggacauauaaugccgaacugcucguacugauggagaacgagaggacucuugacuuccacgauucgaacgugaaaaaucuguacgacaagguccggaugcaauugaaggauaacgcaaaagaacucggaaauggcuguuucgaguuuuaucauaagugcgacgaugaauguaugaacucugugaaaaaugguaccuacgacuacccuaaguaugaggaggaauccaaacugaaccguaaugagauuaaggggguuaaguuaucaaacaugggcguguaccagauacuggcuaucuaugccacagucgcgggaagucuaagccucgccauuaugaucgcaggcgugucccuguggaugugcucuaaugggagccuucagugccgcaucuguauuuga

SEQ ID NO: 132192 - RNA, 1689 nt, Artificial Sequence
  derived and/or modified sequence opt3 from hemagglutinin__InfluenzaA__AGQ80948
auggccaucauuuaccugauacuccuuuucgcugcagugagaggcgaccagaucugcauuggguaucacagcaacaauuccaccgagaaggucgauacaauccuggaaaggaacguuacugugacgcaugcccaagacauuuuggagaaaacccacaauggaaaguuauguaaacugaacgguauacccccucuagaacucggcaauugcucuaucgcgggguggcugcuuggaaacccagagugugaucggcuguugacaguaccggaauggucauacaucauggagaaggagaauccccgcaacggccucugcuauccugguaguuuuaaugacuacgaggaacugaaacaucugcucagcuccgugacucacuucgaaaaggucaagauuuuaccaaaagaucgauggacccagcauacaaccacugggggaucucgugcuugugccguguuuggcaaccccucguucuuuagaaauaugguuuggcugacaaagaaaggcucaaacuauccuaucgcaaaggggagcuacaauaacaccaguggagagcagaugcuuauuaucuggggugugcaccacccaaaugacgaugccgagcagaggacguuguaucaaaacgucggcacuuacguguccguagggaccucuacacugaacaaacggagcauacccgaaauugcuacucgcccuaagguuaauggacagggcgguagaauggaguucuccuggaccauccuagacaugcucgauacaauuaacuuugaaucaaccgggaaucugaucgcaccagaguacggauucaagaucaguaaaaggggcagcucuggcauuaugaagacggaagggacucuugagaacugcgagacaaaaugucagaccccgcugggagccauaaauacuacauugcccuuucauaacauccacccucucaccauuggugaaugcccaaaguaugugaaauccgagcggcuggucuuagcuacgggccugcgcaaugugccccagaucgaaucacgaggacucuucggggccauagcgggcuuuauugaggguggguggcaaggcaugguggacggaugguacggcuaucaucacagcaacgaucaggggaguggauacgcagccgacaaggaaucuacccagaaagcuaucgaugguaucacaaauaaggucaacuccguuauugagaagaugaauacucaguucgaggccgugggcaaagaauuuaacaaucuugagaagagacuggaaaacuugaauaaaaagauggaggacggguuccuagacguauggaccuauaacgcagaacugcucgugcugauggagaacgagaggacacuugauuuccacgacagcaaugucaaaaaccuguacgauaagauccggaugcaauugaaggacaaugcuaaagaacucggaaacggcuguuuugaguucuaucauaagugcgaugacgaauguaugaacucggugaaaaaugguacuuacgauuacccuaaguaugaggaggaaucuaaacugaaucguaacgagauuaaggggguuaaguuauccaauaugggcguguaccagauacuggccaucuaugcgaccgucgccggaucacuaagucucgcaauuaugaucgcuggcaucagccuguggaugugcuccaacgggucucuucagugccgcauuuguauauga

SEQ ID NO: 132193 - RNA, 1689 nt, Artificial Sequence
  derived and/or modified sequence opt3 from hemagglutinin__InfluenzaA__AGQ80949
auggccaucauuuaccugauacuccuuuucgcugcagugagaggcgaccagaucugcauuggguaucacagcaacaauuccaccgagaaggucgauacaauccuggaaaggaacguuacugugacgcaugcccaagacauuuuggagaaaacccacaauggaaaguuauguaaacugaacgguauacccccucuagaacucggcgauugcucuaucgcgggguggcugcuuggaaauccagagugugaccggcuguugacaguaccggaauggucauacaucauggagaaggagaacccccgcaauggccucugcuauccugguaguuuuaacgauuacgaagaacugaaacaucugcucagcuccgugacucacuucgaaaaggucaagauuuuaccaaaagaccgauggacccagcauacaaccacugggggaucucgugcuugugccgugucgggcaaucccucauuuuucagaaacaugguuuggcugacaaagaaaggcagcaauuauccuaucgcaaaggggaguuacaacaauaccuccggagagcagaugcuuauuaucuggggugugcaccacccaaacgaugacgccgagcagaggacguuguaucaaaaugucggcacuuacgugucuguagggaccagcacacugaacaaacgguccauacccgaaauugcuacucgcccuaagguuaacggacagggcgguagaauggaguuuucauggaccauccuagauaugcucgacacaauuaauuucgaaaguaccgggaaccugaucgcaccagaguacggauuuaagaucagcaaaagggggucuuccggcauuaugaagacggaaggcacucuugagaauugcgagacaaaaugucagaccccgcugggagccauaaacacuacauugcccuuccauaauauccacccucucaccauuggugaaugcccaaaguaugugaaaucagagcggcuggucuuagcuacgggccugcgcaacgugccccagaucgaaagccgagggcucuuuggagccauagcgggcuucauugaggguggguggcaaggcaugguggauggaugguacggcuaucaucacaguaaugaccaggggucuggauacgcagccgauaaggaauccacccagaaagcuaucgacgguaucacaaacaaggucaauagcguuauugagaagaugaacacucaguuugaggccgugggcaaagaguucaauaaccuugagaagagacuggaaaauuugaacaaaaagauggaggacggguuucuagauguauggaccuauaaugcagaacugcucgugcugauggagaacgagaggacacuugacuuccacgauucgaacgucaaaaaucuguacgacaagauccggaugcaauugaaggauaacgcuaaagaacucggaaauggcuguuucgaguuuuaucauaagugcgacgaugaauguaugaacucugugaaaaaugguacuuacgacuacccuaaguaugaggaggaauccaaacugaaccguaaugagauuaaggggguuaaguuaucaaacaugggcguguaccagauacuggccaucuaugcgaccgucgccggaagucuaagccucgcaauuaugaucgcuggcaucucccuguggaugugcucuaaugggagccuucagugccgcauuuguauauga

SEQ ID NO: 132194 - RNA, 1701 nt, Artificial Sequence
  derived and/or modified sequence opt3 from hemagglutinin__InfluenzaA__AGQ80950
augaagaccaucauugcccugagcuacauauucugccucgcuuuuggccagaaccuucccgggaaugacuccucuacagcaacucuguguuugggacaccaugccguguuaaacgguacgaucgucaaaaccauuacagaugaccaaaucgagguuacuaaugcgaccgaacuggugcagucaaguagcacaggcaagauuugcaacaauccucacaaaauccuagaugggagagacuguacccucauagaugcucugcuuggagacccacauugcgauguauuccaggacgagacuugggaucuguuuguggaaagguccucugccuucucgaacuguuauccguacgacguccccgauuaugcaucauugcggagccucguggccaguuccggcacacuggaguuuaucaccgaagguuucacguggacugggguuucucagaauggaggcagcggcgcuugcaagcgcgggccugcaaacggauuuuucucccgacugaauuggcucaccaaaucagguaacgccuacccaguguuaaaugucacaaugcccaacagugacaauuuugauaagcuguauauuuggggcgugcaccauccuagcacuaaccaagagcagaccaaucuuuacguacaggcuucugggcguguuacaguguccaccagaaggucacagcaaacgaucauuccaaacaucggaagccggcccuggguccgcggccagagugguagaauaucuauuuauuggacuaucgugaagccuggggacguguuggucauuaacuccaauggaaaccugaucgccccaaggggcuacuucaaaaugcggacaggcaagagcucgaucaugcgcucugacgcgccgauugagaccuguauauccgaaugcaucacucccaaugggucaauuccuaacgauaaaccauuucagaauguuaacaagaucacauacggagcaugucccaaauaugugaagcagaauacccuaaagcucgccacggguaugcgaaacguaccugagaaacaaaccagaggccuguucggggcuauagccggauuuauugaaaauggcugggaggguaugaucgacgggugguacggcuucaggcaccagaacagugagggaacaggccaggcagcugaucuuaagagcacucaagccgcgaucgaccagauuaaugggaaacugaaccgggugaucgaaaagaccaaugagaaauuccaccagauugaaaaggaguuuuccgaagucgagggacguauacaggauuuggagaaauauguggaagacacaaagaucgaucucuggucuuacaacgccgagcuguuaguugcacuggaaaaucaacauacuauugaccucaccgauagcgagaugaacaaacuuuucgaaaagacacgcagacagcugagggagaacgcugaggacauggguaauggcugcuuuaagaucuaucacaaaugugauaacgccugcaucgaaucaauucggaaugggaccuacgaccaugacauauaucgagaugaggcuuugaacaaucgcuuccagaucaagggaguggaacuaaaaaguggcuacaaggacuggauucuguggaucuccuuugccauuagcugcuuccuccugugugucgugcuucuggguuuuaucaugugggcaugccagagagggaacauaagguguaauaucugcauuuga

SEQ ID NO: 132195 - RNA, 1695 nt, Artificial Sequence
  derived and/or modified sequence opt3 from hemagglutinin__InfluenzaA__AGQ80951
augcugagcaucgugauucucuuccuucuggucgccgaguccucuucacagaacuacaccggcaaucccguuauaugcauggggcaccaugcuguggcaaacggaacaaugguaaagacuuugacggacgaucaaguggaagucgugaccgcccaggaguuaguugaaagucagaaucugccugagcuauguccaagcccgcucagacugguggacggucagacaugcgauaucauuaacggcgcgcuugggucccccggaugugaccaccugaauggcgcugaaugggauaucuuuauugagaggccuaacgccauggacacuugcuauccauucgauguccccgacuaccaaucuuugcggucgauccucgcaaauaacgguaaauuugaguucauagccgaagaguuucaguggucaaccgugaagcagaaugggaaaagcggagcuuguaagcgcgcaaacguaaaugauuucuuuaaccgacugaauuggcugguuaaaagugacggcaacgccuauccucuccagaauuuaacaaaggugaacaacggcgauuacgcucgucuguauaucuggggaguccaucacccauccaccgacacugaacaaacaaaucuuuacaagaacaaucccgggagagugaccgugucuacgaaaacuagccagaccuccgucguuccuaacauugguucaaggccaugggugcggggccagagugggcgcaucagcuucuauuggacaauuguagagccgggagauuugaucguguuuaauacuauaggcaaccugauugcccccagaggucauuacaagcuaaauucucagaaaaaguccaccauccucaacacagcgaccccuauugggucaugcgucagcaaaugucacacggacaagggaagucugucuacuacaaagccauuccaaaauaucuccaggguggcaaucggcgacugccccaaauacguuaagcagggcagccuuaaacuggccaccgggaugcggaacauuccugagaaggcuucgcgcggauuguuuggugccauagcaggcuucaucgaaaauggguggcagggacucauugauggcugguaugguuuucgacaccaaaacgcugaggggacuggcacagccgcggaccugaaaucuacccaggccgcaaucgaucagauaaauggaaaguuaaacagacugauugagaaaacgaaugaaaaguaccaucagaucgaaaaggaguucgagcaaguggaaggcaggauccaggaccucgagaaauaugucgaagauaccaagauugaccuuugguccuacaacgcugagcuguugguggcccuagaaaaccagcacacaaucgauguaacugacucagagaugaauaaacuguucgagcggguucgucgccagcucagagaaaacgcugaggauaaggggaauggauguuuugaaauuuuccauaaaugcgacaacaauuguauagagaguaucaggaacgguaccuaugaucacgacguguaccggaaugaagccauuaacaaucgauuucaaauccagggcgucaagcugacacagggguauaaggacaucauucuuuggaucagcuucuccauaucuugcuuucuguugguggcacuccuguuagccuucauucugugggcuugccagaacggaaauauccgcugucaaauuugcaucuga

SEQ ID NO: 132196 - RNA, 1683 nt, Artificial Sequence
  derived and/or modified sequence opt3 from hemagglutinin__InfluenzaA__AGQ80953
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaacgcgcuguugauuugggccaaugcggguuacugggaacaauuaccggcccaccgcagugugaccaguuucuagaguucucagccgaucucaucauagaacgacgugaggguagugacgugugcuaccccgggaaguuugucaaugaggaagcacugagacagauccuuagggagagcggaggcauugauaaagaaacuaugggcuucacauauuccgggauccggaccaacggagccacgucugcuugucgcagaucggguagcucauuuuacgcagagaugaaguggcuguugaguaauacugacaacgccgcuuucccucaaaccacaaaguccuauaaaaauacuaggaaggauccagcccucauuaucuggggcauacaccauucugggagcaccacagagcagaccaaacuguacggauccggcaacaagcugauuacgguggguucaaguaauuaucagcagagcuuuguacccucuccuggggcgcggccacaaguuaacggacaguccggccgcaucgacuuccacuggcucauguuaaaucccaacgauacugugacauuuucauucaauggcgcauuuauugccccugaccgagcuagcuuccugagagggaaaaguaugggaauccagucugguguccagguggaugccaacugcgaaggcgacuguuaccauaacgggggaaccaucauuuccaaucuuccauuucaaaacauaaauagcagggcagugggcaagugcccgcgguaugucaagcaggagucguugcugcuagcuacugguaugaaaaacguucccgaaaucccuaaggggcguggccucuucggagccauugcgggcuucaucgagaaugggugggaaggacugauagaugguugguacggcuuucgccaccagaacgcccaaggggagggaacagcagcugacuacaaaucuacccaguccgccauugaccagaucacgggcaaacuuaauagacugaucgagaagaccaaccagcaauucgaauugauugauaaugaguuuacagaaguggagaggcagaucgguaacguaauuaauuggacucgggacucaaugaccgaaguguggaguuauaacgcugagcuccuggucgccauggagaaucagcacacaauagauuuagcagacagcgaaaugaacaagcuguacgagcgagugcgcagacagcucagggaaaaugccgaggaagaugggacuggcuguuucgagaucuuucauaaaugcgacgaugacuguauggcuuccauucggaacaacaccuaugaucacucuaaguaccgcgaggaagcgaugcaaaauagaauccagaucgacccaguuaaacuuagcucaggauauaaggaugugauucugugguucaguuuuggcgcauccugcuucauauugcuagccaucgcuauggggcuggucuuuauuugcgugaagaacggaaauaugagguguacaaucugcauuuga

SEQ ID NO: 132197 - RNA, 1683 nt, Artificial Sequence; identical to SEQ ID NO: 132196
  derived and/or modified sequence opt3 from hemagglutinin__InfluenzaA__AGQ80954

SEQ ID NO: 132198 - RNA, 1683 nt, Artificial Sequence; identical to SEQ ID NO: 132196
  derived and/or modified sequence opt3 from hemagglutinin__InfluenzaA__AGQ80955

SEQ ID NO: 132199 - RNA, 1683 nt, Artificial Sequence; identical to SEQ ID NO: 132196
  derived and/or modified sequence opt3 from hemagglutinin__InfluenzaA__AGQ80956

SEQ ID NO: 132200 - RNA, 1683 nt, Artificial Sequence; identical to SEQ ID NO: 132196
  derived and/or modified sequence opt3 from hemagglutinin__InfluenzaA__AGQ80957

SEQ ID NO: 132201 - RNA, 1683 nt, Artificial Sequence; identical to SEQ ID NO: 132196
  derived and/or modified sequence opt3 from hemagglutinin__InfluenzaA__AGQ80958

SEQ ID NO: 132202 - RNA, 1683 nt, Artificial Sequence
  derived and/or modified sequence opt3 from hemagglutinin__InfluenzaA__AGQ80959
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaggauccagcccucaucauauggggcauucaccauuccgggucuacugcggagcagaccaaacuguacggaagcggcaauaagcuggucacaguggguuccucaaacuaucagcagaguuuuguacccagcccuggggcacggccacaaguuaauggacagucuggccgcaucgacuuccacuggcucauguuaaaccccaaugauaccgugacguuuuccuucaacggcgccuuuauugcuccugaccgagccucauuccugagagggaaaagcaugggaauccagagugguguccagguggaugcaaacugcgaaggcgacuguuaccaugggggaggcacuaucauuucuaaucuuccauuucaaaacauagauuccagggcuguggguaagugcccgcgguaugucaagcagaaaucguugcugcuagccacagggaugaagaauguucccgagagcccuaaaggccguggacucuucggcgcgaucgccggguucauugaaaacggaugggagggucugaucgacggcugguacggguuucgccaccagaaugcacaaggagaaggcaccgcugccgacuacaagucuacucaguccgcuauagaucagauuacagguaaacuuaacagacugaucgagaagaccaaucagcaauucgaguugaucgacaacgaauuuacggagguggaaaaacagauugggaauguaaucaacuggaccagggauucaauuacagagguguggaguuauaaugccgaacuccuggucgcaauggagaaccagcacacuauagacuuagccgauagcgagaugaauaagcuguacgaacgggugaagcgacagcuccgcgagaacgcugaagaggacggcaccggauguuucgaaaucuuucauaaaugcgaugacgauuguauggcguccauuagaaauaacacauaugaccacucuaaguacagggaggaggcaaugcaaaaccggauccagaucgauccaguuaaacuuagcucaggcuauaaggacgugauucugugguucaguuuuggggccuccugcuucauauugcuagcuaucgccaugggacuggucuuuauuugcgugaaaaaugguaacaugcgcuguacuaucugcauuuga

SEQ ID NO: 132203 - RNA, 1683 nt, Artificial Sequence
  derived and/or modified sequence opt3 from hemagglutinin__InfluenzaA__AGQ80961
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccaauguuccuaagauuuguuccaaagguaagcggacaguggauuugggccaaugcggguuacugggaaccaucacuggcccaccgcagugugaccaguuucuagaguucucugcugaucucauuaucgaacgccgagaggguucagacgucugcuaccccgggaaauuugugaacgaggaaacacugcgucagauacuuagagagaguggaggcaucgauaaggaaaccaugggcuucacguauagcgggauuaggacuaauggagccaccuccgcaugucggcgcucugguucgucauuuuacgccgagaugaaguggcuguugagcaacacagacaaugcugcauucccucaaaugacuaaaaguuauaagaacgccagaaaagauccagcucucaucauuuggggcauccaccauuccgggucuaccacagagcagaccaagcuguacggaagcggcaauaaacugauaacgguagguuccucaaacuaucagcagaguuuuguucccagcccuggggccaggccacaagugaauggacagucuggccggauugacuuccacuggcucauguuaaaccccaaugauacugucacauuuuccuucaacggcgcguuuaucgcaccugaccgcgccugcuuccugcgagggaagucaauggguauucagagcggaguccagguggaugcuaguugugaaggcgacugcuaccauucugggggaaccaucaucuccaaccuuccauuucaaaauauuaacagcagagccgugggcaaguguccgagguauguuaaacaggagucguugaugcuggcaacugguaugaagaaugugcccgaaauaccuaaagggcggggccuauucggagcuaucgccggcuucauugagaacgggugggaaggacucaucgaugguugguacggcuuucgucaccagaaugcgcaaggggagggaacagccgcagacuacaagucuacccaguccgcuauagaccagauuacgggcaaacugaaccgccuuaucgagaagaccaaucagcaauucgaacugaucgauaacgaguuuacagaaguagagaaacagauugguaaugugaucaacuggacuagagacucaaugaccgaagucuggaguuauaaugccgaguugcucguggcuauggagaaccagcacacaauugaucuggccgacagcgaaaugaauaaguuauacgagaggguuaagcggcagcugcgagaaaacgcagaggaagaugggacuggcugcuucgagauauuucauaaaugugacgaugacugcauggccuccauccgcaauaacaccuaugaucacucuaaguacagagaggaagcuaugcaaaacaggauuaaaaucgacccagugaagcucagcucaggauauaaagaugucauccuuugguucaguuuuggcgcguccugcuucauucuguuggcaauagccauggggcuaguguuuaucuguguaaagaauggaaacaugcggugcacaauuuguaucuga

SEQ ID NO: 132204 - RNA, 1683 nt, Artificial Sequence; identical to SEQ ID NO: 132203
  derived and/or modified sequence opt3 from hemagglutinin__InfluenzaA__AGQ80962

SEQ ID NO: 132205 - RNA, 1683 nt, Artificial Sequence
  derived and/or modified sequence opt3 from hemagglutinin__InfluenzaA__AGQ80964
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaggauccagcccucaucauauggggcauucaccauuccgggucuacugcggagcagaccaaacuguacggaagcggcaauaagcuggucacaguggguuccucaaacuaucagcagaguuuuguacccagcccuggggcacggccacaaguuaauggacagucuggccgcaucgacuuccacuggcucauguuaaaccccaaugauaccgugacguuuuccuucaacggcgccuuuauugcuccugaccgagccucauuccugagagggaaaagcaugggaauccagagugguguccagguggaugcagacugcgaaggcgauuguuaccauucugggggaacuaucauuuccaaccuuccauuucaaaauauagacagcagggcugugggcaagugcccgcgguaugucaagcagcguucguugcugcuagccacagguaugaaaaacguucccgagaucccuaaggggcgcggccucuucggagcgauugccggcuucaucgaaaaugggugggagggacugauagacgguugguacggcuuuagacaccagaacgcacaaggggaaggaaccgcugccgauuacaaaucuacucaguccgcuauugaccagaucacaggcaaacuuaauaggcugaucgagaagaccaaccagcaauucgaguugauugauaaugaauuuacggagguggaaaagcagaucgguaacguaauuaauuggacccgggacucaauaacagagguguggaguuauaacgccgaacuccuggucgcaauggagaaucagcacacuaucgauuuagccgacagcgagaugaacaaacuguacgaacgagugaagcgccagcucagagagaaugcugaagaggaugggaccggcuguuucgaaauuuuucauaagugcgacgaugacuguauggcguccaucaggaacaauacauaugaucacucuaaauaccgggaggaggcaaugcaaaaccgcauccagauugacccaguuaaacuuagcucaggauauaaggacgugauacugugguucaguuuuggcgccuccugcuucaucuugcuagcuauugccauggggcuggucuuuaucugcgugaagaacggaaauaugagauguacuauuugcaucuga

SEQ ID NO: 132206 - RNA, 1683 nt, Artificial Sequence; identical to SEQ ID NO: 132196
  derived and/or modified sequence opt3 from hemagglutinin__InfluenzaA__AGQ80965

SEQ ID NO: 132207 - RNA, 1683 nt, Artificial Sequence; identical to SEQ ID NO: 132196
  derived and/or modified sequence opt3 from hemagglutinin__InfluenzaA__AGQ80966

SEQ ID NO: 132208 - RNA, 1683 nt, Artificial Sequence; identical to SEQ ID NO: 132196
  derived and/or modified sequence opt3 from hemagglutinin__InfluenzaA__AGQ80968

SEQ ID NO: 132209 - RNA, 1683 nt, Artificial Sequence
  derived and/or modified sequence opt3 from hemagglutinin__InfluenzaA__AGQ80970
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaaaaggcuguugauuugggccaaugcggguuacugggaacaauuaccggcccaccgcagugugaccaguuucuagaguucucagccgaucucaucauagaacgccgagaggguagugacgugugcuaccccgggaaauuugucaaugaggaagcacugcgucagauccuuagagagagcggaggcauugauaaggaaacuaugggcuucacauauuccgggaucaggaccaacggagccacgucugcuugucggcgcucggguagcucauuuuacgcagagaugaaguggcuguugaguaauacugacaacgccgcuuucccucaaaccacaaaauccuauaagaauacuagaaaagauccagcccucauuaucuggggcauacaccauucugggagcaccacagagcagaccaagcuguacggauccggcaacaaacugauuacgguggguucaaguaauuaucagcagagcuuuguacccucuccuggggcgaggccacaaguuaacggacaguccggccggaucgacuuccacuggcucauguuaaaucccaacgauacugugacauuuucauucaauggcgcauuuauugccccugaccgcgcuagcuuccugcgagggaagaguaugggaauccagucugguguccagguggaugccaacugcgaaggcgacuguuaccauaacgggggaaccaucauuuccaaucuuccauuucaaaacauaaauagcagagcagugggcaagugcccgagguaugucaaacaggagucguugcugcuagcuacugguaugaagaacguucccgaaaucccuaaagggcggggccucuucggagccauugcgggcuucaucgagaaugggugggaaggacugauagaugguugguacggcuuucgucaccagaacgcccaaggggagggaacagcagcugacuacaagucuacccaguccgccauugaccagaucacgggcaaacuuaaucgccugaucgagaagaccaaccagcaauucgaauugauugauaaugaguuuacagaaguggagagacagaucgguaacguaauuaauuggacuagggacucaaugaccgaaguguggaguuauaacgcugagcuccuggucgccauggagaaucagcacacaauagauuuagcagacagcgaaaugaacaaacuguacgagcgggugcgacgccagcucagagaaaaugccgaggaagaugggacuggcuguuucgagaucuuucauaagugcgacgaugacuguauggcuuccauuaggaacaacaccuaugaucacucuaaguaccgggaggaagcgaugcaaaaucgcauccagaucgacccaguuaaacuuagcucaggauauaaggaugugauucugugguucaguuuuggcgcauccugcuucauauugcuagccaucgcuauggggcuggucuuuauuugcgugaaaaacggaaauaugagauguacaaucugcauuuga

SEQ ID NO: 132210 - RNA, 1683 nt, Artificial Sequence
  derived and/or modified sequence opt3 from hemagglutinin__InfluenzaA__AGQ80971
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaaaagacaguugauuugggccaaugcggguuacugggaaccauuacuggcccaccgcagugugaccaguuucuagaguucucagcugaucucaucauagaacgccgagaggguagugacgugugcuaccccgggaaauuugucaaugaggaagcccugcgucagauccuuagagagagcggaggcauugauaaggaaacaaugggcuucaccuauuccgggaucaggacgaacggagcaacuucugccugucggcgcucggguagcucauuuuacgcugagaugaaguggcuguugaguaauaccgacaacgcagccuucccucaaacaacuaaauccuauaagaauaccagaaaagauccagcucucauuaucuggggcauacaccauucugggagcacaaccgagcagacgaagcuguacggauccggcaacaaacugauuacuguggguucaaguaauuaucagcagagcuuuguacccucuccuggggccaggccacaaguuaacggacaguccggccggaucgacuuccacuggcucauguuaaaucccaacgauacagugaccuuuucauucaauggcgcguuuauugcaccugaccgcgccagcuuccugcgagggaagaguaugggaauccagucugguguccagguggaugcuaacugcgaaggcgacuguuaccauaacgggggaacuaucauuuccaaucuuccauuucaaaacauaaauagcagagccgugggcaagugcccgagguaugucaaacaggagucguugcugcuagcaacagguaugaagaacguucccgaaaucccuaaagggcggggccucuucggagcuauugccggcuucaucgagaaugggugggaaggacugauagaugguugguacggcuuucgucaccagaacgcgcaaggggagggaaccgccgcagacuacaagucuacgcaguccgcuauugaccagaucaccggcaaacuuaaucgccugaucgagaagacaaaccagcaauucgaauugauugauaaugaguuuacugaaguggagagacagaucgguaacguaauuaauuggaccagggacucaaugacagaaguguggaguuauaacgccgagcuccuggucgcuauggagaaucagcacacuauagauuuagccgacagcgaaaugaacaaacuguacgagcgggugcgacgccagcucagagaaaaugcagaggaagaugggaccggcuguuucgagaucuuucauaagugcgacgaugacuguauggccuccauuaggaacaacacauaugaucacucuaaguaccgggaggaagcuaugcaaaaucgcauccagaucgacccaguuaaacuuagcucaggauauaaggaugugauucugugguucaguuuuggcgcguccugcuucauauugcuagcaaucgccauggggcuggucuuuauuugcgugaaaaacggaaauaugagauguaccaucugcauuuga

SEQ ID NO: 132211 - RNA, 1683 nt, Artificial Sequence
  derived and/or modified sequence opt3 from hemagglutinin__InfluenzaA__AGQ80974
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaacgcgcuguugauuugggccaaugcggguuacugggaacaauuaccggcccaccgcagugugaccaguuucuagaguucucagccgaucucaucauagaacgacgugaggguagugacgugugcuaccccgggaaguuugucaaugaggaagcacugagacagauccuuagggagagcggaggcauugauaaagaaacuaugggcuucacauauuccgggauccggaccaacggagccacgucugcuugucgcagaucggguagcucauuuuacgcagagaugaaguggcuguugaguaauacugacaacgccgcuuucccucaaaccacaaaguccuauaaaaauacuaggaaggauccagcccucauuaucuggggcauacaccauucugggagcaccacagagcagaccaaacuguacggauccggcaacaagcugauuacgguggguucaaguaauuaucagcagagcuuuguacccucuccuggggcgcggccacaaguuaacggacaguccggccgcaucgacuuccacuggcucauguuaaaucccaacgauacugugacauuuucauucaauggcgcauuuauugccccugaccgagcuagcuuccugagagggaaaaguaugggaauccagucugguguccagguggaugccaacugcgaaggcgacuguuaccauaacgggggaaccaucauuuccaaucuuccauuucaaaacauaaauagcagggcagugggcaagugcccgcgguaugucaagcaggagucguugcugcuagcuacugguaugaaaaacguucccgaaaucccuaaggggcguggccucuucggagccauugcgggcuucaucgagaaugggugggaaggacugguggaugguugguacggcuuucgccaccagaacgcccaaggggagggaacagcagcugacuacaaaucuacccaguccgccauagaccagauuacgggcaaacuuaauagacugaucgagaagaccaaccagcaauucgaauugaucgauaaugaguuuacagaaguagagaggcagauugguaacgugaucaauuggacucgggacucaaugaccgaagucuggaguuauaacgcugagcuccugguggccauggagaaucagcacacaauugauuuagcagacagcgaaaugaacaagcuguacgagcgaguucgcagacagcucagggaaaaugccgaggaagaugggacuggcuguuucgagauauuucauaaaugcgacgaugacuguauggcuuccauccggaacaacaccuaugaucacucuaaguaccgcgaggaagcgaugcaaaauaggauucagaucgacccagugaaacuuagcucaggauauaaggaugucauccugugguucaguuuuggcgcauccugcuucauuuugcuagccauagcuauggggcugguguuuaucugcguaaagaacggaaauaugagauguacaauuugcaucuga

SEQ ID NO: 132212 - RNA, 1683 nt, Artificial Sequence
  derived and/or modified sequence opt3 from hemagglutinin__InfluenzaA__AGQ80977
augaacacccagauccuggcccucgcucuugcagccauuauacccacaaaugcggacaagaucugccugggccaccaugcugugagcaacgggacuaaagugaauacguugaccgagagaggaguugaagugguaaacgccacagagacuguggaaaggaccuccauuccucggaucuguucuaaggguaaacgcgcagucgauuuaggccaaugcgggcugcuaggaacaauuaccggcccaccgcagugugaccaguuccucgaguuuucagccgaucugaucauagaacgacgugaggguagugacgugugcuaccccgggaaguucguuaaugaggaagcucuuagacagauccugagggagagcggaggcauugauaaagaaacuaugggcuuuacauauuccgggauccggaccaacggagcaacgucugccugucgcagaucggguagcagcuucuacgcugagaugaagugguugcucaguaauacugacaacgccgcguuuccucaaaccacaaaguccuauaaaaauacuaggaaggauccagcacugauuaucuggggcgugcaccauucugggagcaccacagagcagaccaaacuguacggauccggcaacaagcucauaacggucgguucaaguaauuaucagcagagcuucgugcccucuccuggggcccggccacaaguaaacggacaguccggccgcauugacuuucacugguuaaugcugaaucccaacgauacuguuacauucucauuuaauggcgcuuucaucgccccugaccgagcaucauuucuuagagggaaaaguauggguauucagucuggagugcaggucgaugcuaacugcgaaggcgacuguuaccauaacgggggaaccaucaucuccaauuugccauuccaaaacauuaauagcagggccgugggcaagugcccgcgguaugugaagcaggagucgcugcuacucgcgacugguaugaaaaacguccccgaaauaccuaaggggcguggccuguuuggagccaucgcaggcuucauugagaaugggugggaaggacuuguugaugguugguacggcuuccgccaccagaacgcucaaggggagggaacagccgcugacuacaaaucuacccaguccgccaucgaccagauaacgggcaagcugaauagauugauugagaaaaccaaccagcaauuugaacucaucgauaaugaguucacagaaguggagaggcagaucgguaacguaauuaauuggacucgggacucaaugaccgaaguguggaguuauaacgcagagcuguuagucgccauggagaaucagcacacaaucgaucuggcugacagcgaaaugaacaagcucuacgagcgagugcgcagacagcuuagggaaaaugcggaggaagaugggacuggcuguuuugagauuuuccauaaaugcgacgaugacuguauggcauccauacggaacaacaccuaugaucacucuaaguaccgcgaggaagccaugcaaaauagaauccagauugacccaguuaagcugagcucaggauauaaagaugugaucuugugguuuaguuucggcgcuuccugcuuuauccuacuggccauugcaauggggcucgucuucauaugcgucaagagcggaaacaugagguguacaaucugcauuuga

SEQ ID NO: 132213 - RNA, 1683 nt, Artificial Sequence
  derived and/or modified sequence opt3 from hemagglutinin__InfluenzaA__AGQ80978
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaacgcgcuguugauuugggccaaugcggguuacugggaacaauuaccggcccaccgcagugugaccaguuucuagaguucucagccgaucucaucauagaacgacgugaggguagugacgugugcuaccccgggaaguuugucaaugaggaagcacugagacagauccuuagggagagcggaggcauugauaaagaaacuaugggcuucacauauuccgggauccggaccaacggagccacgucugcuugucgcagaucggguagcucauuuuacgcagagaugaaguggcuguugaguaauacugacaacgccgcuuucccucaaaccacaaaguccuauaaaaauacuaggaaggauccagcccucauuaucuggggcauacaccauucugggagcauuaccgagcagacaaaacuguacggauccggcaacaagcugaucaccguggguucaaguaauuaucagcagagcuuuguacccucuccuggggcgcggccacaaguuaacggacaguccggccgcauugacuuccacuggcucauguuaaaucccaacgauacggugacuuuuucauucaauggcgcauuuaucgccccugaccgagcuagcuuccugagagggaaaaguaugggaauccagucugguguccagguggaugccaacugcgaaggcgacuguuaccauaacgggggaacaauuauauccaaucuuccauuucaaaacaucaauagcagggcagugggcaagugcccgcgguaugucaagcaggagucguugcugcuagcuaccgguaugaaaaacguucccgaaauuccuaaggggcguggccucuucggagccaucgcgggcuucauagagaaugggugggaaggacugguggaugguugguacggcuuucgccaccagaacgcccaaggggagggaacugcagcugacuacaaaucuacacaguccgccauugaccagaucaccggcaaacuuaauagacugaucgagaagacgaaccagcaauucgaauugauugauaaugaguuuaccgaaguagagaggcagaucgguaacgugauuaauuggacacgggacucaaugacugaagucuggaguuauaacgcugagcuccugguggccauggagaaucagcacaccauagauuuagcagacagcgaaaugaacaagcuguacgagcgaguucgcagacagcucagggaaaaugccgaggaagaugggacaggcuguuucgagaucuuucauaaaugcgacgaugacuguauggcuuccauucggaacaacacuuaugaucacucuaaguaccgcgaggaagcgaugcaaaauagaauccagaucgacccagugaaacuuagcucaggauauaaggaugucauucugugguucaguuuuggcgcauccugcuucauauugcuagccaucgcuauggggcugguguuuauuugcguaaagaacggaaauaugagguguaccaucugcauuuga

SEQ ID NO: 132214 - RNA, 1683 nt, Artificial Sequence
  derived and/or modified sequence opt3 from hemagglutinin__InfluenzaA__AGQ80979
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaacgcgcuguugauuugggccaaugcggguuacugggaacaauuaccggcccaccgcagugugaccaguuucuagaguucucagccgaucucaucauagaacgacgugaggguagugacgugugcuaccccgggaaguuugucaaugaggaagcacugagacagauccuuagggagagcggaggcauugauaaagaaacuaugggcuucacauauuccgggauccggaccaacggagccacgucugcuugucgcagaucggguagcucauuuuacgcagagaugaaguggcuguugaguaauacugacaacgccgcuuucccucaaaccacaaaguccuauaaaaauacuaggaaggauccagcccucauuaucuggggcauacaccauucugggagcaccacagagcagaccaaacuguacggauccggcaacaagcugauuacgguggguucaaguaauuaucagcagagcuuuguacccucuccuggggcgcggccacaaguuaacggacaguccggccgcaucgacuuccacuggcucauguuaaaucccaacgauacugugacauuuucauucaauggcgcauuuauugccccugaccgagcuagcuuccugagagggaaaaguaucggaauccagucugguguccagguggaugccaacugcgaaggcgacuguuaccauaacgggggaaccauuauauccaaucuuccauuucaaaacaucaauagcagggcagugggcaagugcccgcgguaugucaagcaggagucguugcugcuagcuacugguaugaaaaacguucccgaaauuccuaaggggcguggccucuucggagccaucgcgggcuucauagagaaugggugggaaggacugauugaugguugguacggcuuucgccaccagaacgcccaaggggagggaacagcagcugacuacaaaucuacccaguccgccaucgaccagaucacgggcaaacuuaauagacugauugagaagaccaaccagcaauucgaauugaucgauaaugaguuuacagaaguggagaggcagauugguaacguaauaaauuggacucgggacucaaugaccgaaguguggaguuauaacgcugagcuccuggucgccauggagaaucagcacacaaucgauuuagcagacagcgaaaugaacaagcuguacgagcgagugcgcagacagcucagggaaaaugccgaggaagaugggacuggcuguuucgagauuuuucauaaaugcgacgaugacuguauggcuuccauccggaacaacaccuaugaucacucuaaguaccgcgaggaagcgaugcaaaauagaauccagauugacccaguuaaacuuagcucaggauauaaggaugugauacugugguucaguuuuggcgcauccugcuucaucuugcuagccauugcuauggggcuggucuuuaucugcgugaagaacggaaauaugagguguacaauuugcaucuga

SEQ ID NO: 132215 - RNA, 1683 nt, Artificial Sequence; identical to SEQ ID NO: 132211
  derived and/or modified sequence opt3 from hemagglutinin__InfluenzaA__AGQ80980

SEQ ID NO: 132216 - RNA, 1683 nt, Artificial Sequence; identical to SEQ ID NO: 132196
  derived and/or modified sequence opt3 from hemagglutinin__InfluenzaA__AGQ80981

SEQ ID NO: 132217 - RNA, 1683 nt, Artificial Sequence; identical to SEQ ID NO: 132196
  derived and/or modified sequence opt3 from hemagglutinin__InfluenzaA__AGQ80982

SEQ ID NO: 132218 - RNA, 1683 nt, Artificial Sequence; identical to SEQ ID NO: 132196
  derived and/or modified sequence opt3 from hemagglutinin__InfluenzaA__AGQ80983

SEQ ID NO: 132219 - RNA, 1683 nt, Artificial Sequence; identical to SEQ ID NO: 132196
  derived and/or modified sequence opt3 from hemagglutinin__InfluenzaA__AGQ80984

SEQ ID NO: 132220 - RNA, 1683 nt, Artificial Sequence; identical to SEQ ID NO: 132196
  derived and/or modified sequence opt3 from hemagglutinin__InfluenzaA__AGQ80985

SEQ ID NO: 132221 - RNA, 1683 nt, Artificial Sequence; identical to SEQ ID NO: 132196
  derived and/or modified sequence opt3 from hemagglutinin__InfluenzaA__AGQ80986

SEQ ID NO: 132222 - RNA, 1683 nt, Artificial Sequence; identical to SEQ ID NO: 132196
  derived and/or modified sequence opt3 from hemagglutinin__InfluenzaA__AGQ80987

SEQ ID NO: 132223 - RNA, 1683 nt, Artificial Sequence; identical to SEQ ID NO: 132196
  derived and/or modified sequence opt3 from hemagglutinin__InfluenzaA__AGQ80988

SEQ ID NO: 132224 - RNA, 1683 nt, Artificial Sequence
  derived and/or modified sequence opt3 from hemagglutinin__InfluenzaA__AGQ80990
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccuaagaucuguucuaaagguaagcgggcuguugauuugggccaaugcggguuacugggaacaauuaccggcccaccgcagugugaccaguuucuagaguucucagccgaucucaucauagaacgccgagaggguagugacgugugcuaccccgggaaauuugucaaugaggaagcacugcgucagauccuuagagagagcggaggcauugauaaggaaacuaugggcuucacauauuccgggaucaggaccaacggagccacgucugcuugucggcgcucggguagcucauuuuacgcagagaugaaguggcuguugaguaauacugacaacgccgcuuucccucaaaccacaaaauccuauaagaauacuagaaaagauccagcccucauuaucuggggcauacaccauucugggagcaccacagagcagaccaagcuguacggauccggcaacaaacugauuacgguggguucaaguaauuaucagcagagcuuuguacccucuccuggggcgaggccacaaguuaacggacaguccggccggaucgacuuccacuggcucauguuaaaucccaacgauacugugacauuuucauucaauggcgcauuuauugccccugaccgcgcuagcuuccugcgagggaagaguaugggaauccagucugguguccagguggaugccaacugcgaaggcgacuguuaccauaacgggggaaccaucauuuccaaucuuccauuucaaaacauaaauagcagagcagugggcaagugcccgagguaugucaaacaggagucguugcugcuagcuacugguaugaagaacguucccgaaaucccuaaagggcggggccucuucggagccauugcgggcuucaucgagaaugggugggaaggacugauagaugguugguacggcuuucgucaccagaacgcccaaggggagggaacagcagcugacuacaagucuacccaguccgccauugaccagaucacgggcaaacuuaaucgccugaucgagaagaccaaccagcaauucgaauugauugauaaugaguuuacagaaguggagagacagaucgguaacguaauuaauuggacuagggacucaaugaccgaaguguggaguuauaacgcugagcuccuggucgccauggagaaucagcacacaauagauuuagcagacagcgaaaugaacaaacuguacgagcgggugcgacgccagcucagagaaaaugccgaggaagaugggacuggcuguuucgagaucuuucauaagugcgacgaugacuguauggcuuccauuaggaacaacaccuaugaucacucuaaguaccgggaggaagcgaugcaaaaucgcauccagaucgacccaguuaaacuuagcucaggauauaaggaugugauucugugguucaguuuuggcgcauccugcuucauauugcuagccaucgcuauggggcuggucuuuauuugcgugaaaaacggaaauaugagauguacaaucugcauuuga

SEQ ID NO: 132225 - RNA, 1683 nt, Artificial Sequence; identical to SEQ ID NO: 132210
  derived and/or modified sequence opt3 from hemagglutinin__InfluenzaA__AGQ80991

SEQ ID NO: 132226 - RNA, 1683 nt, Artificial Sequence
  derived and/or modified sequence opt3 from hemagglutinin__InfluenzaA__AGQ80992
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccaauguuccucggauuuguuccaaggguaaacgcacaguggauuugggccaaugcggguuacugggaaccaucacuggcccaccgcagugugaccaguuucuagaguucucugcugaucucauuaucgaacgacgugaggguucagacgucugcuaccccgggaaguuuaugaacgaggaagcccugagacagauacuuagggagaguggaggcaucgauaaagaaacaaugggcuucaccuauagcgggauucggacgaauggagcaacuuccgccugucgcagaucugguucgucauuuuacgcugagaugaaguggcuguugagcaacaccgacaaugcagccuucccucaaaugacaaagaguuauaaaaacacuaggaaggauccagcucucaucauuuggggcauccaccauuccgggucuaccacagagcagaccaaacuguacggaagcggcaauaagcugauaacgguggguuccucaaacuaucagcagaguuuuguacccagcccuggggcccggccacaaguuaauggacagucuggccgcauugacuuccacuggcucauguuaaaccccaaugauacugugacauuuuccuucaacggcgcguuuaucgcaccugaccgagccugcuuccugagagggaaaucaauggguauucagagcggaguccagguggaugcuaguugugaaggcgacugcuaccauucugggggaaccaucaucuccaaccuuccauuucaaaauauuaacagcagggccgugggcaaguguccgcgguaugucaagcaggagucguugaugcuggcaacugguaugaaaaauguucccgaaauaccuaaggggcguggccuauucggagcuaucgccggcuucauugagaacgggugggaaggacucaucgaugguugguacggcuuucgccaccagaaugcgcaaggggagggaacagccgcagacuacaaaucuacccaguccgcuauagaccagauuacgggcaagcugaacagacuuaucgagaaaaccaaucagcaauucgaacugaucgauaacgaguuuacagaaguggagaagcagauugguaauguaaucaacuggacuagggacucaaugaccgaaguguggaguuauaaugccgaguugcucgucgcuauggagaaccagcacacaauugaucuggccgacagcgaaaugaauaaauuauacgagcgggugaagcgacagcugcgcgaaaacgcagaggaagaugggacuggcugcuucgagauauuucauaagugugacgaugacugcauggccuccaucagaaauaacaccuaugaucacucuaaauacagggaggaagcuaugcaaaaccggauucagaucgacccaguuaagcucagcucaggauauaaagaugugauccuuugguucaguuuuggcgcguccugcuucauucuguuggcaauagccauggggcuagucuuuaucugugugaagaauggaaacaugcgcugcacaauuuguaucuga

SEQ ID NO: 132227 - RNA, 1683 nt, Artificial Sequence; identical to SEQ ID NO: 132196
  derived and/or modified sequence opt3 from hemagglutinin__InfluenzaA__AGQ80993

SEQ ID NO: 132228 - RNA, 1683 nt, Artificial Sequence; identical to SEQ ID NO: 132203
  derived and/or modified sequence opt3 from hemagglutinin__InfluenzaA__AGQ80994

SEQ ID NO: 132229 - RNA, 1683 nt, Artificial Sequence; identical to SEQ ID NO: 132205
  derived and/or modified sequence opt3 from hemagglutinin__InfluenzaA__AGQ80995

SEQ ID NO: 132230 - RNA, 1683 nt, Artificial Sequence; identical to SEQ ID NO: 132205
  derived and/or modified sequence opt3 from hemagglutinin__InfluenzaA__AGQ80996

SEQ ID NO: 132231 - RNA, 1683 nt, Artificial Sequence
  derived and/or modified sequence opt3 from hemagglutinin__InfluenzaA__AGQ80997
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccaauauuccucggaucuguuccaaggguaaacgcacaguugauuugggccaaugcggguuacugggaaccauuacuggcccaccgcagugugaccaguuucuagaguucucugcugaucucaucauagaacgacgugaggguucagacgugugcuaccccgggaaguuugucaacgaggaagcccugagacagauccuuagggagaguggaggcauugauaaagaaacaaugggcuucaccuauagcgggauccggacggacggagcaacuuccgccugucgcagaucugguucgucauuuuacgcugagaugaaguggcuguugagcaauaccgauaacgcagccuucccucaaaugacaaagaguuauaaaaauacuaggaaggacccagcucucauuaucuggggcauacaccauuccgggucuaccacagagcagaccaaacuguacggaagcggcaacaagcugauuacgguggguuccucaaauuaucagcagaguuuuguacccagcccuggggcccggccacaaguuaacggacagucuggccgcaucgauuuccacuggcucauguuaaaucccaacgacacugugacauuuuccuucaauggcgcguuuauugcaccugaucgagccucauuccugagagggaaaagcaugggaauccagagugguguccagguggacgcuaacugcgaaggcgauuguuaccauucugggggaaccaucauuuccaaccuuccauuucaaaauauaaacagcagggccgugggcaagugcccgcgguaugucaagcaggagucguugcugcuagcaacugguaugaaaaauguucccgaaaucccuaaggggcguggccucuucggagcuauugccggcuucaucgagaacgggugggaaggacugauagacgguugguacggcuuucgccaccaaaauucucagggggagggaacagcggccgacuacaaauccacccagucagcaauugaucagaucacgggcaaacuuaacagacugaucgagaagaccaaucagcaauucgaauugauugacaacgaguuuacagaaguggagaagcagaucgguaauguaauuaacuggacuagggauaguaugaccgaaguguggagcuauaaugcugagcuccuggucgccauggagaaccagcacacaauagacuuagcugauuccgaaaugaauaaacuguacgagcgggugaagcgacagcuccgcgaaaacgccgaggaagacgggacuggcuguuucgagaucuuucauaagugcgaugacgauuguauggcaucuauuagaaauaacaccuaugaccacagcaaauacagggaggaagccaugcaaaaccggauccagaucgauccaguuaaacuuucaaguggauauaaggacgugauucugugguucuccuuuggcgcuagcugcuucauauugcuagcgaucgcaauggggcuggucuuuauuugcgugaagaauggaaacaugcgcuguacaaucugcauuuga

SEQ ID NO: 132232 - RNA, 1683 nt, Artificial Sequence
  derived and/or modified sequence opt3 from hemagglutinin__InfluenzaA__AGQ81000
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccaauauuccucggaucuguuccaaggguaaacgcacaguugauuugggccaaugcggguuacugggaaccauuacuggcccaccgcagugugaccaguuucuagaguucucugcugaucucaucauagaacgacgugaggguucagacgugugcuaccccgggaaguuugucaacgaggaagcccugagacagauccuuagggagaguggaggcauuggcaaagaaacaaugggguucaccuauagcggaauccggacgaauggugcaacuuccgccugucgcagaucuggcucgucauuuuacgcugagaugaaguggcuguugagcaacaccgauaaugcagccuucccucaaaugacaaagaguuauaaaaacacuaggaaggacccagcucucauuaucugggggauacaccauuccggaucuaccacagagcagaccaaacuguacggcagcgguaauaagcugauuacggugggguccucaaacuaucagaaaaguuuuguacccagcccuggagcccggccacagguuaauggccaaucuggccgcaucgauuuccacuggcucauguuaaaccccaaugacacugugacauuuuccuucaacggggcguuuauugcaccugaucgagccucauuccugagaggaaagagcauggguauccagaguggcguccagguggacgcuaacugcgaaggggauuguuaccauaauggaggcaccaucauuucuaaccuuccauuucagaauauaaacuccagggccguggguaagugcccgcgguaugucaaacaagagagcuugcugcuagcaacugggaugaagaauguucccgaaaucccuaaaggccguggacucuucggcgcuauugccggguucaucgagaacggaugggaaggucugauagacggcugguacggguuucgccaccagaaugcgcagggagagggcacagccgcagauuacaagucgacccaaucugcuauugaccagaucacggguaaacuuaacagacugaucgagaagaccaaucagcaguucgaauugauugacaacgaguuuacagaaguggagaaacaaaucgggaauguaauuaacuggacuagggauuccaugaccgaaguguggucauauaaugccgagcuccuggucgcuauggagaaccagcacacaauagacuuagccgauagugaaaugaauaagcuguacgagcgggugaagcgacagcuccgcgaaaacgcagaggaagacggcacuggauguuucgagaucuuucauaaaugcgaugacgauuguauggccagcauuagaaacaauaccuaugaccacuccaaguacagggaggaagcuaugcagaaccggauccaaaucgauccaguuaaacuuucuagcggcuauaaggacgugauucugugguucucauuuggggcgaguugcuucauauugcuagcaaucgccaugggacuggucuuuauuugcgugaaaaaugguaacaugcgcuguacaaucugcauuuga

SEQ ID NO: 132233 - RNA, 1683 nt, Artificial Sequence
  derived and/or modified sequence opt3 from hemagglutinin__InfluenzaA__AGQ81001
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccaauauuccucggaucuguuccaaggguaaacgcacaguugauuugggccaaugcggguuacugggaaccauuacuggcccaccgcagugugaccaguuucuagaguucucugcugaucucaucauagaacgacgugaggguucagacgugugcuaccccgggaaguuugucaacgaggaagcccugagacagauccuuagggagaguggaggcauugauaaagaaacaaugggcuucaccuauagcgggauccggacgaauggagcaacuuccgccugucgcagaucugguucgucauuuuacgcugagaugaaguggcuguugagcaacaccgacaaugcagccuucccucaaaugacaaagaguuauaaaaacacuaggaaggauccagcucucauuaucuggggcauacaccauuccgggucuaccacagagcagaccaaacuguacggaagcggcaauaagcugauuacgguggguacuuccaacuaucagcagucauuuguacccaguccuggggcccggccacaaguuaauggacagagcggccgcaucgacuuccacuggcucauguuaaaccccaaugauacagugaccuuuucuuucaacggcgcguuuauugcaccugaccgagccuccuuccugagagggaaaucaaugggaauccagagcgguguccagguggaugcuaacugcgaaggcgacuguuaccauaaugggggaacuaucauuaguaaccuuccauuucaaaauauaaacucuagggccgugggcaagugcccgcgguaugucaagcaggaguccuugcugcuagcaacagguaugaaaaauguucccgaaaucccuaaggggcguggccucuucggagcuauugccggcuucaucgagaacgggugggaaggacugauagaugguugguacggcuuucgccaccagaaugcgcaaggggagggaaccgccgcagacuacaaaagcacgcagucggcuauugaccagaucaccggcaaacuuaacagacugaucgagaagacaaaucagcaauucgaauugauugauaacgaguuuacugaaaucgagaagcagauugguaaugugauaaacuggaccagggacucuaugacagaaguaugguccuauaaugccgagcuccugguggcuauggagaaccagcacacuaucgauuuagccgacucagaaaugaauaaacuguacgagcgggucaagcgacagcuccgcgaaaacgcagaggaagaugggaccggcuguuucgagauuuuucauaagugcgacgaugacuguauggccaguaucagaaacaauacauaugaucacagcaaauacagggaggaagcuaugcaaaaccggauccagauugacccagugaaacuuuccucuggauauaaggauguuauacugugguucagcuuuggcgcgucaugcuucaucuugcuagcaauugccauggggcugguguuuaucugcgucaagaauggaaacaugcgcuguaccauuugcaucuga

SEQ ID NO: 132234 - RNA, 1683 nt, Artificial Sequence; identical to SEQ ID NO: 132211
  derived and/or modified sequence opt3 from hemagglutinin__InfluenzaA__AGQ81002

SEQ ID NO: 132235 - RNA, 1683 nt, Artificial Sequence; identical to SEQ ID NO: 132211
  derived and/or modified sequence opt3 from hemagglutinin__InfluenzaA__AGQ81003

SEQ ID NO: 132236 - RNA, 1683 nt, Artificial Sequence; identical to SEQ ID NO: 132211
  derived and/or modified sequence opt3 from hemagglutinin__InfluenzaA__AGQ81004

SEQ ID NO: 132237 - RNA, 1683 nt, Artificial Sequence; identical to SEQ ID NO: 132211
  derived and/or modified sequence opt3 from hemagglutinin__InfluenzaA__AGQ81005

SEQ ID NO: 132238 - RNA, 1683 nt, Artificial Sequence; identical to SEQ ID NO: 132211
  derived and/or modified sequence opt3 from hemagglutinin__InfluenzaA__AGQ81006

SEQ ID NO: 132239 - RNA, 1683 nt, Artificial Sequence; identical to SEQ ID NO: 132211
  derived and/or modified sequence opt3 from hemagglutinin__InfluenzaA__AGQ81007

SEQ ID NO: 132240 - RNA, 1683 nt, Artificial Sequence; identical to SEQ ID NO: 132211
  derived and/or modified sequence opt3 from hemagglutinin__InfluenzaA__AGQ81008

SEQ ID NO: 132241 - RNA, 1683 nt, Artificial Sequence
  derived and/or modified sequence opt3 from hemagglutinin__InfluenzaA__AGQ81009
augaacacccagauccugguguucgcccucgucgcuauuauacccacaaaugcagacaagaucugccuuggccaccaugccguuagcaacgggacuaaagugaauacgcugaccgagagaggaguagaaguggucaacgcgacagagacuguggaaaggaccuccauuccucggaucuguucuaaggguaaacgcgcuguugauuugggccaaugcggguuacugggaacaauuaccggcccaccgcagugugaccaguuucuagaguucucagccgaucucaucauagaacgacaggaggguagugacgugugcuaccccgggaaguuugucaaugaggaagcacugcgucaaauccuuagagagagcggaggcauuaacaaagaaacuaugggcuucacauauuccgggaucaggaccaauggagccacgucugcuugucggcgcucggguagcagcuuuuacgcagagaugaaguggcuguugaguaacacugauaaugccgcuuucccucagaccacaaaguccuauaaaaacacuagaaaggacccagcccucauuaucuggggcauacaccauucugggagcaccacagagcagaccaaacuguacggauccggcaauaagcugauuacgguggguucaaguaacuaucagcaaucauuuguacccucuccuggggcgaggccacagguuaauggacaguccggccggaucgauuuccacuggcucauguuaaaccccaaugacacugugacauuuucauucaacggcgcauuuauugccccugaucgcgcuagcuuccugcgagggaaaaguaugggaauccagucugguguccaaguggacgccaacugcgaaggcgauuguuaccauaaugggggaaccaucauuuccaaccuuccauuucagaauauaaacagcagagcagugggcaagugcccgagguaugucaagcaggagucguugcugcuagcuacugguaugaaaaauguucccgaaaucccuaaggggcggggccucuucggagccauugcgggcuucaucgagaacgggugggaaggacugguggacgguugguacggcuuucgucaccaaaaugcccagggggagggaacagcagcugauuacaaaucuacccaguccgccauagaccagauuacgggcaaacuuaaccgccugaucgagaagaccaaucaacaguucgaauugaucgacaacgaguuuacagaaguagagagacagauugguaaugugaucaacuggacuagggauucaaugaccgaagucuggaguuauaaugcugagcuccugguggccauggagaaccagcacacaauugacuuagcagauagcgaaaugaauaagcuguacgagcggguucgacgccaacucagagaaaacgccgaggaagacgggacuggcuguuucgagauauuucauaaaugcgaugacgauuguauggcuuccaucaggaacaauaccuaugaccacucuaaguaccgggaggaagcgaugcagaaccgcauucagaucgauccagugaaacuuagcucaggauauaaggacgucauccugugguucaguuuuggcgcauccugcuucauuuugcuagccauagcuauggggcugguguuuaucugcguaaagaauggaaacaugagauguacaauuugcaucuga

SEQ ID NO: 132242 - RNA, 1683 nt, Artificial Sequence
  derived and/or modified sequence opt3 from hemagglutinin__InfluenzaA__AGQ81011
augaacacccagauccugguguucgcccucauugcuauaacacccacuaauagcgacaagaucugccuuggccaccaugcagucuccaacgggacgaaaguuaauacccugacagagagaggaguggaaguagugaacgccacugagaccgucgaaaggacaucuauuccucggaucuguucaaaggguaaacgcaccguggauuugggccaaugcggguuacugggaacuauuacaggcccaccgcagugugaccaguuucuagaguucagugcggaucucaucauagaacgacgugaggguagcgacguuugcuaccccgggaaguuugugaaugaggaagcucugagacagauccuuagggaguccggaggcauugauaaagaagccaugggcuucaccuauucugggauccggacgaacggagcaacuucggccugucgcagaucagagagcaguuuuuacgcugagaugaaguggcuguuguccaauaccgacaacgcagccuucccuccaaugacaaagucuuauaaaaauacuaggaaggcucccgcccucauuaucugggguauacaccauagcggcuccaccgcggaacaaacaaaacuguacgggucaggaaacaagcuggucaccgugcggaguagcaauuaucagcagucuuuuguaccuuccccaggcgcaggucccaaaguuaacgggcagucaggacgcauugauuuccacuggcucauguuaaauccuaacgacacggugacuuuuagcuucaauggcgccuuuaucgcuccagaucgagccaguuuccugagaggcaagucuauggggauucaauccggaguccagguggacgcaaacugcgagggugauuguuaccauagcggcgggacaaucaucucgaaccuuccguuucagaauauugacucuaggguggucggaaagugcccccgguauguuaaacagaaguccuugcugcuagcuaccggcaugaaaaacgugccugaaauaccaaagggucgugggcuuuucggcgccaucgcgggauucauugagaauggcugggaagggcugaucgauggaugguacgguuuucgccaccaaaacgcccagggcgaggggacugcagcugacuacaaaucaacacagagugccauaaaucaaaugaccggaaagcucaacagacugauugagaaaacgaaucagcaguucgaauugaucgacaacgaguuuaccgaaguagagaagcagaucggcaaugugauuaacuggacaagggauagcaucacugaagucugguccuauaaugcugagcuccugguggccauggagaaccaacacaccauugacuuagcagauucugaaaugaauaagcuguacgagcggguuaaacgacagcuccgcgaaaacgccgaggaagacgguacaggguguuucgagauauuucauaagugcgaugacgauuguauggcuagcaucagaaauaacacuuaugaccacucaaaauacagggaggaagcgaugcagaaccggauucagaucgaucccgugaaacuuaguuccggcuauaaggacgucauccugugguucagcuuuggagcaucuugcuugauucuacuggccauagcuaugggccucguguucaucugcguaaagaaugggaacaugcgcuguaccauuugcaucuga

SEQ ID NO: 132243 - RNA, 1683 nt, Artificial Sequence
  derived and/or modified sequence opt3 from hemagglutinin__InfluenzaA__AGQ81012
augaacacccagauccugguauucgcccucauugcuauaauccccacaaauagcgacaagauuugccuuggccaccaugcagucuccaacgggacuaaaguuaauacgcugaccgagagaggaguggaaguagugaacgccacagagacugucgaaaggaccucuaucccucggauuuguucaaaggguaaacgcacaguggauuugggccaaugcggguuacugggaaccaucacuggcccaccgcagugugaccaguuucuagaguucagugcggaucucauaaucgaacgacgugaggguagcgacguuugcuaccccgggaaguuugugaaugaggaagcucugagacagauucuuagggaguccggaggcaucaacaaagaagccaugggcuucacauauucugggauucggaccaauggagcaacgucggccugucgcagaucagguagcaguuuuuacgcugagaugaaguggcuguuguccaacacugauaaugcagccuucccuccaaugaccaagucuuauaaaaacacaaggaaggcucccgcccucaucauauggggcauucaccauagcggguccacugcggagcaaaccaaacuguacggaucaggcaauaagcuggucacagugcggaguagcaacuaucagcagucuuuuguaccuuccccaggugcagggccccagguuaauggacaaucaggccgcaucgacuuccacuggcucauguuaaacccuaaugauaccgugacguuuagcuucaacggcgccuuuauugcuccagaccgagccaguuuccugagagggaaaucuaugggaauccaguccgguguccagguggaugcaaacugcgaaggcgacuguuaccauagcgggggaacuaucauuucgaaucuuccguuucagaacauagauucuaggguggucggcaagugcccccgguauguuaagcaaaaauccuugcugcuagcuacagguaugaagaaugugccugagaucccaaaagggcguggccucuucggagccauugcgggcuucaucgaaaacgggugggagggacugauagacgguugguacggcuuucgccaccagaaugcccagggggaaggaaccgcagcugauuacaagucaacucaaagugccauuaaccagaugacaggcaaacuuaauagacugaucgagaagaccaaccagcaguucgaguugaucgacaaugaauuuacggagguagaaaaacaaauugguaacgugaucaauuggaccagggacagcauuacagaggucugguccuauaacgcugaacuccugguggccauggagaaucagcacacuauagauuuagcagacucugagaugaacaagcuguacgaacggguuaagcgacagcuccgcgagaaugccgaagaggaugggaccggcuguuucgaaaucuuucauaaaugcgacgaugacuguauggcuagcauuagaaacaacacauaugaucacucaaaguacagggaggaggcgaugcagaaucggauccaaaucgaccccgugaaacuuaguuccggauauaaggaugucauucugugguucagcuuuggcgcaucuugcuucauauugcuagccaucgcuauggggcugguguuuauuugcgugaaaaacggaaauaugcgcuguacuaucugcauuuga

SEQ ID NO: 132244 - RNA, 1683 nt, Artificial Sequence
  derived and/or modified sequence opt3 from hemagglutinin__InfluenzaA__AGQ81017
augaacacccagauccugguauucgcccucauugcuauaacacccacuaauagcgacaagaucugccuuggccaccaugcagucuccaacgggacgaaaguuaauacccugacagagagaggaguggaaguagugaacgccacugagaccgucgaaaggacaucuauuccucggaucuguucaaaggguaaacgcaccguggauuugggccaaugcggguuacugggaacuauuacaggcccaccgcagugugaccaguuucuagaguucagugcggaucucaucauagaacgacgugaggguagcgacguuugcuaccccgggaaguuugugaaugaggaagcucugagacagauccuuagggaguccggaggcauugauaaagaagccaugggcuucaccuauucugggauccggacgaacggagcaacuucggccugucgcagaucagguagcaguuuuuacgcugagaugaaguggcuguuguccaauaccgacaacgcagccuucccuccaaugacaaagucuuauaaaaauacuaggaaggcucccgcccucauuaucuggggcauacaccauagcggguccaccgcggagcaaacaaaacuguacggaucaggcaacaagcuggucaccgugcggaguagcaauuaucagcagucuuuuguaccuuccccaggugcagggccccagguuaacggacaaucaggccgcauugauuuccacuggcucauguuaaauccuaacgacacggugacuuuuagcuucaauggcgccuuuaucgcuccagaucgagccaguuuccugagagggaaaucuauggguauucaguccggaguccagguggacgcaaacugcgaaggcgauuguuaccauagcgggggaacaaucaucucgaaccuuccguuucagaauauugacucuaggguggucggcaagugcccccgguauguuaagcaaaaauccuugcugcuagcuaccgguaugaagaacgugccugagauaccaaaagggcguggccucuucggagccaucgcgggcuucauugaaaaugggugggagggacugaucgaugguugguacggcuuucgccaccagaacgcccagggggaaggaacugcagcugacuacaagucaacacaaagugccauaaaucagaugaccggcaaacuuaacagacugauugagaagacgaaucagcaguucgaguugaucgacaacgaauuuaccgagguagaaaaacaaaucgguaaugugauuaacuggacaagggauagcaucacugaggucugguccuauaaugcugaacuccugguggccauggagaaccagcacaccauugacuuagcagauucugagaugaauaagcuguacgaacggguuaagcgacagcuccgcgagaacgccgaagaggacgggacaggcuguuucgaaauauuucauaaaugcgaugacgauuguauggcuagcaucagaaauaacacuuaugaccacucaaaguacagggaggaggcgaugcagaaccggauucaaaucgaucccgugaaacuuaguuccggauauaaggacgucauccugugguucagcuuuggcgcaucuugcuucauuuugcuagccauagcuauggggcugguguuuaucugcgugaaaaauggaaacaugcgcuguaccauuugcaucuga

SEQ ID NO: 132245 - RNA, 1683 nt, Artificial Sequence
  derived and/or modified sequence opt3 from hemagglutinin__InfluenzaA__AGQ81018
augaacacccagauccugguguucgcccucauugcuauaauccccacaaauagcgacaagauuugccuuggccaccaugcagucuccaacgggacuaaaguuaauacgcugaccgagagaggaguggaaguagugaacgccacagagacugucgaaaggaccucuaucccucggauuuguucaaaggguaaacgcacaguggauuugggccaaugcggguuacugggaaccaucacuggcccaccgcagugugaccaguuucuagaguucagugcggaucucauaaucgaacgacgugaggguagcgacguuugcuaccccgggaaguuugugaaugaggaagcucugagacagauucuuagggaguccggaggcaucgucaaagaagccaugggcuucacauauucugggauucggaccaacggagcaacgucggccugucgcagaucagguagcaguuuuuacgcugagaugaaguggcuguuguccaauacugauaacgcagccuucccuccaaugaccaagucuuauaaaaauacaaggaaggcucccgccaucauaauuuggggcauccaccauagcggguccacugcggagcaaaccaaacucuacggaucaggcaacaagcuggugacaguacggaguagcaauuaucagcagucuuuuguuccuuccccaggugcagggccccaggugaacggacaaucaggccgcauugacuuccacuggcugaugcucaauccuaacgauaccgucacguuuagcuucaauggcgccuuuaucgcuccagaccgagccaguuucuuaagagggaaaucuaugggaauccaguccgguguccagguggaugcaaacugcgaaggcgacuguuaccauagcagggggacuauuauaucgaaccugccguuucagaauaucgauucucgggugguuggaaagugcccccguuaugugaagcaaaaaucccuuuugcuggcuacaggcaugaagaacguaccugagauuccaaaaggucgcgggcuauucggcgccaucgcgggauucauagaaaauggcugggaggggcucauugacggaugguacgguuuuagacaccagaacgcccagggcgaagggaccgcagcugauuacaagucaacucaaagugccaucaaucagaugacaggaaaacugaacaggcuuaucgagaagaccaaucagcaguucgagcugauugacaacgaauuuacggagguggaaaaacaaaucggcaaugucauuaacuggacccgggacagcauaacagaggugugguccuauaaugcugaauugcucguugccauggagaaccagcacacuaucgaucuggcagacucugagaugaauaaguuauacgaacgagugaagcgccagcugagagagaacgccgaagaggaugguaccggguguuucgaaauuuuucauaaaugcgacgaugacuguauggcuagcaucaggaauaacacauaugaucacucaaaguaccgggaggaggcgaugcagaaccgcauccaaauugaccccgucaaacucaguuccggcuauaaggaugugauacuuugguucagcuuuggagcaucuugcuucauccuguuggccauugcuaugggccuaguauuuaucugcguuaaaaaugggaacaugagauguacuauuugcaucuga

SEQ ID NO: 132246 - RNA, 1683 nt, Artificial Sequence; identical to SEQ ID NO: 132245
  derived and/or modified sequence opt3 from hemagglutinin__InfluenzaA__AGQ81019

SEQ ID NO: 132247 - RNA, 1683 nt, Artificial Sequence; identical to SEQ ID NO: 132244
  derived and/or modified sequence opt3 from hemagglutinin__InfluenzaA__AGQ81020

SEQ ID NO: 132248 - RNA, 1683 nt, Artificial Sequence; identical to SEQ ID NO: 132245
  derived and/or modified sequence opt3 from hemagglutinin__InfluenzaA__AGQ81021

SEQ ID NO: 132249 - RNA, 1683 nt, Artificial Sequence; identical to SEQ ID NO: 132244
  derived and/or modified sequence opt3 from hemagglutinin__InfluenzaA__AGQ81022

SEQ ID NO: 132250 - RNA, 1683 nt, Artificial Sequence; identical to SEQ ID NO: 132245
  derived and/or modified sequence opt3 from hemagglutinin__InfluenzaA__AGQ81023

SEQ ID NO: 132251 - RNA, 1683 nt, Artificial Sequence
  derived and/or modified sequence opt3 from hemagglutinin__InfluenzaA__AGQ81025
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucgauaaagaagcaaugggcuucacauauuccgggauucggaccaacggagucacgucugccugucgcagaucggguagcucauuuuacgcugagaugaaguggcuguugaguaauacugacaacgcagccuucccuccaaugaccaaguccuauaaaaauacaaggaaggcucccgcccucaucauauggggcauucaccauucugggagcacugcggagcaaaccaaacuguacggauccggcaacaagcuggugacaguacggucaaguaauuaucagcagagcuuuguuccuucuccaggugcagggccccaggugaacggacaauccggccgcaucgauuuccacuggcucauguuaaauccuaacgacaccgucacguuuucauucaauggcgccuuuauugcuccagaucgagccagcuuccugagagggaaaaguaugggaauccagucugguguccagguggacgcaaacugcgaaggcgauuguuaccauuccgggggaacuaucauuagcaaccuuccguuucagaauauagacucgagggugguuggcaagugcccccgguaugugaagcaaaaaucuuugcugcuagcuacagguaugaagaacguaccugagaucccaaaagggcguggccucuucggagccauugcgggcuucaucgaaaaugggugggagggacugauagaugguugguacggcuuucgccaccagaacgcccagggggaaggaaccgcagcugacuacaaguccacucaaucagccauuaaucagaugacaggcaaacuuaacagacugaucgagaagaccaaucagcaguucgguuugaucgacaacgaguuuacggaaguggagaaacaaauugggaaugucaucaacuggaccagggauaguauuacagaaguguggagcuauaaugcugagcuccugguugccauggaaaaccagcacacuauagacuuagcagauuccgagaugaauaagcuguacgagcgggugaagcgacagcuccgcgaaaacgccgaggaagacggcaccggauguuucgagaucuuucauaaaugcgaugacgauuguauggcuucuauuagaaauaacacauaugaccacagcaaguacagggaagaggcgaugcagaaccggauccaaaucgaucccgucaaacuuucaaguggcuauaaggacgugauucugugguucuccuuuggggcaagcugcuucauauugcuagccaucgcuaugggacugguaguuauuugcgugaaaaaugguaacaugcgcuguacuaucugcauuuga

SEQ ID NO: 132252 - RNA, 1683 nt, Artificial Sequence
  derived and/or modified sequence opt3 from hemagglutinin__InfluenzaA__AGQ81026
augaacacccagauccugguauucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucgauaaagaagcaaugggcuucacauauuccgggauucggaccaacggagccacgucugcuugucgcagaucggguagcagcuuuuacgcagagaugaaguggcuguugaguaauacugacaacgccgcuuucccuccaaccacaaaguccuauaaaaauacuaggaaggcccccgcgcucaucauauggggcauucaccauucugggagcaccgcagagcaaacaaaacuguacggauccggcaacaagcuggucaccgugcggucaaguaauuaucagcagagcuuuguaccuucuccaggugccgggccccagguuaacggacaauccggccgcaucgauuuccacuggcucauguuaaauccuaacgacacggugacuuuuucauucaauggcgcuuuuauugccccagaucgagcaucauuccugagagggaaaaguaugggaauccagucugguguccagguggacgcuaacugcgaaggcgauuguuaccauuccgggggaacaaucauuagcaaccuuccguuucagaauauagacucgaggguggucggcaagugcccccgguauguuaagcaaaaaucuuugcugcuagccaccgguaugaagaacgugccugagaucccaaaagggcguggccucuucggagcgauugccggcuucaucgaaaaugggugggagggacugauagaugguugguacggcuuucgccaccagaacgcacagggggaaggaacugcugccgacuacaaguccacacaaucagcuauuaaucagaugaccggcaaacuuaacagacugaucgagaagacgaaucagcaguucgaguugaucgacaacgaauuuaccgagguagaaaaacaaauugguaaugugaucaacuggacaagggauaguauuacugaggucuggagcuauaaugccgaacuccugguggcaauggagaaccagcacaccauagacuuagccgauuccgagaugaauaagcuguacgaacggguuaagcgacagcuccgcgagaacgcugaagaggacgggacaggcuguuucgaaaucuuucauaaaugcgaugacgauuguauggcgucuauuagaaauaacacuuaugaccacagcaaguacagggaggaggcaaugcagaaccggauccaaaucgaucccgugaaacuuucaaguggauauaaggacgucauucugugguucuccuuuggcgccagcugcuucauauugcuagcuaucgccauggggcugguguuuauuugcgugaaaaauggaaacaugcgcuguaccaucugcauuuga

SEQ ID NO: 132253 - RNA, 1683 nt, Artificial Sequence
  derived and/or modified sequence opt3 from hemagglutinin__InfluenzaA__AGQ81027
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucgauaaagaagcaaugggcuucacauauuccgggauucggaccaacggagucacgucugccugucgcagaucggguagcucauuuuacgcugagaugaaguggcuguugaguaauacugacaacgcagccuucccuccaaugaccaaguccuauaaaaauacaaggaaggcucccgcccucaucauauggggcauucaccauucugggagcacugcggagcaaaccaaacuguacggauccggcaacaagcuggugacaguacggucaaguaauuaucagcagagcuuuguuccuucuccaggugcagggccccaggugaacggacaauccggccgcaucgauuuccacuggcucauguuaaauccuaacgacaccgucacguuuucauucaauggcgccuuuauugcuccagaucgagccagcuuccugagagggaaaaguaugggaauccagucugguguccagguggacgcaaacugcgaaggcgauuguuaccauuccgggggaacuaucauuagcaaccuuccguuucagaauauagacucgagggugguuggcaagugcccccgguaugugaagcaaaaaucuuugcugcuagcuacagguaugaagaacguaccugagaucccaaaagggcguggccucuucggagccauugcgggcuucaucgaaaaugggugggagggacugauagaugguugguacggcuuucgccaccagaacgcccagggggaaggaaccgcagcugacuacaaguccacucaaucagccauuaaucagaugacaggcaaacuuaacagacugaucgagaagaccaaucagcaguucgaguugaucgacaacgaauuuacggagguggaaaaacaaauugguaaugucaucaacuggaccagggauaguauuacagagguguggagcuauaaugcugaacuccugguugccauggagaaccagcacacuauagacuuagcagauuccgagaugaauaagcuguacgaacgggugaagcgacagcuccgcgagaacgccgaagaggacgggaccggcuguuucgaaaucuuucauaaaugcgaugacgauuguauggcuucuauuagaaauaacacauaugaccacagcaaguacagggaggaggcgaugcagaaccggauccaaaucgaucccgucaaacuuucaaguggauauaaggacgugauucugugguucuccuuuggcgcaagcugcuucauauugcuagccaucgcuauggggcugguauuuauuugcguuaaaaauggaaacaugcgcuguacuaucugcauuuga

SEQ ID NO: 132254 - RNA, 1683 nt, Artificial Sequence
  derived and/or modified sequence opt3 from hemagglutinin__InfluenzaA__AGQ81028
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucgauaaagaagcaaugggcuucacauauuccgggauucggaccaacggagccacgucugcuugucgcagaucggguagcagcuuuuacgcagagaugaaguggcuguugaguaauacugacaacgccgcuuucccuccaaccacaaaguccuauaaaaauacuaggaaggcccccgcgcucaucauauggggcauucaccauucugggagcaccgcagagcaaacaaaacuguacggauccggcaacaagcuggucaccgugcggucaaguaauuaucagcagagcuuuguaccuucuccaggugccgggccccagguuaacggacaauccggccgcaucgauuuccacuggcucauguuaaauccuaacgacacggugacuuuuucauucaauggcgcuuuuauugccccagaucgagcaucauuccugagagggaaaaguaugggaauccagucugguguccagguggacgcuaacugcgaaggcgauuguuaccauuccgggggaacaaucauuagcaaccuuccguuucagaauauagacucgaggguggucggcaagugcccccgguauguuaagcaaaaaucuuugcugcuagccaccgguaugaagaacgugccugagaucccaaaagggcguggccucuucggagcgauugccggcuucaucgaaaaugggugggagggacugauagaugguugguacggcuuucgccaccagaacgcacagggggaaggaacugcugccgacuacaaguccacacaaucagcuauuaaucagaugaccggcaaacuuaacagacugaucgagaagacgaaucagcaguucgaguugaucgacaacgaauuuaccgagguagaaaaacaaauugguaaugugaucaacuggacaagggauaguauuacugagauguggagcuauaaugccgaacuccuggucgcaauggagaaccagcacaccauagacuuagccgauuccgagaugaauaagcuguacgaacgggugaagcgacagcuccgcgagaacgcugaagaggacgggacaggcuguuucgaaaucuuucauaaaugcgaugacgauuguauggcgucuauuagaaauaacacuuaugaccacagcaaguacagggaggaggcaaugcagaaccggauccaaaucgaucccguuaaacuuucaaguggauauaaggacgugauucugugguucuccuuuggcgccagcugcuucauauugcuagcuaucgccauggggcuggucuuuauuugcgugaaaaauggaaacaugcgcuguaccaucugcauuuga

SEQ ID NO: 132255 - RNA, 1683 nt, Artificial Sequence
  derived and/or modified sequence opt3 from hemagglutinin__InfluenzaA__AGQ81029
augaacacccagauccugguauucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucgauaaagaagcaaugggcuucacauauuccgggauucggaccaacggagucacgucugccugucgcagaucggguagcucauuuuacgcugagaugaaguggcuguugaguaauacugacaacgcagccuucccuccaaugaccaaguccuauaaaaauacaaggaaggcucccgcccucaucauauggggcauucaccauucugggagcacugcggagcaaaccaaacuguacggauccggcaacaagcuggugacaguacggucaaguaauuaucagcagagcuuuaugccuucuccaggugcagggccccagguuaacggacaauccggccgcaucgauuuccacuggcucauguuaaauccuaacgacaccgugacguuuucauucaauggcgccuuuauugcuccagaucgagccagcuuccugagagggaaaaguaugggaauccagucugguguccagguggacgcaaacugcgaaggcgauuguuaccauuccgggggaacuaucauuagcaaccuuccguuucagaauauagacucgaggguggucggcaagugcccccgguauguuaagcaaaaaucuuugcugcuagcuacagguaugaagaacgugccugagaucccaaaagggcguggccucuucggagccauugcgggcuucaucgaaaaugggugggagggacugauagaugguugguacggcuuucgccaccagaacgcccagggggaaggaaccgcagcugacuacaaguccacucaaucagccauuaaucagaugacaggcaaacuuaacagacugaucgagaagaccaaucagcaguucgaguugaucgacaacgaauuuacggagguagaaaaacaaauugguaaugugaucaacuggaccagggauaguauuacagaggucuggagcuauaaugcugaacuccugguggccauggagaaccagcacacuauagacuuagcagauuccgagaugaauaagcuguacgaacggguuaagcgacagcuccgcgagaacgccgaagaggacgggaccggcuguuucgaaaucuuucauaaaugcgaugacgauuguauggcuucuauuagaaauaacacauaugaccacagcaaguacagggaggaggcgaugcagaaccggauccaaaucgaucccgugaaacuuucaaguggauauaaggacgucauucugugguucuccuuuggcgcaagcugcuucauauugcuagccaucgcuauggggcugguguuuauuugcgugaaaaauggaaacaugcgcuguacuaucugcauuuga

SEQ ID NO: 132256 - RNA, 1683 nt, Artificial Sequence
  derived and/or modified sequence opt3 from hemagglutinin__InfluenzaA__AGQ81031
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucaacaaagaagcaaugggcuucacauauuccgggauucggaccaauggagccacgucugcuugucgcagaucggguagcagcuuuuacgcagagaugaaguggcuguugaguaacacugauaaugccgcuuucccuccaaugaccaaguccuauaaaaacacaaggaaggcccccgcgcucaucauauggggcauucaccauucugggagcacugcagagcaaaccaaacuguacggauccggcaauaagauggucacagugcggucaaguaacuaucagcagagcuuuguaccuucuccaggugccgggccccagguuaauggacaauccggccgcaucgacuuccacuggcugaugcucaacccuaaugauaccgugacguuuucauucaacggcgcuuuuauugccccagaccgagcaucauucuuaagagggaaaaguaugggaauccagucugguguccagguggaugcuaacugcgaaggcgacuguuaccauuccgggggaacuaucauuagcaaucugccguuucagaacauagauucgaggguggucggcaagugcccccgguauguuaagcaaaaaucucuuuugcuggccacagguaugaagaaugugccugagaucccaaaagggcguggccuauucggagcgauugccggcuucaucgaaaacgggugggagggacucauagacgguugguacggcuuucgccaccagaaugcacagggggaaggaaccgcugccgauuacaaguccacucaaucagcuauuaaccagaugacaggcaaacugaauagacuuaucgagaagaccaaccagcaguucgagcugaucgacaaugaauuuacggagguagaaaggcaaauugguaacgugaucaauuggacccgggacaguauuacagaggucuggagcuauaacgccgaauugcucguggcaauggagaaucagcacacuauagaucuggccgacuccgagaugaacaaauuauacgaacgaguuaagcgccagcugagagagaaugcugaagaggaugggaccggcuguuucgaaaucuuucauaagugcgacgaugacuguauggcgucuauuaggaacaacacauaugaucacagcaaauaccgggaggaggcaaugcagaaucgcauccaaaucgaccccgugaagcucucaaguggauauaaagaugucauucuuugguucuccuuuggcgccagcugcuucauacuguuggcuaucgccauggggcuaguguuuauuugcguaaagaacggaaauaugagauguacuaucugcauuuga

SEQ ID NO: 132257 - RNA, 1683 nt, Artificial Sequence; identical to SEQ ID NO: 132252
  derived and/or modified sequence opt3 from hemagglutinin__InfluenzaA__AGQ81032

SEQ ID NO: 132258 - RNA, 1683 nt, Artificial Sequence; identical to SEQ ID NO: 132253
  derived and/or modified sequence opt3 from hemagglutinin__InfluenzaA__AGQ81033

SEQ ID NO: 132259 - RNA, 1683 nt, Artificial Sequence; identical to SEQ ID NO: 132252
  derived and/or modified sequence opt3 from hemagglutinin__InfluenzaA__AGQ81034

SEQ ID NO: 132260 - RNA, 1683 nt, Artificial Sequence; identical to SEQ ID NO: 132253
  derived and/or modified sequence opt3 from hemagglutinin__InfluenzaA__AGQ81035

SEQ ID NO: 132261 - RNA, 1683 nt, Artificial Sequence; identical to SEQ ID NO: 132253
  derived and/or modified sequence opt3 from hemagglutinin__InfluenzaA__AGQ81036

SEQ ID NO: 132262 - RNA, 1683 nt, Artificial Sequence; identical to SEQ ID NO: 132253
  derived and/or modified sequence opt3 from hemagglutinin__InfluenzaA__AGQ81037

SEQ ID NO: 132263 - RNA, 1683 nt, Artificial Sequence; identical to SEQ ID NO: 132245
  derived and/or modified sequence opt3 from hemagglutinin__InfluenzaA__AGQ81038

SEQ ID NO: 132264 - RNA, 1683 nt, Artificial Sequence; identical to SEQ ID NO: 132245
  derived and/or modified sequence opt3 from hemagglutinin__InfluenzaA__AGQ81039

SEQ ID NO: 132265 - RNA, 1683 nt, Artificial Sequence
  derived and/or modified sequence opt3 from hemagglutinin__InfluenzaA__AGQ81040
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaggauccagcccucaucauauggggcauucaccauuccgggucuacugcggagcagaccaaacuguacggaagcggcaauaagcuggucacaguggguuccucaaacuaucagcagaguuuuguacccagcccuggggcacggccacaaguuaauggacagucuggccgcaucgacuuccacuggcucauguuaaaccccaaugauaccgugacguuuuccuucaacggcgccuuuauugcuccugaccgagccucauuccugagagggaaaagcaugggaauccagagugguguccagaucgaugcaaacugcgaaggcgacuguuaccauucugggggaacuauuauauccaaucuuccauuucaaaacaucgauagcagggcugugggcaagugcccgcgguaugugaagcagaaaucguugcugcuagccacagguaugaagaauguccccgagauuccuaaagggcguggccucuucggagcgaucgccggcuucauagaaaacgggugggagggacugauugacgguugguacggcuuucgccaccagaaugcacaaggggaaggaaccgcugccgacuacaagucuacucaguccgcuaucgaucagaucacaggcaaacuuaacagacugauugagaagaccaaucagcaauucgaguugaucgacaacgaauuuacggagguugaaaaacagauugguaaugugauaaacuggaccagggauucaaucacagagguauggaguuauaaugccgaacuccugguggcaauggagaaccagcacacuauugacuuagccgauagcgagaugaauaagcuguacgaacgggucaagcgacagcuccgcgagaacgcugaagaggacgggaccggcuguuucgaaaucuuucauaaaugcgaugacgauuguauggcguccaucagaaauaacacauaugaccacucuaaguacagggaggaggcaaugcaaaaccggauucagauagauccagugaaacuuagcucaggauauaaggacguuauccugugguucaguuuuggcgccuccugcuucauuuugcuagcuaucgccauggggcugguguuuauuugcgucaaaaauggaaacaugcgcuguacuaucugcauauga

SEQ ID NO: 132266 - RNA, 1683 nt, Artificial Sequence
  derived and/or modified sequence opt3 from hemagglutinin__InfluenzaA__AGQ81041
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaccacaaagaguuauaaaaacacuaggaaggauccagcccucaucauauggggcauucaccauuccgggucuaccgcggagcagacaaaacuguacggaagcggcaauaagcuggucaccguggguuccucaaacuaucagcagaguuuuguacccagcccuggggcacggccacaaguuaauggacagucuggccgcaucgacuuccacuggcucauguuaaaccccaaugauacggugacuuuuuccuucaacggcgccuuuauugcuccugaccgagccucauuccugagagggaaaagcaugggaauccagagugguguccagguggaugcaaacugcgaaggcgacuguuaccauucugggggaacaaucauuuccaaucuuccauuucaaaacauagauagcagggcugugggcaagugcccgcgguaugucaagcagaaaucguugcugcuagccaccgguaugaagaauguucccgagaucccuaaagggcguggccucuucggagcgauugccggcuucaucgaaaacgggugggagggacugauagacgguugguacggcuuucgccaccagaaugcacaaggggaaggaacugcugccgacuacaagucuacacaguccgcuauugaucagaucaccggcaaacuuaacagacugaucgagaagacgaaucagcaauucgaguugauugacaacgaauuuaccgagguggaaaaacagaucgguaauguaauuaacuggacaagggauucaauaacugagguguggaguuauaaugccgaacuccuggucgcaauggagaaccagcacaccaucgacuuagccgauagcgagaugaauaagcuguacgaacgggugaagcgacagcuccgcgagaacgcugaagaggacgggacaggcuguuucgaaauuuuucauaaaugcgaugacgauuguauggcguccaucagaaauaacacuuaugaccacucuaaguacagggaggaggcaaugcaaaaccggauccagauugauccaguuaaacuuagcucaggauauaaggacgugauacugugguucaguuuuggcgccuccugcuucaucuugcuagcuauugccauggggcuggucuuuaucugcgugaaaaauggaaacaugcgcuguaccauuugcaucuga

SEQ ID NO: 132267 - RNA, 1683 nt, Artificial Sequence
  derived and/or modified sequence opt3 from hemagglutinin__InfluenzaA__AGQ81042
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagcaaugggcuucacauauagcgggauucggaccaauggagccacguccgcuugucgcagaucugguucgucauuuuacgcagagaugaaguggcuguugagcaacacugacaaugccgcuuucccucaaaugaccaagaguuauaaaaacacaaggaaggauccagcccucaucauauggggcauucaccauuccgggucuacugcggagcagaccaaacuguacggaagcggcaauaagcuggucacaguggguuccucaaacuaucagcagaguuuuguacccagcccuggggcacggccacaaguuaauggacagucuggccgcaucgacuuccacuggcucauguuaaaccccaaugauaccgugacguuuuccuucaacggcgccuuuauugcuccugaccgagccucauuccugagagggaaaagcaugggaauccagagugguguccagguggaugcaaacugcgaaggcgacuguuaccauucugggggaacuaucauuuccaaucuuccauuucaaaacauagauagcagggcugugggcaagugcccgcgguaugucaagcagaaaucguugcugcuagccacagguaugaagaauguucccgagaucccuaaagggcguggccucuucggagcgauugccggcuucaucgaaaacgggugggagggacugauagacgguugguacggcuuucgccaccagaaugcacaaggggaaggaaccgcugccgacuacaagucuacucaguccgcuauugaucagaucacaggcaaacuuaacagacugaucgagaagaccaaucagcaauucgaguugauugacaacgaauuuacggagguggaaaaacagaucgguaauguaauuaacuggaccagggauucaauaacagagguguggaguuauaaugccgaacuccuggucgcaauggagaaccagcacacuaucgacuuagccgauagcgagaugaauaagcuguacgaacgggugaagcgacagcuccgcgagaacgcugaagaggacgggaccggcuguuucgaaauuuuucauaaaugcgaugacgauuguauggcguccaucagaaauaacacauaugaccacucuaaguacagggaggaggcaaugcaaaaccggauccagauugauccaguuaaacuuagcucaggauauaaggacgugauacugugguucaguuuuggcgccuccugcuucaucuugcuagcuauugccauggggcuggucuuuaucugcgugaaaaauggaaacaugcgcuguacuauuugcaucuga

SEQ ID NO: 132268 - RNA, 1683 nt, Artificial Sequence
  derived and/or modified sequence opt3 from hemagglutinin__InfluenzaA__AGQ81043
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccaauaucccucggauuuguuccaaggguaaacgcacaguggauuugggccaaugcggguuacugggaaccaucacuggcccaccgcagugugaccaguuucuagaguucucugcugaucucauaaucgaacgacgugaggguucagacguuugcuaccccgggaaguuugugaacgaggaagcccugagacagauucuuagggagaguggaggcaucgauaaagaagagaugggcuucacauauagcgggauucggaccaauggagcaacguccgccugucgcagaucugguucgucauuuuacgcugagaugaaguggcuguugagcaacacugacaaugcagccuucccucaaaugaccaagaguuauaaaaacacaaggaaguccccagcucucaucgucuggggcauacaccauucugugagcacugccgaacagaccaaacuguacggguccggaaauaagcugguaacaguuggcucaaguaacuaucagcagagcuuugugcccucuccuggugcgcggccacaagucaaugggcucuccggacgcauugauuuccacugguuaaugcugaaccccaaugacaccgugacguuuucauucaacggcgcauuuaucgccccugaucgagcuagcuuccuuagaggcaaaaguauggggauucagucuggagugcaggucgacgccaacugcgagggugauuguuaccauuccggcgggacuaucaucagcaauuugccauuucagaacauugacucgagggcaguuggaaagugcccgcgguaugugaagcaacguucucugcuacucgcuacaggcaugaaaaauguacccgaaauaccuaagggucgcgggcuguucggcgccaucgcgggauucauugagaacggcugggaagggcuuaucgauggaugguacgguuuuagacaccagaaugcccagggcgaggggaccgcagcugacuacaaauccacucaaucagccauagaccagauuacaggaaagcugaacagguugaucgagaaaaccaaucagcaguucgaacucaucgauaacgaguuuaaugaaguggagaagcaaauuggcaacgucaucaauuggacgcgggacaguauuaccgaaguguggagcuauaacgcugagcuguuaguugccauggagaaucagcacacaauagaucuggcagacuccgaaauggauaaacucuacgagcgagugaagcgccagcuuagagaaaacgccgaggaagacgguacuggguguuucgagaucuuucauaagugcgaugacgauuguauggcuucuauuaggaauaacaccuaugaccacagcaaauaccgggaggaagcgaugcagaaccgcauccaaaucgauccagucaagcugucaaguggcuauaaagacgugauuuugugguucuccuuuggagcaagcugcuucauacuacuggccaucguaaugggccucguuuuuauuugcgugaagaaugggaacaugagauguacaaucugcauuuga

SEQ ID NO: 132269 - RNA, 1683 nt, Artificial Sequence; identical to SEQ ID NO: 132004
  derived and/or modified sequence opt3 from hemagglutinin__InfluenzaA__AGQ81044

SEQ ID NO: 132270 - RNA, 1683 nt, Artificial Sequence; identical to SEQ ID NO: 132004
  derived and/or modified sequence opt3 from hemagglutinin__InfluenzaA__AGQ81045

SEQ ID NO: 132271 - RNA, 1683 nt, Artificial Sequence; identical to SEQ ID NO: 132004
  derived and/or modified sequence opt3 from hemagglutinin__InfluenzaA__AGQ81046

SEQ ID NO: 132272 - RNA, 1683 nt, Artificial Sequence; identical to SEQ ID NO: 132253
  derived and/or modified sequence opt3 from hemagglutinin__InfluenzaA__AGQ81047

SEQ ID NO: 132273 - RNA, 1683 nt, Artificial Sequence; identical to SEQ ID NO: 132252
  derived and/or modified sequence opt3 from hemagglutinin__InfluenzaA__AGQ81049

SEQ ID NO: 132274 - RNA, 1683 nt, Artificial Sequence; identical to SEQ ID NO: 132253
  derived and/or modified sequence opt3 from hemagglutinin__InfluenzaA__AGQ81050

SEQ ID NO: 132275 - RNA, 1683 nt, Artificial Sequence
  derived and/or modified sequence opt3 from hemagglutinin__InfluenzaA__AGQ81051
augaacacccagauccugguauucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucaacaaagaagcaaugggcuucacauauuccgggauucggaccaauggagccacgucugcuugucgcagaucggguagcagcuuuuacgcagagaugaaguggcuguugaguaacacugauaaugccgcuuucccuccaaugaccaaguccuauaaaaacacaaggaaggcccccgcgcucaucauauggggcauucaccauucugggagcacugcagagcaaaccaaacuguacggauccggcaauaagcuggucacagugcggucaaguaacuaucagcagagcuuuguaccuucuccaggugccgggccccagguuaauggacaauccggccgcaucgacuuccacuggcucauguuaaacccuaaugauaccgugacguuuucauucaacggcgcuuuuauugccccagaccgagcaucauuccugagagggaaaaguaugggaauccagucugguguccagguggaugcuaacugcgaaggcgacuguuaccauuccgggggaacuaucauuagcaaucuuccguuucagaacauagauucgaggguggucggcaagugcccccgguauguuaagcaaaaaucuuugcugcuagccacagguaugaagaaugugccugagaucccaaaagggcguggccucuucggagcgauugccggcuucaucgaaaacgggugggagggacugauagacgguugguacggcuuucgccaccagaaugcacagggggaaggaaccgcugccgauuacaaguccacucaaucagcuauuaaccagaugacaggcaaacuuaauagacugaucgagaagaccaaccagcaguucgaguugaucgacaaugaauuuacggagguagaaaaacaaauugguaacgugaucaauuggaccagggacaguauuacagaggucuggagcuauaacgccgaacuccugguggcaauggagaaucagcacacuauagauuuagccgacuccgagaugaacaagcuguacgaacggguuaagcgacagcuccgcgagaaugcugaagaggaugggaccggcuguuucgaaaucuuucauaaaugcgacgaugacuguauggcgucuauuagaaacaacacauaugaucacagcaaguacagggaggaggcaaugcagaaucggauccaaaucgaccccgugaaacuuucaaguggauauaaggaugucauucugugguucuccuuuggcgccagcugcuucauauugcuagcuaucgccauggggcugguguuuauuugcgugaaaaacggaaauaugcgcuguacuaucugcauuuga

SEQ ID NO: 132276 - RNA, 1683 nt, Artificial Sequence; identical to SEQ ID NO: 132253
  derived and/or modified sequence opt3 from hemagglutinin__InfluenzaA__AGQ81052

SEQ ID NO: 132277 - RNA, 1683 nt, Artificial Sequence
  derived and/or modified sequence opt3 from hemagglutinin__InfluenzaA__AGQ81053
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucaacaaagaagcaaugggcuucacauauuccgggauucggaccaauggagccacgucugcuugucgcagaucggguagcagcuuuuacgcagagaugaaguggcuguugaguaacacugauaaugccgcuuucccuccaaugaccaaguccuauaaaaacacaaggaaggcccccgcgcucaucauauggggcauucaccauucugggagcacugcagagcaaaccaaacuguacggauccggcaauaagauggucacagugcggucaaguaacuaucagcagagcuuuguaccuucuccaggugccgggccccagguuaauggacaauccggccgcaucgacuuccacuggcugaugcucaacccuaaugauaccgugacguuuucauucaacggcgcuuuuauugccccagaccgagcaucauucuuaagagggaaaaguaugggaauccagucugguguccagguggaugcuaacugcgaaggcgacuguuaccauuccgggggaacuaucauuagcaaucugccguuucagaacauagauucgaggguggucggcaagugcccccgguauguuaagcaaaaaucucuuuugcuggccacagguaugaagaaugugccugagaucccaaaagggcguggccuauucggagcgauugccggcuucaucgaaaacgggugggagggacucauagacgguugguacggcuuucgccaccagaaugcacagggggaaggaaccgcugccgauuacaaguccacucaaucagcuauuaaccagaugacaggcaaacugaauagacuuaucgagaagaccaaccagcaguucgagcugaucgacaaugaauuuacggagguagaaaaacaaauugguaacgugaucaauuggaccagggacaguauuacagaggucuggagcuauaacgccgaauugcucguggcaauggagaaucagcacacuauagaucuggccgacuccgagaugaacaaguuauacgaacggguuaagcgacagcugcgcgagaaugcugaagaggaugggaccggcuguuucgaaaucuuucauaaaugcgacgaugacuguauggcgucuauuagaaacaacacauaugaucacagcaaguacaggaaagaggcaaugcagaaucggauccaaaucgaccccgugaagcucucaaguggauauaaagaugucauucuuugguucuccuuuggcgccagcugcuucauacuguuggcuaucgccauggggcuaguguuuauuugcguaaagaacggaaauaugcgcuguacuaucugcauuuga

SEQ ID NO: 132278 - RNA, 1683 nt, Artificial Sequence; identical to SEQ ID NO: 132253
  derived and/or modified sequence opt3 from hemagglutinin__InfluenzaA__AGQ81055

SEQ ID NO: 132279 - RNA, 1683 nt, Artificial Sequence; identical to SEQ ID NO: 132253
  derived and/or modified sequence opt3 from hemagglutinin__InfluenzaA__AGQ81056

SEQ ID NO: 132280 - RNA, 1683 nt, Artificial Sequence; identical to SEQ ID NO: 132253
  derived and/or modified sequence opt3 from hemagglutinin__InfluenzaA__AGQ81057

SEQ ID NO: 132281 - RNA, 1683 nt, Artificial Sequence; identical to SEQ ID NO: 132253
  derived and/or modified sequence opt3 from hemagglutinin__InfluenzaA__AGQ81058

SEQ ID NO: 132282 - RNA, 1683 nt, Artificial Sequence; identical to SEQ ID NO: 132004
  derived and/or modified sequence opt3 from hemagglutinin__InfluenzaA__AGQ81059

SEQ ID NO: 132283 - RNA, 1683 nt, Artificial Sequence; identical to SEQ ID NO: 132004
  derived and/or modified sequence opt3 from hemagglutinin__InfluenzaA__AGQ81060

SEQ ID NO: 132284 - RNA, 1683 nt, Artificial Sequence; identical to SEQ ID NO: 132004
  derived and/or modified sequence opt3 from hemagglutinin__InfluenzaA__AGQ81061

SEQ ID NO: 132285 - RNA, 1683 nt, Artificial Sequence
  derived and/or modified sequence opt3 from hemagglutinin__InfluenzaA__AGQ81081
auggagguggucagccugaucaccauucuccuuguuauaacaggcuccaacgccgacaagaucugcauuggguaccagucuacuaauucaacggaaaccguggauacacugacugagaacaauguacccgugacccacgcuaaagaauuguuacauacagagcacaacggaaugcugugugcaaccaaucuagguagaccucucauccuggacacuugcacaauugaaggccuuaucuaugggaacccaaguugugauauacuguugggaggcagggaguggagcuacaucgucgagcggccguccgccgugaauggucucugcuaucccgggaacguugaaaaucuggaggaacugcgcucucucuucucgucagcgagcaguuaccaacguauucagaucuuuccugacaccauuuggaacguguccuauucuggaacgagcaaggcuuguuccgauucauucuaccgaaguaugagaugguuaacucagaaaaauaacgccuauccaguccaggacgcacaauacaccaauaacaggggccggaauauccuguuuauguggggcauaaaccaucccccuacagauacugcccagaccaaccuuuacacacgcaccgacacgacuacaagcguggcuaccgaggauauuaauagaacuuucaagccauugaucgggcccaggccucugguaaacggacuacagggucggauugacuauuacugggcaguucuccgcccaggccagacacugcgaaucagaucuaaugggaaccuuaucgccccgugguauggacacauucuguccggcgagucacaugguaggauauugaaaaccgaucucaauagcgggaacugcgugguccaaugucagacggaacggggaggccugaauaccacauuacccuuucacaacgugaguaaguacgcuuucggcaauugcccuaaguaugugggggucaaaucucugaagcucgccguuggacuucguaacgugccagcgcgcuccagcagaggucuguuuggcgcaaucgccggguucauugagggaggcuggucggguuugguagcugggugguacggcuuucagcacucuaaugaccagggaacuggcauggccgcagauagggacuccacccaaaaagcuaucgacaagauaacaucaaaagugaacaauauugucgauaagaugaacaagcaguaugaaaucaucgaccaugaguucagugaaauugagacucggcuaaauaugaucaacaacaaaauugaugaccagauacaagauaucugggccuacaaugcggagcugcucgugcugcuugaaaaccagaagacccuggacgagcacgaugccaauguuaacaauuuguacaacaaagugaagcgagcacucgggagcaaugcugucgaagacggaaaagguuguuuugagcuguaucauaagugcgauaaccaguguauggaaacaauucgcaauggcaccuacaacagaaggaaauauaaggaggagucccgguuagaacgccagaagaucgagggggugaaacuggaaucugagggaacuuacaagauccuaacgauuuauagcacaguagccucaagucucguuauagcuaugggcuucgccgcauuucuguucugggccauguccaaugguagcugcagaugcaacaucuguauuuga

SEQ ID NO: 132286 - RNA, 1683 nt, Artificial Sequence
  derived and/or modified sequence opt3 from hemagglutinin__InfluenzaA__AGQ81086
auggagguggucagccugaucaccauucuccuuguuauaacaggcuccaacgccgacaagaucugcauuggguaccagucuacuaauucaacggaaaccguggauacacugacugagaacaauguacccgugacccacgcuaaagaauuguuacauacagagcacaacggaaugcugugugcaaccaaucuagguagaccucucauccuggacacuugcacaauugaaggccuuaucuaugggaacccaaguugugaucuguugcucggaggcagggaguggagcuacauagucgagcggccguccgccgugaauggucugugcuaucccgggaacguugaaaaucuggaggaacuccgcucuuuauucucgucagcgagcaguuaccaacgaauccagauuuuuccugacaccaucuggaacguguccuauucuggaacgagcaaggcuuguuccgauucauucuaccguaguaugagauggcugacucagaaaaauaacgccuauccaguccaggacgcacaauacaccaauaacaggggccggaauauucuuuuuauguggggcaucaaccaucccccuacagauacugcccagaccaacuuguacacacgcaccgacacgacuacaagcguggcuaccgaggauauaaauagaacuuucaagccacugauugggcccaggccucuaguaaacggacuccagggucggaucgacuauuacugggcaguucugcgcccaggccagacacuucgaauuagaucuaaugggaaccugaucgccccgugguauggacacaucuuguccggcgagucacaugguaggauucucaaaaccgaucugaauagcgggaacugcgugguccaaugucagacggaacggggaggcuuaaauaccacacugcccuuucacaacgugaguaaguacgcuuucggcaauugcccuaaguaugugggggucaaaucucucaaacuugccguuggacugcguaacgugccagcgcgcuccagcagagguuuguuuggcgcaauagccggguucaucgagggaggcuggucgggucuaguagcugggugguacggcuuucagcacucuaaugaccagggaacuggcauggccgcagauagggacuccacccaaaaggcuauugacaagaucacaucaaaagugaacaauauagucgauaagaugaacaagcaguaugaaauuaucgaccaugaguucagugaaaucgagacucggcugaauaugauuaacaacaaaaucgaugaccagauucaagauauaugggccuacaaugcggagcuccuggugcuucuggaaaaccagaagaccuuggacgagcacgaugccaauguuaacaaucucuacaacaaagugaagcgagcacuggggagcaaugcugucgaagacggaaaagguuguuuugaguuauaucauaagugcgauaaccaguguauggaaacaauccgcaauggcaccuacaacagaaggaaauauaaggaggagucccggcuggaacgccagaagauugagggggugaaacuagaaucugagggaacuuacaagauccucacgaucuauagcacaguagccucaagucugguuauugcuaugggcuucgccgcauuucuuuucugggccauguccaaugguagcugcagaugcaacauauguaucuga

SEQ ID NO: 132287 - RNA, 1683 nt, Artificial Sequence
  derived and/or modified sequence opt3 from hemagglutinin__InfluenzaA__AGQ81087
auggagaccgugagccugaucacaaugcuccuugucgccacuguuauuaacgcugacaagauaugcaucggcuaccaguccaccaauucuacggaaacaguggauacucugaccgagaacaauguacccgugacacacgcaaaagaauuguuacauaccgagcacaacgggaugcugugugccacuaaucuaggacauccucucauucuggacacaugcaccaucgaaggucuuauuuauggcaacccaucaugugaucuguugcucgggggaagagaguggaguuacaucgucgagaggccgagcgcggugaauggccugugcuaucccgguaacguugaaaaucuggaggaacuccgguccuuauucucuucggcuucaagcuaccaacgcauacagaucuuuccugacacgauuuggaacgugaguuauuccgggacuucuaaggccuguagcgauuccuucuaccgaucaaugcguuggcugacccagaaaaauaacgcauauccaauccaggacgcccaauacacaaauaacagagagaagaauauucuuuuuauguggggaaucaaccaucccccuacugauaccgcucagacaaacuuguacaccaggacggacacuacaaccagugucgcaacugaggaaauaaaucggacauucaaaccacugauuggcccccgcccucuagugaacggccuccaggggagaaucgauuauuacuggagcguacugaagccaggacagacccuuaggauucggucuaaugguaaccugaucgccccgugguauggccacaucuuguccggggagucacacggacgcguucucaagacggaccugaaacgaggcagcugcaccgugcaaugucagacagaaaaggguggguuaaauacuacccugcccuuucagaacgucaguaaauacgcuuucggaaauugcucuaaguaugugggcgugaaaucccucaagcuagccgucggccugagaaacguuccuagcaggucgucucggggguuguuuggagcgauugcagguuucauagagggcgggugguccggacuuguggccggcugguacgguuuucagcacucaaaugaucaagggguaggcauggcugccgaccgugauaguacacagaaggcaaucgacaaaaugacuagcaaggugaacaauauugucgacaaaaugaacaagcaguaugaaaucauaaaucaugaguucuccgagauugaaacccgccugaacaugaucaauaacaaaaucgaugaccaaauucaggauaucugggcuuacaacgccgagcuccuggugcuucuggaaaaucagaagacauuggacgagcacgaugcgaacguuaauaaccucuacaauaaagugaagagagcccugggaucuaacgcagucgaagacggcaagggguguuuugaguuauaucauaaaugcgaugaccaguguauggagaccauuaggaauggaacuuacaaccggcgacgcuaucaagaagagagcaagcuggaaagacagaaaauagagggugugaagcuagaaucagagggcacguacaaaauccucacaauuuauaguaccguagcuuccagccugguuaucgccaugggguucgcugccuuucuuuucugggcaaugucuaauggaucauguaggugcaacaucugcauuuga

SEQ ID NO: 132288 - RNA, 1683 nt, Artificial Sequence
  derived and/or modified sequence opt3 from hemagglutinin__InfluenzaA__AGQ81092
auggagguggucagccugaucaccauucuccuuguuauaacaggcuccaacgccgacaagaucugcauuggguaccagucuacuaauucaacggaaaccguggauacacugacugagaacaauguacccgugacccacgcuaaagaauuguuacauacagagcacaacggaaugcugugugcaaccaaucuagguagaccucucauccuggacacuugcacaauugaaggccuuaucuaugggaacccaaguugugaucuguugcucggaggcagggaguggagcuacauagucgagcggccguccgccgugaauggucugugcuaucccgggaacguugaaaaucuggaggaacuccgcucuuuauucucgucagcgagcaguuaccaacgaauccagauuuuuccugacaccaucuggaacguguccuauacgggaacuucuaaggcuuguagcgauuccuucuaccguucaaugagauggcugacccagaaaaauaacgccuauccaguccaggacgcacaauacacaaauaacaggggccggaauauucuuuuuauguggggcaucaaccaucccccuacugauaccacacagaccaacuuguacacgcgcacugacacaaccacuucuguggccacagaggauauaaauagaaccuucaagccacugauugggcccaggccucuaguaaacggacuccagggucggaucgacuauuacugggcuguucugcgcccaggccagacgcuucgaauuagaagcaaugggaaccugaucgcaccgugguauggacacaucuugucuggcgagucccaugguaggauucucaaaaccgaucugaagucagggaauugcgugguccaaugucagacagaacggggaggcuuaaacacuacccugcccuuucacaaugugagcaaguacgccuucggcaacugcccuaaauaugugggggucaagagucucaaacuugcuguuggacugcguaaugugccagcccgcaguuccagagguuuguuuggcgcgauagcaggguucaucgagggaggcuggagcggucuaguagccgggugguacggcuuucagcacucgaacgaccagggaacaggcauggcugccgauagggacucuacucaaaaggcaauugacaaaaucaccuccaaggugaauaacauagucgauaagaugaauaaacaguaugaaauuaucgaccaugaguucucagaaaucgagacacggcugaacaugauuaauaacaagaucgaugaccagauucaagauauaugggcuuacaacgccgagcuccuggugcuucuggaaaaucagaaaaccuuggacgagcacgaugcgaacguuaauaaccucuacaauaaggugaaacgagcccuggggaguaacgcagucgaagacggaaaggguuguuuugaguuauaucauaaaugcgauaaucaguguauggaaacuauccgcaacggcacguacaauagaaggaaguauaaggaggagagccggcuggaacgccagaaaauugagggggugaagcuagaauccgagggaacauacaaaauccucaccaucuauucuacuguagcuagcucacugguuauugccaugggcuucgcugccuuucuuuucugggcaaugaguaacgguuccugcagaugcaauauauguaucuga

SEQ ID NO: 132289 - RNA, 1683 nt, Artificial Sequence
  derived and/or modified sequence opt3 from hemagglutinin__InfluenzaA__AGQ81095
auggagguggucagccugaucaccauucuccuuguuauaacaguguccaacgccgacaagaucugcauuggcuaccagucuacuaauucaacggaaaccguaaacacacugacugaggauaaugugcccgucacccacgcuaaagaauuguuacauacagagcacaacgggaugcugugugcaaccaaucuaggaagaccucucauccuggacacuugcacaauugaaggucuuaucuauggcaacccaaguugugaucuguugcucgggggaagggaguggagcuacauaguggagcggccguccgccguuaauggccugugcuaucccgguaacguggaaaaucuggaggaacuccgcucuuuauucucgucagcgagcaguuaccaacgaauccagauuuuuccugacaccaucuggaacgucuccuauucugggacgagcaaggcuuguuccgauucauucuaccguaguaugagauggcugacucagaaaaauaacgccuauccagugcaggacgcacaauacaccaauaacaggggacggaauauucuuuuuauguggggcaucaaccaucccccuacagauacugcccagaccaacuuguacacacgcaccgacacgacuacaagcguagcuaccgaggauauaaauagaacuuucaagccacugauuggccccaggccucuaguuaacgggcuccagggacggaucgacuauuacugggcagugcugaaaccaggucagacacuucgcauucgaucuaauggcaaccugaucgccccgugguaugggcacaucuuguccggagagucacauggcaggauucucaagaccgaucugaauagcgguaacugcgucgugcaaugucagagugaaagagggggauuaaauacgacccugcccuuucacaacgugucuaaguacgcuuucggcaauugcccuaaauaugucggcguuaagucccucaaacuugccguggggcugcggaacguaccagcgcguagcucgcgcggauuguuuggugcaauagccggcuucaucgaagggggauggucuggccuaguggcugguugguacggguuucagcacuccaaugaccagggcacaggaauggccgcagauagagacucaacucaaaaggcuauugacaaaaucaccaguaaggucaacaauauaguggauaagaugaacaaacaguaugagauuaucgaccaugaguucagcgaaaucgagacaaggcugaauaugauuaacaacaagaucgaugaccagauucaagauauaugggccuacaaugcggagcuccugguucuucuggaaaaccagaaaacuuuggacgagcacgaugccaaugugaacaaucucuacaacaaggucaaacgggcacugggcuccaaugcuguggaagacgggaagggauguuuugaguuauaucauaaaugcgauaaccaguguauggaaaccauccgaaaugguacauacgaccgcagaaaguauaaggaggagucuaggcuggaacggcagaaaauugagggcguaaagcuagaaagcgaggggaccuacaaaauccucacuaucuauucaacgguugccaguucccuggugauugcuaugggauucgccgcauuucuuuucugggccaugagcaacggcucuugccgcagaaauauaugcaucuga

SEQ ID NO: 132290 - RNA, 1683 nt, Artificial Sequence
  derived and/or modified sequence opt3 from hemagglutinin__InfluenzaA__AGQ81099
auggagaccgugagccugaucacaauucuccuuauagucacuguuuccaacgccgacaagaucugcauuggcuaccagucuacuaauucaaccgaaacaguggauacucugaccgagaacaauguacccgugacacacgcuaaagaauuguuacauaccgagcacaacgggaugcugugugcaacuaaucuaggacauccucucauccuggacacaugcaccauugaaggucuuaucuauggcaacccaaguugugaucuguugcucgggggaagagaguggagcuacauagucgagaggccguccgccgugaauggccugugcuaucccgguaacguugaaaaucuggaggaacuccggucuuuauucucgucagcgaacagcuaccaacgcauccagauuuuuccugacacgaucuggaaugugaguuauuccgggacuucuaaggcuuguagcgauuccuucuaccgaucaaugcguuggcugacccagaaaaacaaugccuauccaacacaggacgcacaauacacuaacaauagagagaagaacauucuuuuuauguggggaaucaaccaucccccuaccgauacagcccagaccaauuuguacacgaggacugacacaaccacgagugucgcuacagaggaaauaaaccggaccuucaaaccacugauuggcccccgcccucuagugaauggccuccaggggagaaucgauuauuacuggagcguacugaagccaggacagacgcuuaggauucggucuaacgguaaucugaucgcaccgugguauggccacaucuuguccggggagucacacggacgcauucucaagaccgaccugaaacgaggcagcugcacaguucaaugucagacugaaaaggguggguuaaacaccacacugcccuuucagaaugugaguaaauacgccuucggaaacugcucuaaguaugucggcgugaaaucccucaagcuagcugugggccugagaaaugucccuagcaggucgucucggggguuguuuggagccauagcggguuucaucgagggcgggugguccggacuuguugcaggcugguacgguuuucagcacucaaacgaucaaggggugggcauggccgcugaccgugauaguacucagaaggccauugacaaaguaaccagcaaggugaauaacaucgucgacaaaaugaauaagcaguaugaaauaauugaucaugaguucuccgagguggaaacacgccugaacaugaucaauaacaaaaucgacgaucaaauucaggacaucugggcauacaacgcugagcuccugguucuucuggaaaaucagaagaccuuggaugagcacgacgccaacgugaauaaccucuacaauaaagucaagagagcgcugggaucuaacgccguggaagauggcaagggguguuuugaguuauaucauaaaugcgacgaucaguguauggagacuauuaggaauggaacguacaaccggcgaaaguaucaagaagagagcaaacuggaacgccagaagauagaggguguaaaacuagaaucagagggcacauacaagauccucaccauuuauaguacuguugcauccagccuggugaucgcuaugggguucgccgcuuuucuuuucugggccaugucuaauggaucaugcagaaggaacaucugcauuuga

SEQ ID NO: 132291 - RNA, 1683 nt, Artificial Sequence
  derived and/or modified sequence opt3 from hemagglutinin__InfluenzaA__AGQ81100
auggagaccgugagccugaucacaaugcuccuugucgccacuguuauuaacgcugacaagauaugcaucggcuaccaguccaccaauucuacggaaacaguggauacucugaccgagaacaauguacccgugacacacgcaaaagaauuguuacauaccgagcacaacgggaugcugugugccacuaaucuaggacauccucucauucuggacacaugcaccaucgaaggucuuauuuauggcaacccaucaugugaucuguugcucgggggaagagaguggaguuacaucgucgagaggccgagcgcggugaauggccugugcuaucccgguaacguugaaaaucuggaggaacuccgguccuuauucucuucggcuucaagcuaccaacgcauacagaucuuuccugacacgauuuggaacgugaguuauuccgggacuucuaaggccuguagcgauuccuucuaccgaucaaugcguuggcugacccagaaaaauaacgcauauccaauccaggacgcccaauacacaaauaacagagagaagaauauucuuuuuauguggggaaucaaccaucccccuacugauaccgcucagacaaacuuguacaccaggacggacacuacaaccagugucgcaacugaggaaauaaaucggacauucaaaccacugauuggcccccgcccucuagugaacggccuccaggggagaaucgauuauuacuggagcguacugaagccaggacagacccuuaggauucggucuaaugguaaccugaucgccccgugguauggccacaucuuguccggggagucacacggacgcauucucaagacggaccugaaacgaggcagcugcaccguucaaugucagacagaaaaggguggguuaaauacuacccugcccuuucagaacgugaguaaauacgcuuucggaaauugcucuaaguaugucggcgugaaaucccucaagcuagccgugggccugagaaacgucccuagcaggucgucucggggguuguuuggagcgauagcagguuucaucgagggcgggugguccggacuuguugccggcugguacgguuuucagcacucaaaugaucaaggggugggcauggcugccgaccgugauaguacacagaaggcaauugacaaaaucacuagcaagguaaacaauauaguggacaaaaugaacaagcaguaugaaauuaucgaucaugaguucuccgaggucgaaacccgccugaauaugaucaacaauaaaauugacgaucaaauccaggacauuugggcuuacaacgccgagcuccuggugcuucuggaaaaccagaagacauuggaugagcacgacgcgaauguuaacaaucucuacaacaaagugaagagagcccugggaucuaaugcagucgaagauggcaagggguguuuugaguuauaucauaaaugcgacgaucaguguauggagaccauaaggaacggaacuuacaaucggcgacgcuaucaagaagagagcaagcuggaaagacagaaaaucgagggugugaagcuagaaucagagggcacguacaaaauucucacaaucuauaguaccguagcuuccagccugguuaucgccaugggguucgcugccuuucuuuucugggcaaugucuaacggaucaugcaggcggaauauuugcauauga

SEQ ID NO: 132292 - RNA, 1683 nt, Artificial Sequence
  derived and/or modified sequence opt3 from hemagglutinin__InfluenzaA__AGQ81123
auggagguggucagccugaucaccauucuccuuguuauaacaguguccaacgccgacaagaucugcauuggcuaccagucuacuaauucaacggaaaccguaaacacacugacugaggauaaugugcccgucacccacgcuaaagaauuguuacauacagagcacaacgggaugcugugugcaaccaaucuaggaagaccucucauccuggacacuugcacaauugaaggucuuaucuauggcaacccaaguugugaucuguugcucgggggaagggaguggagcuacauaguggagcggccguccgccguuaauggccugugcuaucccgguaacguggaaaaucuggaggaacuccgcucuuuauucucgucagcgagcaguuaccaacgaauccagauuuuuccugacaccaucuggaacgucuccuauucugggacgagcaaggcuuguuccgauucauucuaccguaguaugagauggcugacucagaaaaauaacgccuauccagugcaggacgcacaauacaccaauaacaagggaaggaauauucuuuuuauguggggcaucaaccaucccccuacagauacugcccagaccaacuuguacacacggaccgacacgacuacaagcguagcuaccgaggauauaaaucgcacuuucaaaccacugauuggccccagaccucuaguuaacgggcuccagggaaggaucgacuauuacugggcagugcugaagccaggucagacacuucggauucgcucuaauggcaaccugaucgccccgugguaugggcacaucuugcucggagagucccauggccgaauacugaagaccgauuuaaauucaggugacugcgucgugcaaugucagagcgaaagagggggacugaacacgacccuccccuuucacaaugugaguaaauacgcuuucggcaacugcccuaaguaugucggcguuaaaucucuuaagcuggccgugggguugaggaauguaccagcgcgguccacacguggacuauuuggugcaauugccggcuucaucgaagggggauggagcggccugguggcugguugguacggguuucagcacucgaacgaucagggcacuggaauggccgcagaccgcgacucuacccaaaaagcuauugauaagaucacauccaaggucaauaacauaguggacaaaaugaauaagcaguaugagauuaucgaucaugaguucucagaaaucgagacuagacucaacaugauuaauaacaaaaucgacgaucagauucaagacauaugggccuacaacgcggagcugcuuguucuguuggaaaaucagaagacccucgaugagcacgacgccaacgugaauaaccuguacaauaaagucaagagggcauuaggcaguaacgcuguggaagaugggaaaggauguuuugagcuguaucauaagugcgacaaucaguguauggaaacaauccggaacgguaccuacgaucgacgcaaguauaaagaggagagcagacuagaaaggcagaagauugagggcguaaaacucgaauccgaggggacuuacaagauccugacgaucuauucuacaguugccagcucacuugugauugcuaugggauucgccgcauuuuuguucugggccaugaguaauggcuccugccggugcaacauauguaucuga

SEQ ID NO: 132293 - RNA, 1683 nt, Artificial Sequence
  derived and/or modified sequence opt3 from hemagglutinin__InfluenzaA__AGQ81124
auggagguggccacccugaucacaauucuccuugucauaacuggcagcaacgcugacaagaucugcauuggguaccaauccaccaauucuacggaaacaguugauacucugaccgagaacaaugugcccguaacacacgcaaaagaauuguuacauaccgagcacaacggaaugcugugugccacuaaucuagguagaccucucauccuggacacaugcaccauugaaggccuuaucuaugggaacccaucaugugaucugccguuggagggaagggaguggaguuacauaguggaacggcccagcgcggucaauggcgugugcuauccugguaacguugagaaucucgaagaacugcgcucccuguucucuucggcuucaagcuaccaacgaauccagauuuuuccagacaguaucuggaacguguccuauucugggacgagcaaggccuguuccgauucauucuaccguaauaugagauggcucacucagaaagacaacaauuaucccguccaggaugcacaauacaccaacaauaggggaaagaacauuuuauuuauguggggcaucaaccauccuccaacagacacugcccagaccaaucuguacacacggaccgauacgacuacaaguguggcuaccgaggacauaaaccgcacuuucaaaccccuuauuggcccuagaccauugguaaaugggcugcagggaaggaucgauuauuacugggcaguucuaaagccgggucagacacuccgggugcgcagcaacggcaaucugauugcccccugguaugggcacauccuucugggagaaucucauggccgaaucuugaagaccgaccucaaauccgguaacugcgucgugcaaugucagacggagagagggggacugaauaccacauuaccuuuucacaacgugucaaaguacgcuuucggcaauugcccaaaauauauuggcgucaagagccugaaacucgccguugggcuuaggaacgugcccgcgcggaguucucguggacuguuuggugcaauagccggcuucaucgaagggggaugguccggcuugguagcugguugguacggguuucagcacagcaaugaucagggcacuggaauggccgcagaccgcgacucgacccaaaaggcuauugauaagaucacaucuaaagugaacaauauagucgacaagaugaacaaacaguaugagauuaucgaucaugaguucuccgagaucgagacuagacuaaauaugauuaacgacaagaucgaugaccagauucaagauauaugggccuacaacgcggaacugcucgugcugcuugagaaucagaaaacccuggacgaacacgaugccaacguuaauaacuuguacaauaaggugaaaagggcacucggcucaaacgcugucgaggacgggaagggauguuuugaucuguaucauaagugcgacaaucaguguauggaaacaauccggaacgguaccuacaaucgacgcaaauaucagaaggagaguagauuagagaggcagaaaauugaaggcgugaagcuggagagcgaagggacuuacaaaauccuaacgaucuauuccacaguagccucuagccucguuauugcuaugggauucgccgcauuucuguucugggccaugucaaacggcaguugccggugcaauauauguaucuga

SEQ ID NO: 132294 - RNA, 1683 nt, Artificial Sequence
  derived and/or modified sequence opt3 from hemagglutinin__InfluenzaA__AGQ81125
auggagguggccacccugaucacaauucuccuugucauaacuggcagcaacgcugacaagaucugcauuggguaccaguccaccaauucuacggaaacaguugauacucugaccgagaacaaugugcccguaacacacgcaaaagaauuguuacauaccgagcacaacggaaugcugugugccacuaaucuagguagaccucucauccuggacacaugcaccauugaaggccuuaucuaugggaacccaucaugugaucugccguuggagggaagggaguggaguuacauaguggaacggcccagcgcggucaauggcgugugcuauccugguaacguugagaaucucgaggagcugcgcucccuguucucuucggcuucaagcuaccaacgaauccagauuuuuccagacaguaucuggaacguguccuauucugggacgagcaaggccuguuccgauucauucuaccguaguaugagauggcucacucagaaagacaauaacuaucccguccaggaugcacaauacaccaauaacaggggaaagaauauuuuauuuauguggggcaucaaccauccuccaacagacacugcccagaccaaccuguacacacggaccgauacgacuacaagcguggcuaccgaggacauaaaucgcacuuucaaaccccuuauuggcccuagaccauugguaaacgggcugcagggaaggaucgauuauuacugggcaguucuaaagccgggucagacacuccgggugcgcucuaauggcaaccugauugcccccugguaugggcacauccuucugggagucucccauggccgaaucuugaagaccgaccucaaaucagguaauugcguggugcaaugucagacggaaagagggggacugaacaccacauuaccuuuucacaaugucagcaaguacgcuuucggcaacugcccaaaauauauuggcguuaagagucugaaacucgccguggggcuuaggaauguacccgcgcggucuucccguggacuguuuggugcaauagccggcuucaucgaagggggauggagcggcuugguggcugguugguacggguuucagcacucgaacgaucagggcacuggaauggccgcagaccgcgacucuacccaaaaggcuauugauaagaucacauccaaagucaauaacauaguggacaagaugaauaaacaguaugaaauuaucgaucaugaguucucagaaaucgagacuagacuaaacaugauuaaugacaagaucgaugaccagauucaagauauaugggccuacaacgcggagcugcucguucugcuugaaaaccagaaaacccuggacgagcacgaugccaaugugaacaauuuguacaacaaggucaaaagggcacucggcaguaaugcuguggaagacgggaagggauguuuugaucuguaucauaagugcgacaaccaguguauggagacaauccggaaugguaccuacaaccgacgcaaauaucaggaagagagcagauuagagaggcaaaagauugaaggcguaaaacuggaguccgaagggacuuacaagauccuaacgaucuauucuacaguugccagcucacucgugauugcuaugggauucgccgcauuucuguucugggccaugaguaauggcuccugccggugcaacauauguaucuga

SEQ ID NO: 132295 - RNA, 1683 nt, Artificial Sequence
  derived and/or modified sequence opt3 from hemagglutinin__InfluenzaA__AGQ81126
auggagaccaucagccugaugacaauucuccuuauaacuacggccuccaacgcugacaagaucugcauuggccaccagucuaccaauucaacagaaacuguggauacccugacagagaccaacguccccguuacucaugcaaaagaauuguuacaaacagagcacaaugggaugcugugugccaccaaccuaggacauccucucauccuggacacgugcacuauugaaggucuuaucuacggcaauccaaguugugaucuguugcucgaggggagagaguggagcuauauaguggaaaggccguccgcgguaaacggaaccugcuaccccggcaauguggagaaccuggaagaacugcggacacucuucucuucggcuucaagcuaucagcgcauccagauuuuuccugacacuaucuggaaugucaccuacacagguaccagucgauccuguucugggagcuucuaucguuccaugagaugguuaacgcagaagucaggauuuuacccagugcaagaugccaaauauacuaacaauaggggcaagaacauucuguucguuuggggcauccaccauccccacacauacaccgaccagacuacacuuuacauacggaaugauaccacgaccagugugacaacugaggaauugaaccgcauuuuuaaaccugucaucgugccaagacugcuaguaaaugggcagcagggaaggauugacuauuacuggagcguucucaagcccggucaaacccugcgggugcgcucuaacggcaaccuuaucgcaccuugguaugggcacguccuguccggaggcucacauggucgaaucuugaagacagaucucaaagggggaaauugcguggugcagugucagacugagaagggcggcuucaacagcacccugccauuucacaauauuaguaaauacgccuucgggacaugcccgaaguaugucaaaguuaacucuuuaaagcuggcuauaggacucagaaaugugcccgcaagguccaaccggggucuuuuuggcgccaucgcuggguucauugaaggaggcuggccuggucugguagccgggugguacggcuuucagcauagcaaugaccaaggagugggcauggcggcagaucgugacucgacccagaaggccgucgauaaaaucacuucuaaggugaacaauauaguugacaaaaugaacaagcaguaugagauuaucgaccacgaguucuccgagguggagacgcgcuugaauaugaucaacaauaaaauugaugaccaaauccaggauauuugggcuuacaacgccgaacuacugguccuccuggagaaucagaagacacuugacgaacacgaugcaaacgugaacaaucuguacaacaaaguaaagagagcuuuggggucaaaugccauggaggacggaaaggguuguuuugaacucuaucauaaaugcgaugaccaguguauggagaccauaaggaacggcacuuacaaucggcgaaaguaucgcgaggaaaguagacuggagcaacagaggaucgaagggguuaaauuagagagcgaaggaaccuacaagauucugacaaucuauuccaccguggcgucuagccuaguccucgccaugggcuucgcagcuuuccuguuuugggccaugucaaacgguaguugccggugcaauaucuguauuuga

SEQ ID NO: 132296 - RNA, 1683 nt, Artificial Sequence
  derived and/or modified sequence opt3 from hemagglutinin__InfluenzaA__AGQ81127
auggagguggccacccugaucacaauucuccuucugauaacuggcagcaacgcugacaagaucugcauuggguaccaguccaccaauucuacggaaacagucgauacuuugaccgagaacaauguucccgugacacacgcaaaagaauuacugcauaccgagcacaacggaaugcuaugugccacuaaucucgguagaccucugauccuugacacaugcaccauugaaggccugaucuaugggaacccaucaugugauuugccgcucgagggaagggaguggaguuacauaguagaacggcccagcgcggugaauggcgucugcuauccugguaacguggagaaucuggaagaacugcgcucccucuucucuucggcuucaagcuaccaacgaauccagauuuuuccagacaguaucuggaacguuuccuauucugggacgagcaaggccuguuccgauucauucuaccguaguaugagaugguuaacucagaaaaauaacaauuaucccgugcaggacgcacaauacaccaacaauaggggaaagaacauucuguuuauguggggcaucaaccauccuccaacagauacugcccagaccaaucuuuacacacggaccgacacgacuacaagcgucgcuaccgaggauauaaaccgcacuuucaaacccuugauuggcccuagaccacuggugaaugggcuacagggaaggaucgacuauuacugggcaguacucaagccgggucagacacugcggguucgcucuaacggcaaucuuauugcccccugguaugggcacauccuguugggagaaucccauggccgaauccucaagaccgaucugaaaucagguaacugcgugguccaaugucagacggagagagggggauuaaauaccacacugccuuuucacaacgugagcaaguacgcuuucggcaauugcccaaaauauauuggcgugaagagucucaaacuugccgucgggcugaggaacguucccgcgcggucuucccguggauuguuuggugcaauagccggcuucaucgaagggggauggagcggccuaguggcugguugguacggguuucagcacucgaaugaccagggcacuggaauggccgcagaucgcgacucuacccaaaaggcuauugacaagaucacauccaaaguaaacaauauaguggauaagaugaacaaacaguaugagauuaucgaccaugaguucucagagaucgagacuagacugaauaugauuaacgauaagaucgacgaucagauucaagacauaugggccuacaacgcggaacuccugguccuucuggagaaucagaaaaccuuggaugaacacgacgccaacgugaauaaccucuacaauaagguuaaaagggcacugggcaguaacgcuguggaggaugggaagggauguuuugacuuauaucauaagugcgauaaucaguguauggaaacaauccggaacgguaccuacaaucgacgcaaauaucaggaggagagcagacuggaaaggcaaaagauugagggcgucaaacuagaauccgaggggacuuacaagauccucacgaucuauucuacaguggccagcucacugguaauugcuaugggauucgccgcauuucuuuucugggccaugaguaacggcuccugccggugcaauauauguaucuga

SEQ ID NO: 132297 - RNA, 1683 nt, Artificial Sequence
  derived and/or modified sequence opt3 from hemagglutinin__InfluenzaA__AGQ81128
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaagggaguggaguuacaucguagaacggcccagcgcugugaauggcgucugcuauccugguaacguggagaauuuggaggaacuccgcucccuguucucuucggccucaagcuaccaacguauucagaucuuuccagacaguauuuggaacguuuccuauucugggacgagcaaggcauguuccgauucauucuaccgaaguaugagauggcugacucagaaaaauaacaauuaucccgugcaggacgcccaauacaccaacaauaggggaaagaacauccucuuuauguggggcauaaaccauccuccaacagauacugcucagaccaauuuauacacacggaccgacacgacuacaagcgucgcaaccgaggauauuaaccgcacuuucaaaccccugaucggcccuagaccacuugugaauggguugcagggaaggauugacuauuacugggccguacugaagccgggucagacacuacggguucgcucuaacggcaaucucaucgcucccugguaugggcacauccugcuuggagaaucccauggccgaauacugaagaccgauuugaaaucagguaacugcgugguccaaugucagacggagagagggggacucaauaccacacugccuuuucacaacgugagcaaguacgccuucggcaauugcccaaaauauauuggcgugaagaguuuaaaacuggcggucgggcucaggaacguucccgcacggucuucccguggacuuuuuggugccaucgcuggcuucauugaagggggauggagcggccugguggccgguugguacggguuucagcacucgaaugaccagggcacuggaauggcagcugaucgcgacucuacccaaaaggccaucgacaagauaacauccaaaguaaacaauauuguggauaagaugaacaaacaguaugacaucaucgaucaugaguucucagaaauugagacuagauugaauaugaucaacgacaagauugaugaccagauacaagauaucugggcguacaacgccgagcuacugguccuccuggaaaaucagaaaacccuugacgagcacgaugcaaacgugaauaaccuguacaauaagguuaaaagggcuuugggcaguaacgccguggaagacgggaagggauguuuugaucucuaucauaagugcgacaaucaguguauggagacaauucggaacgguaccuacaaucgacgcaaauaucaggaagagagcagacuggagaggcaaaagaucgaaggcgucaaauuagaguccgaagggacuuacaagauccugacgauuuauucuacaguggcuagcagucuaguaguugccaugggauucgcagccuuucucuucugggcuaugucaaacggcuccugccggugcaauauauguaucuga

SEQ ID NO: 132298 - RNA, 1683 nt, Artificial Sequence
  derived and/or modified sequence opt3 from hemagglutinin__InfluenzaA__AGQ81130
auggagaccgugagccugaucacaauucuccuugucguuacuauaggcaacgccgacaagaucugcauuggguaccaguccaccaauucuacggaaacaguggauacucugaccgagaacaauguacccgugacacacgcuaaagaauuguuacauaccgagcacaacggaaugcugugugcaacuucacuaggucauccucucauccuggacacaugcaccauugaaggccuuaucuaugggaauccaaguugugaucuguugcucggaggcagagaguggagcuacauagucgagaggccguccgccgugaacggucugugcuaucccgggaauguugaaaaccuggaggaacuccggucuuuauucucgucagcgcgcagcuaccaacgaauccagauuuuuccugacacgaucuggaaugugaguuauuccggaacuucuaaggcuuguagcgauuccuucuaccguucaaugagauggcugacccagaaaaacaaugccuauccaauucaggacgcacaauacacaaacaaucaggagaagaacauccuuuuuauguggggcauaaaucaucccccuacugauaccguccagacaaacuuguacaccaggacggacacuacaaccaguguggccacugaggaaauuaaccggacauucaaaccacugaucggcccccgcccucuaguaaaugggcuccagggaagaauugauuauuacuggagcguucugaagccaggucaaacccuuaggauccggucuaacggcaaucugaucgcuccgugguaugggcacauuuuguccggagagucacacggccgcauacucaagacggaccugaaacgagguagcugcaccgugcagugucagacagaaaaagggggauuaaacacuacccugcccuuucagaaugucaguaaguacgcauucggcaacugcucuaaguauaucggcaugaaaucccucaaacuugccguggggcugagaaaugugccuagcaggucgucucggggauuguuuggugcuauugccggcuucaucgaagggggaugguccggccuagucgcggguugguacggguuucaacacucaaacgaucagggcguuggaauggcagccgaccgugauaguacacagaaggcuauagacaagauuacuagcaaggugaauaacaucguagacaaaaugaauaagcaauaugagaucauugaucaugaguucuccgagguggaaacccgccugaacaugaucaauaacaaaauugacgaucagauacaggacaucugggccuacaaugcagagcuccugguccuucuggaaaaccagaagacauuggaugagcacgacgcuaacgugaauaaccucuacaauaaaguuaagagagcccugggcuuuaacgcgguggaagaugggaagggauguuucgaguuauaucauaaaugcgacgaucaauguauggagaccauuaggaaugguacuuacaaccggcgaaaguaucaggaagagucuaaacuggaacgccagaagaucgagggcgucaaacuagaaagcgaggggacguacaagauccucacaauuuauucaaccguggccaguucccugguaauagcaaugggauuugcugccuuccuuuucugggcuaugagcaauggcucuugcagaugcaacaucuguauuuga

SEQ ID NO: 132299 - RNA, 1683 nt, Artificial Sequence
  derived and/or modified sequence opt3 from hemagglutinin__InfluenzaA__AGQ81132
auggagaccaucagccugaugacaauucuccuuauaacuacggccuccaacgcugacaagaucugcauuggccaccagucuaccaauucaacagaaacuguggauacccugacagagaccaacguccccguuacucaugcaaaagaauuguuacaaacagagcacaaugggaugcugugugccaccaaccuaggacauccucucauccuggacacgugcacuauugaaggucuuaucuacggcaauccaaguugugaucuguugcucgaggggagagaguggagcuauauaguggaaaggccguccgcgguaaacggaaccugcuaccccggcaauguggagaaccuggaagaacugcggacacucuucucuucggcuucaagcuaucagcgcauccagauuuuuccugacacuaucuggaaugucaccuacacagguaccagucgauccuguucugggagcuucuaucguuccaugagaugguuaacgcagaagucaggauuuuacccagugcaagaugccaaauauacuaacaauaggggcaagaacauucuguucguuuggggcauccaccauccccacacauacaccgaccagacuacacuuuacauacggaaugauaccacgaccagugugacaacugaggaauugaaccgcauuuuuaaaccugucaucgugccaagacugcuaguaaaugggcagcagggaaggauugacuauuacuggagcguucucaagcccggucaaacccugcgggugcgcucuaacggcaaccuuaucgcaccuugguaugggcacguccuguccggaggcucacauggucgaaucuugaagacagaucucaaagggggaaauugcguggugcagugucagacugagaagggcggcuucaacagcacccugccauuucacaauauuaguaaauacgccuucgggacaugcccgaaguaugucaaaguuaacucuuuaaagcuggcuauaggacucagaaaugugcccgcaagguccaaccggggucuuuuuggcgccaucgcuggguucauugaaggaggcuggccuggucugguagccgggugguacggcuuucagcauagcaaugaccaaggagugggcauggcggcagaucgugacucgacccagaaggccgucgauaaaaucacuucuaaggugaacaauauaguugacaaaaugaaccgccaguaugagauuaucgaccacgaguucuccgagguggagacgagauugaauaugaucaacaauaagauugaugaccaaauccaggauauuugggcuuacaacgccgaacuacugguccuccuggagaaucagaaaacacuugacgaacacgaugcaaacgugaacaaucuguacaacaagguaaaaagggcuuuggggucaaaugccauggaggacggaaaggguuguuuugaacucuaucauaagugcgaugaccaguguauggagaccauacggaacggcacuuacaaucgacgcaaauauagagaggaaaguaggcuggagcaacagcggaucgaagggguuaaguuagagagcgaaggaaccuacaaaauucugacaaucuauuccaccguggcgucuagccuaguccucgccaugggcuucgcagcuuuccuguuuugggccaugucaaacgguaguugccgcugcaauaucuguauuuga

SEQ ID NO: 132300 - RNA, 1683 nt, Artificial Sequence
  derived and/or modified sequence opt3 from hemagglutinin__InfluenzaA__AGQ81133
auggagaccaucagccugaugacaauucuccuuauaacuacggccuccaacgcugacaagaucugcauuggccaccagucuaccaauucaacagaaacuguggauacccugacagagaccaacguccccguuacucaugcaaaagaauuguuacaaacagagcacaaugggaugcugugugccaccaaccuaggacauccucucauccuggacacgugcacuauugaaggucuuaucuacggcaauccaaguugugaucuguugcucgaggggagagaguggagcuauauaguggaaaggccguccgcgguaaacggaaccugcuaccccggcaauguggagaaccuggaagaacugcggacacucuucucuucggcuucaagcuaucagcgcauccagauuuuuccugacacuaucuggaaugucaccuacacagguaccagucgauccuguucugggagcuucuaucguuccaugagaugguuaacgcagaagucaggauuuuacccagugcaagaugccaaauauacuaacaauaggggcaagaacauucuguucguuuggggcauccaccauccccacacauacaccgaccagacuacacuuuacauacggaaugauaccacgaccagugugacaacugaggaauugaaccgcauuuuuaaaccugucaucgugccaagacugcuaguaaaugggcagcagggaaggauugacuauuacuggagcguucucaagcccggucaaacccugcgggugcgcucuaacggcaaccuuaucgcaccuugguaugggcacauccuguccggaggcucacauggucgaauuuugaagacagaucucaaaagcgggaauugcgucgugcagugucagacugagaagggaggcuucaacaguacccugccauuucacaauauaucuaaauacgccuucggcacaugcccgaaguaugugaaagucaacuccuuaaagcuggcuaucgggcucagaaauguucccgcaaggagcaaccggggacuuuuuggugccauugcuggcuucaucgaagggggauggccuggccugguggccgguugguacggguuucagcauucgaaugaccaaggcguaggaauggcggcagaucgugacucuacccagaaggccguggauaaaauaacuuccaaggucaacaauauuguggacaaaaugaacaagcaguaugagaucaucgaccacgaguucucagagguugagacgcgcuugaauaugauuaacaauaaaaucgaugaccaaauucaggauauaugggcuuacaacgccgaacuacuggugcuccuggagaaucagaagacacuugacgaacacgaugcaaacgucaacaaucuguacaacaaagugaagagagcuuugggcaguaaugccauggaggacgggaagggauguuuugaacucuaucauaaaugcgaugaccaguguauggagaccaucaggaacgguacuuacaaucggcgaaaguaucgcgaggaaagcagacuggagcaacagaggauugaaggcguaaaauuagaguccgaagggaccuacaagauccugacaaucuauucuaccguugcgagcagucuagugcucgccaugggauucgcagcuuuccuguuuugggccaugucaaacggcuccugccggugcaauauuuguauauga

SEQ ID NO: 132301 - RNA, 1683 nt, Artificial Sequence
  derived and/or modified sequence opt3 from hemagglutinin__InfluenzaA__AGQ81134
auggagaccaucagccugaugacaauucuccuuauaacuacggccuccaacgcugacaagaucugcauuggccaccagucuaccaauucaacagaaacuguggauacccugacagagaccaacguccccguuacucaugcaaaagaauuguuacaaacagagcacaaugggaugcugugugccaccaaccuaggacauccucucauccuggacacgugcacuauugaaggucuuaucuacggcaauccaaguugugaucuguugcucgaggggagagaguggagcuauauaguggaaaggccguccgcggcuaacggaaccugcuaccccggcaauguagagaacccugaagaacugcggacacuguucucuucggccucaagcuaucagcgcauccagauuuuuccagacacuaucuggaaugugaccuacacagguaccagucgauccuguucugggagcuucuaucguuccaugagauggcucacgcagaagucaggauuuuaccccguccaagaugcaaaauauacuaacaauaggggcaagaacauuuuauucguguggggcauccaccauccucacacauacaccgaccagacuacacuguacauacggaaugauaccacgaccaguguuacaacugaggaacuuaaccgcauuuuuaaaccagugaucguccccagauugcuggugaaugggcagcagggaaggauugacuauuacuggagcguacuaaagccuggucaaacccuccggguucgcucuaacggcaaccugaucgccccaugguaugggcacgugcuuuccggaggcucacauggucgaauccugaagacagauuugaaaagcgggaauugcgucgugcagugucagacugagaagggaggcuucaacaguacccucccguuucacaauauuucuaaauacgcuuucggcacaugccccaaguaugugaaagucaacucccugaaguuagcaauagggcugagaaauguuccugccaggagcaaccggggacucuuuggugcuaucgccggcuucauugaagggggauggccaggccuuguggcggguugguacggguuucagcauucgaaugaccaaggcguaggaauggcagccgaucgugacucuacccagaaggcuguggauaaaaucacuuccaaggucaacaauauaguggacaaaaugaacaagcaguaugagauuaucgaccacgaguucucagagguugagacgcgccugaauaugaucaacaauaaaauugaugaccaaauccaggauauuugggccuacaacgcagaauugcuagugcugcucgagaaucagaagacacuggacgaacacgaugcuaacgucaacaaucuuuacaacaaagugaagagagcccugggcaguaaugcgauggaggacgggaagggauguuuugaauuguaucauaaaugcgaugaccaguguauggagaccauaaggaacgguacuuacaaucggcgaaaguaucgcgaggaaagcagacucgagcaacagaggaucgaaggcguaaaacuggaguccgaagggaccuacaagauuuuaacaaucuauucuaccguugccagcucacuggugcuagcaaugggauucgcugccuuccucuuuugggcuaugaguaacggcuccugccggugcaauaucuguauuuga

SEQ ID NO: 132302 - RNA, 1683 nt, Artificial Sequence
  derived and/or modified sequence opt3 from hemagglutinin__InfluenzaA__AGQ81135
auggagguggccaccaucauuacaauacugcucgucaucacuggcagcaacgcugacaagauuugcaucggguaccaguccaccaauucuacggaaacaguugauacucuuaccgagaacaaugugcccguaacacacgcaaaagaacuguugcauaccgagcacaacggaauguuaugugccacuaaucuggguagaccucuaauucucgacacaugcaccaucgaaggccugauauaugggaacccaucaugugaucuuccgcuggagggaagggaguggaguuacaucguggaacggcccagcgcggucaauggcgugugcuauccugguaacguugagaauuuggaagaacuccgcucccuguucucuucggcuucaagcuaccaacguauucagaucuuuccagacaguauuuggaacguguccuauucugggacgagcaaggccuguuccgauucauucuaccgaaguaugagauggcugacucagaaaaauaacaauuaucccguccaggacgcacaauacaccaacaauaggggaaagaacauccucuuuauguggggcauaaaccauccuccaacagauaaugcccagacuaacuuauacacccggacagacaccacgacuagcguggcuacagaggauauuaaucgcaccuucaaaccccugaucggcccuagaccacuuguaaacggguugcagggaaggauugacuauuacugggcaguucugaagccgggucagacucuacgggugcgcucuaauggcaaccucaucgcccccugguaugggcacauccugcuuggagaaucccauggccgaauacugaagacagauuugaaaucagguaauugcgucgugcaaugucagaccgagagagggggacucaacacgacccugccuuuucacaaugugagcaaguacaguuucggcaacugcccaaaauauauuggcgucaagucuuuaaaacuggcuguugggcucaggaaugugcccgcccgguccagccguggacuuuuuggugcgaucgcaggcuucauugaagggggauggucgggccugguagccgguugguacggguuucagcacucuaacgaccagggcacaggaauggcugccgaucgcgacuccacucaaaaggcaaucgacaagauaaccucaaaagugaauaacauugucgauaagaugaauaaacaguaugagaucaucgaccaugaguucaacgagauugagacaagauugaacaugaucaauaacaagauugaugaccagauacaagauaucugggcuuacaaugccgaacuacuggugcuccuggagaaccagaaaacucuugacgaacacgaugcgaauguuaacaaucuguacaacaaggugaaaagggccuugggcaguaaugcagucgaggacgggaagggauguuuugaucucuaucauaagugcgacaaccaguguauggaaaccauucggaaugguacauacaaccgacgcaaauaucaggaggagagcagacuggaaaggcaaaagaucgagggcgugaaauuagaauccgaggggaccuacaagauccugacuauuuauucuacgguagcuagcagucuaguuauagccaugggauucgcugccuuucucuucugggcaaugucaaauggcuccugccggugcaacaucuguauuuga

SEQ ID NO: 132303 - RNA, 1683 nt, Artificial Sequence
  derived and/or modified sequence opt3 from hemagglutinin__InfluenzaA__AGQ81136
auggagaccaucagccugaugacaauucuccuuauaacuacggccuccaacgcugacaagaucugcauuggccaccagucuaccaauucaacagaaacuguggauacccugacagagaccaacguccccguuacucaugcaaaagaauuguuacaaacagagcacaaugggaugcugugugccaccaaccuaggacauccucucauccuggacacgugcacuauugaaggucuuaucuacggcaauccaaguugugaucuguugcucgaggggagagaguggagcuauauaguggaaaggccguccgcgguaaacggaaccugcuaccccggcaauguggagaaccuggaagaacugcggacacucuucucuucggcuucaagcuaucagcgcauccagauuuuuccugacacuaucuggaaugucaccuacacagguaccagucgauccuguucugggagcuucuaucguuccaugagaugguuaacgcagaagucaggauuuuacccagugcaagaugccaaauauacuaacaauaggggcaagaacauucuguucguuuggggcauccaccauccccacacauacaccgaccagacuacacuuuacauacggaaugauaccacgaccagugugacaacugaggaauugaaccgcauuuuuaaaccugucaucgugccaagacugcuaguaaaugggcagcagggaaggauugacuauuacuggagcguucucaagcccggucaaacccugcgggugcgcucuaacggcaaccuuaucgcaccuugguaugggcacguccuguccggaggcucacauggucgaaucuugaagacagaucucaaagggggaaauugcguggugcagugucagacugagaagggcggcuucaacagcacccugccauuucacaauauuaguaaauacgccuucgggacaugcccgaaguaugucaaaguuaacucuuuaaagcuggcuauaggacucagaaaugugcccgcaagguccaaccggggucuuuuuggcgccaucgcuggguucauugaaggaggcuggccuggucugguagccgggugguacggcuuucagcauagcaaugaccaaggagugggcauggcggcagaucgugacucgacccagaaggccgucgauaaaaucacuucuaaggugaacaauauaguugacaaaaugaaccgccaguaugagauuaucgaccacgaguucuccgagguggagacgagauugaauaugaucaacaauaagauugaugaccaaauccaggauauuuggacauacaacgcugaacuacugguccuccuggagaaucagaaaacccuugacgaacacgaugccaacgugaacaaucuguacaacaagguaaaaagggcauuggggucaaaugcuauggaggacggaaaggguuguuuugaacucuaucauaagugcgaugaccaguguauggagacuauacggaacggcaccuacaaucgacgcaaauauagagaggaaaguaggcuggagcaacagcggaucgaagggguuaaguuagagagcgaaggaacauacaaaauucugaccaucuauuccacuguggccucuagccuaguccucgcgaugggcuucgccgcauuccuguuuugggcuaugucaaacgguaguugccgcugcaauaucuguauuuga

SEQ ID NO: 132304 - RNA, 1683 nt, Artificial Sequence; identical to SEQ ID NO: 132299
  derived and/or modified sequence opt3 from hemagglutinin__InfluenzaA__AGQ81137

SEQ ID NO: 132305 - RNA, 1683 nt, Artificial Sequence
  derived and/or modified sequence opt3 from hemagglutinin__InfluenzaA__AGQ81138
auggaggccgcuaccaucauuacaauacugcucgcaaucacuggcagcaacgccgacaagauuugcaucggguaccaauccaccaauucuacggaaacaguggauacucuuaccgagaacaauguccccguuacacacgcgaaagaacuguugcauaccgagcacaacggaauguuaugugcuacuaaucuggguagaccucuaauucucgacacaugcaccaucgaaggccugauauaugggaacccaucaugugaucuuccgcuggagggaagggaguggaguuacaucguggaacggcccagcgccguaaauggcgugugcuauccuggucaugucgagaacuuggaagaacuccgcucccuguucucuucggcaucaagcuaccaacgagugcagauuuuuccagacaguaucuggaauguuuccuauucugggacgagcaaggccuguuccgauucauucuaccguaguaugagauggcugacucagaaaaacaauaacuaucccgugcaggacgcucaauacaccaauaacaagggcaaaaauauucucuuuauguggggaaucaaccacccuccaacagauacugcacagaccaacuuauacacaaggaccgacacgacuacaagcgucgccaccgaggauauaaaucggacuuucaagccccugauuggcccucgcccacuugugaacggguugcagggaagaaucgacuauuacugggcuguacugaagccgggucagacacuaaggguucggucuaauggcaaccucauugcccccugguaugggcauauccugcuuggagaaucccacggccgcauccugaaaaccgauuugaagucagguaauugcgugguccaaugucagacggagcgagggggacucaacaccacacugccuuuucacaaugugagcaaauacgcguucggcaacugcccaaaguauauuggcgugaaaaguuuaaagcuggcagucgggcucagaaauguucaugccaggucuucccggggacuuuuuggugcuauagccggcuucaucgaagggggauggagcggccugguggcagguugguacggguuucagcacucgaacgaccagggcacuggaauggcugccgaucgugacucuacccaaaaggcgauugacaaaaucacauccaagguaaauaacauaguggauaaaaugaauaagcaguaugagauuaucgaccaugaguucucagagaucgagacucgcuugaacaugauuaaugauaaaaucgacgaucagauucaagacauaugggccuacaacgcagaacuacugguccuccuggagaaccagaagacccuugaugaacacgacgcuaaugugaacaaucuguacaacaaaguuaagagagccuugggcaguaaugcuguggaggaugggaagggauguuuugaccucuaucacaaaugcgauaaccaguguauggaaacaaucaggaaugguaccuacaaccggcgaaaguaucaggaggagagccgccuggaaagacagaaaauugagggcgucaaguuagaauccgaggggacuuacaaaauccugacgaucuauucuacaguggccagcagucuaguaauugcaaugggauucgccgcuuuucucuucugggcgaugucaaauggcuccuguaggugcaacauaugcaucuga

SEQ ID NO: 132306 - RNA, 1683 nt, Artificial Sequence
  derived and/or modified sequence opt3 from hemagglutinin__InfluenzaA__AGQ81139
auggagguggccaccaucauuacaauacugcucgucaucacuggcgggaacgcugacaagauuugcaucggauaccagagcaccaauuccacggaaacaguugauacucuuaccgagaacaaugugcccguaacacacgcaaaagaacuguugcauaccgagcacaacgguauguuaugugccacuaaucugggcagaccucuaauucucgacacaugcaccaucgaagggcugauauauggaaacccaucuugugaucuuccgcuggagggcagggaguggucauacaucguggaacggaguagcgcggucaauggugugugcuaucccgggaacguugagaauuuggaagaacuccgcucccuguucucuucggcuucaagcuaccaacguauucagaucuuuccugacaguauuuggaacguguccuauucuggaacgagcaaggccuguuccgauucauucuaccgaaguaugagauggcugacucagaaaaauaacaauuauccaguccaggacgcacaauacaccaacaauaggggcaagaacauccucuuuauguggggcauaaaccaucccccuacagauaaugcccagacuaacuuauacacccggacagacaccacgacuagcguggcuacagaggauauuaaucgcaccuucaaaccacugaucgggcccagaccucuuguaaacggauugcaggguaggauugacuauuacugggcaguucugaagccaggccagacucuacgggugcgcucuaaugggaaccucaucgccccgugguauggacacauccugcuuggcgaaucccauggucgaauacugaagacagauuugaaaucagggaauugcgucgugcaaugucagaccgagagaggaggccucaacacgacccugcccuuucacaaugugagcaaguacaguuucggcaacugcccuaaauauauuggggucaagucuuuaaaacuggcuguuggacucaggaaugugccagcccgguccagccguggucuuuuuggcgcgaucgcaggguucauugaaggaggcuggucgggucugguagccgggugguacggcuuucagcacucuaacgaccagggaacaggcauggcugccgaucgcgacuccacucaaaaggcaaucgacaagauaaccucaaaagugaauaacauugucgauaagaugaauaaacaguaugagaucaucgaccaugaguucagugagauugagacaagauugaacaugaucaacaauaagauugaugaccagauacaagauaucugggcuuacaacgccgaacuacuggugcuccuggagaaucagaaaacucuugacgaacacgaugcgaacguuaauaaccuguacaauaaggugaaaagggccuuggggagcaacgcagucgaggacggaaaggguuguuuugaucucuaucauaagugcgacaaucaguguauggaaaccauucggaacggcacauacaaucgacgcaaauaucaggaggaguccagacuggaaaggcaaaagaucgagggggugaaauuagaaucugagggaaccuacaagauccugacuauuuauagcacgguagcuucaagucuaguuauagccaugggcuucgcugccuuucucuucugggcaauguccaacgguagcugccggugcaauaucuguauuuga

SEQ ID NO: 132307 - RNA, 1683 nt, Artificial Sequence
  derived and/or modified sequence opt3 from hemagglutinin__InfluenzaA__AGQ81141
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccgagcacaacggaauguuaugugcgacugaccuggguagaccucuaauucucgauacaugcaccaucgaaggccugauauaugggaauccaucaugugaccuuccgcuggagggaagggaguggaguuacaucguagaacggcccagcgcugugaacggcgucugcuauccugguaauguggagaacuuggaggaacuccgcucccuguucucuucggccucaagcuaccaacguauucagaucuuuccagauaguauuuggaauguuuccuauucugggacgagcaaggcauguuccgacucauucuaccgaaguaugagauggcugacucagaaaaacaauaacuaucccgugcaggaugcccaauacaccaauaacaggggaaagaauauccucuuuauguggggcauaaaccauccuccaacagacacugcucagaccaacuuauacacacggaccgauacgacuacaagcgucgcaaccgaggacauuaaucgcacuuucaaaccccugaucggcccuagaccacuugugaacggguugcagggaaggauugauuauuacugggccguacugaagccgggucagacacuacggguucgcucuaauggcaaccucaucgcucccugguaugggcacauccugcuuggagaaucccauggccgaauacugaagaccgacuugaaaucagguaauugcgugguccaaugucagacggagagagggggacucaacaccacacugccuuuucacaaugugagcaaguacgccuucggcaacugcccaaaauauauuggcgugaagaguuuaaaacuggcggucgggcucaggaauguucccgcacggucucgucgcggacuuuuuggugccaucgcuggcuucauugaagggggauggacuggccugguggccgguugguacggguuucagcacuccaacgaucagggcaccggaauggcagcugacagagacagcacacaaaaggccaucgauaagauaacuucgaaaguaaauaacauuguggacaagaugaauaaacaguaugauaucaucgaccaugaguucucugaaauugagaccagguugaacaugaucaaugauaagauugacgaucagauacaagacaucugggcguacaacgccgagcuacugguccuccuggaaaaccagaaaacacuugaugagcacgacgcaaaugugaacaaucuguacaacaagguuaaaggcgcuuugggguccaaugccguggaagauggaaaggguuguuuugaccucuaucauaagugcgacaaccaguguauggagaccauucggaauggcacuuacaaccgacgcaaauaucaggaagagucaagacuggagaggcaaaagaucgaaggggucaaauuagagagugaaggaacguacaagauccugacaauuuauagcaccguggcuuccucucuaguaauagccaugggcuucgcagccuuucucuucugggcuaugagcaaugguucaugccggugcaacaucuguauuuga

SEQ ID NO: 132308 - RNA, 1683 nt, Artificial Sequence
  derived and/or modified sequence opt3 from hemagglutinin__InfluenzaA__AGQ81143
auggagguggccaccaucauuacaauacugcucgucaucacuggcagcaacgcugacaagauuugcaucggguaccaguccaccaauucuacggaaacaguugauacucuuaccgagaacaaugugcccguaacacacgcaaaagaacuguugcauaccgagcacaacggaauguuaugugccacuaaucuggguagaccucuaauucucgacacaugcaccaucgaaggccugauauaugggaacccaucaugugaucuuccgcuggagggaagggaguggaguuacaucguggaacggcccagcgcggucaauggcgugugcuauccugguaacguugagaauuuggaagaacuccgcucccuguucucuucggcuucaagcuaccaacguauucagaucuuuccagacaguauuuggaacguguccuauucugggacgagcaaggccuguuccgauucauucuaccgaaguaugagauggcugacucagaaaaauaacaauuaucccguccaggacgcacaauacaccaacaauaggggaaagaacauccucuuuauguggggcauaaaccauccuccaacagauaaugcccagacuaacuuauacacccggacagacaccacgacuagcguggcuacagaggauauuaaucgcaccuucaaaccccugaucggcccuagaccacuuguaaacggguugcagggaaggauugacuauuacugggcaguucugaagccgggucagacucuacgggugcgcucuaauggcaaccucaucgcccccugguaugggcacauccugcuuggagaaucccauggccgaauacugaagacagauuugaaaucagguaauugcgucgugcaaugucagaccgagagagggggacucaacacgacccugccuuuucacaaugugagcaaguacaguuucggcaacugcccaaaauauauuggcgucaagucuuuaaaacuggcuguugggcucaggaaugugcccgcccgguccagccguggacuuuuuggugcgaucgcaggcuucauugaagggggauggucgggccugguagccgguugguacggguuucagcacucuaacgaccagggcacaggaauggcugccgaucgcgacuccacucaaaaggcaaucgacaagauaaccucaaaagugaauaacauugucgauaagaugaauaaacaguaugagaucaucgaccaugaguucagugagauugagacaagauugaacaugaucaacaauaagauugaugaccagauacaagauaucugggcuuacaacgccgaacuacuggugcuccuggagaaucagaaaacucuugacgaacacgaugcgaacguuaauaaccuguacaauaaggugaaaagggccuugggcagcaacgcagucgaggacgggaagggauguuuugaucucuaucauaagugcgacaaucaguguauggaaaccauucggaacgguacauacaaucgacgcaaauaucaggaggaguccagacuggaaaggcaaaagaucgagggcgugaaauuagaaucugaggggaccuacaagauccugacuauuuauagcacgguagcuucaagucuaguuauagccaugggauucgcugccuuucucuucugggcaauguccaacggcagcugccggugcaauaucuguauuuga

SEQ ID NO: 132309 - RNA, 1683 nt, Artificial Sequence
  derived and/or modified sequence opt3 from hemagglutinin__InfluenzaA__AGQ81144
auggaggccgcuaccaucauuacaauacugcucguggucacuggcagcaacgcagacaagaucugcauuggguaccaguccaccaauucuacggaaacaguugauacucuuaccgagaacaaugugcccguaacacacgccaaagaacuguugcauaccgagcacaacggaauguuaugugcgacuaaucuggguagaccucuaauccucgacacaugcaccauugaaggccugaucuaugggaacccaucaugugaucuuccgcuggagggaagggaguggaguuacauaguggaacggcccagcgcugucaauggcgugugcuauccugguaacguugagaauuuggaagaacuccgcucccuguucucuucggccucaagcuaccaacgaauccagauuuuuccagacaguaucuggaacguguccuaugggggaacgucuaaggcauguagcgauuccuucuaccguucaaugagauggcugacucagaaaaauaacaauuaucccguccaggacgcccaauacaccaacaauaggggcaagaacauucucuuuauguggggcaucaaccauccuccaacagauacugcucagaccaauuuauacacacggaccgacacgacuacaaguguggcaaccgaggauauaaaccgcacuuucaaaccccugauugggccuagaccacuuguaaauggauugcaggguaggaucgacuauuacugggccguucugaagccgggccagacacuacgggugcgcagcaacgggaaucucauugcucccugguauggacacauccugcuuggcgaaucucauggucgaauccugaagaccgauuugaaauccgggaacugcgucgugcaaugucagacggagagaggaggccucaauaccacacugccuuuucacaacgugucaaaguacgccuucggcaauugcccaaaauauauuggggucaagagcuuaaaacuggcgguuggacucaggaacaugcccgcacggaguucucguggucuuuuuggcgccauagcuggguucaucgaaggaggcugguccggucugguggccgggugguacggcuuucagcacagcaaugaccagggaacuggcauggcagcugaucgcgacucgacccaaaaggccauugacaagaucacaucuaaaguaaacaauauaguggauaagaugaacaaacaguaugagauuaucgaccaugaguucuccgagaucgagacuagauugaauaugauuaacgauaagaucgacgaucagauucaagacauaugggcguacaacgccgaacuacugguccuccuggagaaucagaaaacccuugaugaacacgacgcaaacgugaauaaccuguacaauaagguuaaaagggcuuuggggucaaacgccguggaggauggaaaggguuguuuugaccucuaucauaagugcgauaaucaguguauggaaacaauccggaacggcaccuacaaucgacgcaaauaucaggaggagaguagacuggaaaggcaaaagauugagggggucaaauuagaaagcgagggaacuuacaagauccugacgaucuauuccacaguggcuucuagccuaguaauugccaugggcuucgcagccuuucucuucugggcuaugucaaacgguaguugccggugcaauauauguaucuga

SEQ ID NO: 132310 - RNA, 1683 nt, Artificial Sequence
  derived and/or modified sequence opt3 from hemagglutinin__InfluenzaA__AGQ81146
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaaaggaguggaguuacaucguagaaaggcccagcgcugugaauggcaugugcuauccugguaacgucgagaauuuggaggagcuccggucccuguucucuucggccucaagcuaccaacgcauucagaucuuuccagacaguauuuggaacguguccuauucugggacgagcaaagcauguuccgauucauucuaccgaaguaugcguuggcugacucagaagaauaacaauuaucccguucaggacgcccaauacaccaacaauagaggcaaaaacauccucuuuauguggggaauaaaccauccuccaacagauacugcucagaccaauuuauacacaaggaccgacacgaagacuagcguggcaacagaggaaauuaaccggaccuucaagccccugaucggcccucgcccacuugucaauggguugcagggaagaauugauuauuacugggccgugcugaaaccgggucagacucuaaggguacggucuaacggcaaucucaucgcucccugguaugggcacauccugcuuggagagucccauggccgcauucugaagacagacuugaaaucagguaacugcguugugcaaugucagaccgaacgagggggacucaauacgacccugccuuuucacaacgucagcaaguacgccuucggcaauugcccaaaauauauaggcgugaagaguuuaaagcuggcgguggggcucagaaacguccccgcaaggucuucccggggacuuuuuggugccaucgcuggcuucauugaagggggauggagcggccugguugccgguugguacggguuucagcacucgaaugaucagggcacaggaauggcagcugaccgugauucuacucaaaaagccaucgacaagauaaccuccaaagugaacaauauuguagacaagaugaacaaacaguaugaaaucaucgaucaugaguucucagagauugaaacacgcuugaauaugaucaacgacaagauugaugaccagauacaagauaucugggcguacaacgccgagcuacuggugcuccuggaaaaucagaaaacucuugacgagcacgauaguaacgucaauaaccuguacaauaaggugaagagagcauugggcagcaacgcuguugaagacgggaaaggauguuuugaucucuaucauaagugcgacaaucaguguauggagaccauuaggaacgguacauacaaucggcgaaaauaucaggaggaaucccgccuggagagacaaaagaucgaaggcgugaaauuagagucugaagggaccuacaagauccugacuauuuauagcacggucgccucaagucuagugauagcuaugggauucgccgcauuucucuucugggccauguccaacggcagcuguaggugcaauaucugcauuuga

SEQ ID NO: 132311 - RNA, 1683 nt, Artificial Sequence
  derived and/or modified sequence opt3 from hemagglutinin__InfluenzaA__AGQ81147
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaaaggaguggaguuacaucguagaaaggcccagcgcugugaauggcaugugcuauccugguaacgucgagaauuuggaggagcuccggucccuguucucuucggccucaagcuaccaacgcauucagaucuuuccagacaguauuuggaacguguccuauucugggacgagcaaagcauguuccgauucauucuaccgaaguaugcguuggcugacucagaagaauaacaauuaucccguucaggacgcccaauacaccaacaauagaggcaaaaacauccucuuuauguggggaauaaaccauccuccaacagauacugugcagaccaauuuauacacaaggaccgacacgaagacuagcgucgcuacagaggaaauuaaccggaccuucaagccccugaucggcccucgcccacuugugaauggguugcagggaagaauugauuauuacugggcaguacugaaaccgggucagacucuaaggguucggucuaacggcaaucucaucgcccccugguaugggcacauccugcuuggagagucccauggccgcauucugaagacagacuugaaaucagguaacugcgugguccaaugucagaccgaacgagggggacucaauacgacccugccuuuucacaacgugagcaaguacgcuuucggcaauugcccaaaauauauaggcgugaagaguuuaaagcuggccgucgggcucagaaacguucccgcgaggucuucccggggacuuuuuggugcaaucgccggcuucauugaagggggauggagcggccugguggcugguugguacggguuucagcacucgaaugaucagggcacaggaauggccgcagaccgugauucuacucaaaaagcuaucgacaagauaaccuccaaaguaaacaauauuguggacaagaugaacaaacaguaugaaaucaucgaucaugaguucucagagauugaaacacgcuugaauaugaucaacgacaagauugaugaccagauacaagauaucugggccuacaacgcggagcuacugguccuccuggaaaaucagaaaacucuugacgagcacgaugccaacgugaauaaccuguacaauaagguuaagagagcauugggcaguaacgcuguggaagacgggaaaggauguuuugaucucuaucauaagugcgacaaucaguguauggagaccauuaggaacgguacauacaaucggcgaaaauaucaggaggaaagccgccuggagagacaaaagaucgaaggcgucaaauuagaguccgaagggaccuacaagauccugacuauuuauucuacgguggccagcagucuaguaauagcuaugggauucgccgcauuucucuucugggccaugucaaacggcuccuguaggugcaauaucugcauuuga

SEQ ID NO: 132312 - RNA, 1683 nt, Artificial Sequence
  derived and/or modified sequence opt3 from hemagglutinin__InfluenzaA__AGQ81148
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaaaggaguggaguuacaucguagaaaggcccagcgcugugaauggcaugugcuauccugguaacgucgagaauuuggaggagcuccggucccuguucucuucggccucaagcuaccaacgcauucagaucuuuccagacaguauuuggaacguguccuauucugggacgagcaaagcauguuccgauucauucuaccgaaguaugcguuggcugacucagaagaauaacaauuaucccguucaggacgcccaauacaccaacaauagaggcaaaaacauccucuuuauguggggaauaaaccauccuccaacagauacugcucagaccaauuuauacacaaggaccgacacgaagacuagcguggcaacagaggaaauuaaccggaccuucaagccccugaucggcccucgcccacuugucaauggguugcagggaagaauugauuauuacugggccgugcugaaaccgggucagacucuaaggguacggucuaacggcaaucucaucgcucccugguaugggcacauccugcuuggagagucccauggccgcauucugaagacagacuugaaaucagguaacugcguugugcaaugucagaccgaacgagggggacucaauacgacccugccuuuucacaacgucagcaaguacgccuucggcaauugcccaaaauauauaggcgugaagaguuuaaagcuggcgguggggcucagaaacguccccgcaaggucuucccggggacuuuuuggugccaucgcuggcuucauugaagggggauggagcggccugguugccgguugguacggguuucagcacucgaaugaucagggcacaggaauggcagcugaccgugauucuacucaaaaagccaucgacaagauaaccuccaaagugaacaauauuguagacaagaugaacaaacaguaugaaaucaucgaucaugaguucucagagauugaaacacgcuugaauaugaucaacgacaagauugaugaccagauacaagauaucugggcguacaacgccgagcuacuggugcuccuggaaaaucagaaaacucuugacgagcacgaugcaaacgucaauaaccuguacaauaaggugaagagagcuuugggcaguaacgccguugaagacgggaaaggauguuuugaucucuaucauaagugcgacaaucaguguauggagaccauuaggaacgguacauacaaucggcgaaaauaucaggaggaaagccgccuggagagacaaaagaucgaaggcgugaaauuagaguccgaagggaccuacaagauccugacuauuuauucuacggucgcuagcagucuagugauagccaugggauucgcagccuuucucuucugggcuaugucaaacggcuccuguaggugcaauaucugcauuuga

SEQ ID NO: 132313 - RNA, 1683 nt, Artificial Sequence
  derived and/or modified sequence opt3 from hemagglutinin__InfluenzaA__AGQ81149
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccggacacaacgguauguuaugugcgacuaaucugggcagaccucuaauucucgacacaugcaccaucgaggggcugauauauggaaacccaucaugugaucuuccgcuggaaggcagggaguggaguuacaucguagagcggcccagcgcuauuaauggugugugcuauccugggaacgucgaaaauuuggaggaacuccgcucccuguucucuucggccucaagcuaccaacgaauccagauuuuuccagacaguaucuggaacguguccuauucuggaacgagcaaggcauguuccgauucauucuaccguaguaugagauggcugacucagaaaaauaacaauuaucccguucaggacgcccaauacaccaacaauaggggcaagaacauacucuuuauguggggcauuaaccauccuccaacagauacugcucagaccaauuuauacacacggaccgacacgacuacaagcguggcaaccgaggauaucaaccgcacuuucaaaccccugauugggccuagaccacuugucaauggauugcaggguaggaucgacuauuacugggccgugcugaagccgggccagacacuacggguacgcucuaacgggaaucucaucgcucccugguauggacacauucugcuuggcgagucccauggucgaauacugaagaccgauuugaaaucagggaacugcguugugcaaugucagacggaaagaggaggccucaauaccacacugccuuuucacaacgucagcaaguacgccuucggcaauugcccaaaauauaucggggugaagaguuuaaaacuggcggugggacucaggaacguccccgcacggucuucccguggucuuuuuggcgccauugcuggguucaucgagggaggcuggagcggucugguugccgggugguacggcuuucagcacucgaaugaccagggaacuggcauggcagcugaucgcgacucuacccaaaaggccauagacaagauuacauccaaagugaacaauaucguagauaagaugaacaaacaguaugaaaucauugaccaugaguucucagaaaucgagacuagauugaauaugauuaacgauaagauagacgaucagauccaagacauuugggcguacaacgccgagcuacuggugcuccuggaaaaucagaaaacccuugaugagcacgacgcaaacgucaauaaccuguacaauaaggugaaaagggcuuuggggaguaacgccguugaagauggaaaggguuguuuugaccucuaucauaagugcgauaaucaguguauggagacaauccggaacggcaccuacaaucgacgcaaauaucaggaagagagcagacuggagaggcaaaagaucgaaggggugaaauuagaguccgaaggaacuuacaagauucugacgauauauucuacagucgcuagcagucuagugaucgccaugggcuucgcagccuuucucuucugggcuaugucaaacgguuccugccggugcaauauuuguaucuga

SEQ ID NO: 132314 - RNA, 1683 nt, Artificial Sequence
  derived and/or modified sequence opt3 from hemagglutinin__InfluenzaA__AGQ81150
auggaggccgcuaccaucauuacaauacugcucgugaucacuggcagcaacgcagacaagauuugcaucggguaccaauccaccaauucuacggaaacagucgauacucuuaccgagaacaauguucccgugacacacgccaaagaacuguugcauaccgagcacaacggaauguuaugugcgacugaccuggguagaccucuaauucucgauacaugcaccaucgaaggccugauauaugggaauccaucaugugaccuuccgcuggagggaagggaguggaguuacaucguagaacggcccagcgcugugaacggcgucugcuauccugguaauguggagaacuuggaggaacuccgcucccuguucucuucggccucaagcuaccaacguauucagaucuuuccagauaguauuuggaauguuuccuauucugggacgagcaaggcauguuccgacucauucuaccgaaguaugagauggcugacucagaaaaacaauaacuaucccgugcaggaugcccaauacaccaaugacaggggaaacaauauccucuuuauguggggcauaaaccauccuccaacagauacuguccagaccaacuuauacacacggaccgacacgacuacaagcguggcuaccgaggauauuaaucgcacuuucaagccccugaucggcccuagaccacuuguaaacggguugcagggaaggauugacuauuacugggcaguucugaaaccgggucagacacuacgggugcgcucuaauggcaaccucaucgcccccugguaugggcacauccugcuuggagaaucccauggccgaauacugaagaccgauuugaagucagguaauugcgucgugcaaugucagacggagagagggggacucaacaccacacugccuuuucacaaugugagcaaauacgcuuucggcaacugcccaaaguauauuggcgucaaaaguuuaaagcuggccguugggcucaggaaugugcccgcgcggucuucccguggacuuuuuggugcaaucgccggcuucauugaagggggauggagcggccugguagcugguugguacggguuucagcacucgaacgaccagggcacuggaauggccgcagaccgcgauucuacccaaaaagcuaucgacaagauaacauccaaggugaauaacauugucgauaaaaugaauaagcaguaugacaucaucgaucaugaguucucagaaauugagacuagauugaacaugaucaaugacaaaauugaugaccagauacaagauaucugggccuacaacgcggagcuacuggugcuccuggaaaaccagaagacccuugacgagcacgaugccaauguuaacaaucuguacaacaaagugaagagggcauugggcaguaaugcugucgaagacgggaaaggauguuuugaccucuaucauaagugcgauaaccaguguauggagacaauucggaaugguaccuacaaccgacgcaaguaucaggaagagagcagacuggagaggcagaaaaucgaaggcgugaaguuagaguccgaagggacuuacaaaauccugacgauuuauucuacaguagccagcagucuaguuauagcuaugggauucgccgcauuucucuucugggccaugucaaauggcuccugccggugcaacaucuguauuuga

SEQ ID NO: 132315 - RNA, 1683 nt, Artificial Sequence
  derived and/or modified sequence opt3 from hemagglutinin__InfluenzaA__AGQ81152
auggaggccgcuaccaucauuacaauacugcucgugaucacuggcagcaacgcagacaagauuugcaucggguaccaauccaccaauucuacggaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaagggacuggaguuacaucguagagcggcccagcgcugugaauggcgucugcuauccugguaacguggaaaauuuggaggaacuccgcucccuguucucuucggccucaagcuaccaaaagauucagaucuuuccagauaguauuuggaacguuuccuauucugggacgagcaaagcauguuccgacucauucuaccgaaguaugcguuggcugacucagaagaauaacaauuaucccgugcaggaugcccaauacaccaacaauagagggaaaaacauccucuuuauguggggcauaaaccauccuccaacagacacuguccagaccaauuuauacacaaggaccgauacgacuacaagcguggcuaccgaggacauuaaccggacuuucaagccccugaucggcccucgcccacuuguaaauggguugcagggaagaauugauuauuacugggcaguucugaagccgggucagacacuaagggugcggucuaacggcaaucucaucgcccccugguaugggcacauccugcuuggagagucccauggccgcauucugaaaaccgacuugaagucagguaacugcgucgugcaaugucagacggaacgagggggacucaauaccacacugccuuuucacaacgugagcaaauacgcuuucggcaauugcccaaaguauauaggcgucaaaaguuuaaagcuggccguugggcucagaaacgugcccgcgaggucuucccggggacuuuuuggugcaaucgccggcuucauugagggaggauggagcggccugguagcugguugguacggguuucagcacucgaaugaucagggcacuggaauggccgcagaccgugacucuacccaaaaggcuaucgauaaaauaacauccaaggugaacaauauugucgacaaaaugaacaagcaguaugaaaucaucgaucaugaguucucagaaauugagacucgcuugaauaugaucaacgacaaaauugaugaccagauacaagauaucugggccuacaacgcggagcuacuggugcuccuggaaaaucagaagacccuugacgagcacgaugccaacguuaauaaccuguacaauaaagugaagagagcauugggcaguaacgcugucgaagacgggaagggauguuuugaucucuaucauaaaugcgacaaucaguguauggagacaauuaggaacgguaccuacaaucggcgaaaguaucaggaagagagccgccuggagagacagaaaaucgaaggcgugaaguuagaguccgaagggacuuacaaaauccugacgauuuauucuacaguagccagcagucuaguuauagcuaugggauucgccgcauuucucuucugggccaugucaaacggcuccuguaggugcaauaucugcauuuga

SEQ ID NO: 132316 - RNA, 1683 nt, Artificial Sequence
  derived and/or modified sequence opt3 from hemagglutinin__InfluenzaA__AGQ81153
auggaggccgcuaccaucauuacaauacugcucgugaucacuggcagcaacgcagacaagauuugcaucggguaccaguccacgaauagcaccgaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaagggacuggaguuacaucguagagcggcccagcgcugugaauggcgucugcuauccugguaacguggaaaauuuggaggaacuccgcucccuguucucuucggccucaagcuaccaaaagauucagaucuuuccagauaguauuuggaacguuuccuaugggggaaucucuaaagcauguagcaauuccuucuaccgaucaaugcguuggcugacgcagaagaacaauaacuaucccgugcaggacgcccaauacacuaauaacagaggcaaaaacauacucuuuauguggggcauuaaucauccuccaaccaacacaacucagaccgauuuauacacaaggaccgacacgacuacaagugucgcuaccgaggauauccaccggacuuucaagccccugauugggccucgcccacuugugaauggauugcaggguagaaucgacuauuacugggcaguacugaagccgggccagacacuaaggguucggagcaacgggaaucucaucgcccccugguauggacauauucugcuuggcaaaucucacggucgcauacugaagaccgauuugaaauccgggaacugcgugguccaaugucagacggagcgaggaggccucaauaccacacugccuuuucacaacgugucaaaguacgcuuucggcaauugcccaaaauauaucggggugaagucuuuaaagcuggccgucggacucagaaacguucccgcgaggaguucucggggucuuuuuggcgcaauugccggguucaucgaaggaggcugguccggucugguggcugggugguacggcuuucagcauagcaaugaccagggaacuggcauggccgcagaucgugacucgacccaaaaagcuauagacaagauuacaucuaaaguaaacaauaucguggauaagaugaacaaacaguaugagaucauugaccacgaguucuccgaaaucgaaacucgcuugaauaugauuaacgauaagauagacgaucagauccaagacauuugggccuacaacgcggagcuacugguccuccuggagaaucagaaaacccuugaugaacaugacgccaacgugaauaaccuguacaauaagguuaagagagcauuggggucaaacgcuguggaggauggaaaagguuguuuugaccucuaucacaagugcgauaaucaguguauggaaacaaucaggaacggcaccuacaaucggcgaaaauaucaggaggaaagucgccuggagagacaaaagaucgagggggucaaauuagaaagcgagggaacuuacaagauucugacgauauauuccacaguggccucuagccuaguaaucgcuaugggcuucgccgcauuucucuucugggccaugucaaacgguaguuguaggugcaauauuugcaucuga

SEQ ID NO: 132317 - RNA, 1683 nt, Artificial Sequence
  derived and/or modified sequence opt3 from hemagglutinin__InfluenzaA__AGQ81155
auggaggccgcuaccaucauuacaauacugcucgugaucacuggcagcaacgcagacaagauuugcaucggguaccaguccacgaauagcaccgaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaagggacuggaguuacaucguagagcggcccagcgcugugaauggcgucugcuauccugguaacguggaaaauuuggaggaacuccgcucccuguucucuucggccucaagcuaccaaaagauucagaucuuuccagauaguauuuggaacguuuccuauaaugggacgucuaaagcauguagcgacuccuucuaccgaucaaugcguuggcugacucagaagaacaauaacuaucccgugcaggaugcccaauacaccaauaacagagggaaaaacauccucuuuauguggggcauaaaucauccuccaacagacacuacccagacaaacuuauacaccaggacggauacuacaaccagugucgcuacugaggacauuaaucggacauucaagccccugaucggcccucgcccacuugugaacggguugcagggaagaauugauuauuacugggcaguacugaagccgggucagacccuaaggguucggagcaauggcaaccucaucgcccccugguaugggcacauccugcuuggagagucucauggccgcauucugaaaacggacuugaaguccgguaauugcgugguccaaugucagaccgaacgagggggacucaacacaacucugccuuuucacaaugugucaaaauacgcuuucggcgauugcccaaaguauauaggcgugaaaucuuuaaagcuggccgucgggcucagaaacguucccgcgaggaguucucggggacuuuuuggugcaaucgccggcuucauugagggaggaugguccggccugguggcugguugguacggguuucagcacagcaaugaccagggcaccggaauggccgcagaccgugauucgacacaaaaggcuaucgacaaaauaacuucuaagguaaacaauauuguggauaaaaugaacaagcaguaugaaaucaucgaccaugaguucuccgaaauugagacccgcuugaauaugaucaacgauaaaauugacgaucagauacaagacaucugggccuacaacgcggagcuacugguccuccuggaaaaucagaagacacuugaugagcacgacgccaacgugaauaaccuguacaauaaaguuaagagagcauugggcucaaacgcuguggaagaugggaagggauguuuugaccucuaucauaaaugcgacaaucaguguauggagaccauuaggaacgguacuuacaaucggcgaaaguaucaggaagagagucgccuggagagacaagaaaucgagggcgucaaauuagaaagcgaggggacguacaagauccugacaauuuauuccaccguggccucuagccuaguaauagcuaugggauucgccgcauuucucuucugggccaugucaaacggcaguuguaggugcaauaucugcauuuga

SEQ ID NO: 132318 - RNA, 1683 nt, Artificial Sequence
  derived and/or modified sequence opt3 from hemagglutinin__InfluenzaA__AGQ81156
auggaggccgcuaccaucauuacaauacugcucgugaucacuggcagcaacgcagacaagauuugcaucggguaccaauccacgaauagcaccgaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaagggacuggaguuacaucguagagcggcccagcgcugugaauggcgucugcuauccugguaacguggaaaauuuggaggaacuccgcucccuguucucuucggccucaagcuaccaaaagauucagaucuuuccagauaguauuuggaacguuuccuaugggggaaucucuaaagcauguagcaauuccuucuaccgaucaaugcguuggcugacgcagaagaacaauaacuaucccgugcaggacgcccaauacacuaauaacagaggcaaaaacauacucuuuauguggggcauuaaucauccuccaaccaacacaacucagaccgauuuauacacaaggaccgacacgacuacaagugucgcuaccgaggauauccaccggacuuucaagccccugauugggccucgcccacuugugaauggauugcaggguagaaucgacuauuacugggcaguacugaagccgggccagacacuaaggguucggagcaacgggaaucucaucgcccccugguauggacauauucugcuuggcgagucucacggucgcauacugaaaaccgauuugaaguccgggaacugcgugguccaaugucagacggaacgaggaggccucaauaccacacugccuuuucacaacgugucaaaauacgcuuucggcaauugcccaaaguauaucggggugaaaucuuuaaagcuggccgucggacucagaaacguucccgcgaggaguucucggggucuuuuuggcgcaauugccggguucaucgagggaggcugguccggucugguggcugggugguacggcuuucagcauagcaaugaccagggaacuggcauggccgcagaucgugacucgacccaaaaggcuauagacaaaauuacaucuaagguaaacaauaucguggauaaaaugaacaagcaguaugaaaucauugaccacgaguucuccgaaaucgagacucgcuugaauaugauuaacgauaaaauagacgaucagauccaagacauuugggccuacaacgcggagcuacugguccuccuggaaaaucagaagacccuugaugagcaugacgccaacgugaauaaccuguacaauaaaguuaagagagcauuggggucaaacgcuguggaagauggaaaggguuguuuugaccucuaucacaaaugcgauaaucaguguauggagacaaucaggaacggcaccuacaaucggcgaaaguaucaggaagagagucgccuggagagacagaaaaucgaaggggucaaguuagagagcgaaggaacuuacaaaauucugacgauauauuccacaguggccucuagccuaguaaucgcuaugggcuucgccgcauuucucuucugggccaugucaaacgguaguuguaggugcaauauuugcaucuga

SEQ ID NO: 132319 - RNA, 1683 nt, Artificial Sequence
  derived and/or modified sequence opt3 from hemagglutinin__InfluenzaA__AGQ81157
auggaggccgcuaccaucauuacaauacugcucgugaucacuggcaacaaugcagacaagauuugcaucggguaccaaagcacgaacuccaccgaaacagucgauacucuuaccgagaauaacguucccgugacacacgccaaagaacuguugcauaccgagcacaauggaauguuaugugcgacuaaccuggguagaccucuaauucucgacacaugcaccaucgaaggccugauauaugggaauccaucuugugaucuuccgcuggagggaagggacuggucauacaucguagagcggcccagugcugugaacggcgucugcuauccugguaauguggaaaacuuggaggaacuccgcagccuguucuccucugccucgucauaccaaaagauucagaucuuuccagauagcauuuggaauguuaguuauaacgggacguccaaagcauguucugacagcuucuaccgauccaugcguuggcugacucagaagaauaacaauuaucccgugcaggaugcccaauacaccaacaacagagggaaaaauauccucuuuauguggggcauaaaccauccuccaacagacacuacccagacaaauuuauacaccaggacggauacuacaaccucagucgcuacugaggacauuaaccggacauucaagccccugaucggcccucgcccacuugugaauggguugcagggaagaauugauuauuacugggcaguacugaagccgggucagacccuaaggguucggaguaacggcaaucucaucgcccccugguaugggcacauccugcuuggagagagccauggccgcauucugaaaacggacuugaagucugguaacugcgugguccaaugucagaccgaacgagggggacucaauacaacucugccuuuucacaacguguccaaauacgcuuucggcgauugcccaaaguauauaggcgugaaaucauuaaagcuggccgucgggcucagaaauguucccgcgaggagcagucggggacuuuuuggugcaaucgccggcuucauugagggaggauggucuggccugguggcugguugguacggguuucagcacuccaacgaccagggcaccggaauggccgcagaccgugauagcacacaaaaggcuaucgacaaaauaacuucgaagguaaauaacauuguggauaaaaugaauaagcaguaugaaaucaucgaccaugaguucucugaaauugagacccgcuugaacaugaucaacgauaaaauugacgaucagauacaagacaucugggccuacaaugcggagcuacugguccuccuggaaaaccagaagacacuugaugagcacgacgccaaugugaacaaucuguacaacaaaguuaagagagcauugggcuccaaugcuguggaagaugggaagggauguuuugaccucuaucauaaaugcgacaaccaguguauggagaccauuaggaaugguacuuacaaccggcgaaaguaucaggaagagucacgccuggagagacagaaaaucgaaggcgucaaguuagagagugaagggacguacaaaauccugacaauuuauagcaccguggccuccucucuaguaauagcuaugggauucgccgcauuucucuucugggccaugagcaauggcucauguaggugcaacaucugcauuuga

SEQ ID NO: 132320 - RNA, 1683 nt, Artificial Sequence
  derived and/or modified sequence opt3 from hemagglutinin__InfluenzaA__AGQ81158
auggagguggucaccaucauuacaauacugcucguuaucacuagaagcaacgccgacaagauuugcaucggcuaccaauccaccaauucuacggaaacaguggauacucuuaccgagaacaauguacccgugacacacgcuaaagaacuguugcauaccgagcacaacgggauguuaugugcaacuaaucugggaaggccucuaauucucgacacaugcaccaucgaaggucugauauauggcaacccaucaugugaucuuccgcuggaggggcgggaguggaguuacaucgucgaacgccccagcgccgugaauggaguuugcuauccuggcaacguggagaauuuggaagaacuccgaucccuguucucuucggcgucaagcuaccaacguauucagaucuuuccagacaguauuuggaacgucuccuauucugguacgagcaaggcuuguuccgauucauucuacagaaguaugagguggcugacucagaaaaauaacaauuaucccgugcaggacgcccaauacaccaacaaucgggggaagaacauccucuuuauguggggaauaaaccauccuccaacagauacugcacagaccaauuuauacacacgcaccgacacgacuacaagcguagccaccgaggauauuaacagaacuuucaaaccccugaucggcccuaggccacuuguuaauggcuugcaggggcggauugacuauuacugggcugugcugaagccgggacagacacuacgcguccgaucuaacgguaaucucaucgcacccugguauggccacauccugcuuggggaaucccauggaaggauucugaagaccgauuugaaaucaggcagcugcguggugcaaugucagacggagagaggugggcucaacaccacacugccuuuucacaaugucaguaaguacgccuucggaaacugcccaaaauauauaggcguuaagucuuuaaaacuggcugugggccuccggaauguacccgcccguuccagccgcgggcuuuuuggagcgaucgcagguuucauugaaggcggguggucgggacugguggccggcugguacgguuuucagcacucuaacgaccaggggacuggcauggcugccgauagagacuccacccaaaaggcaaucgacaagauaacaucaaaagucaauaacauuguggauaagaugaauaaacaguaugagaucaucaaccaugaguucagugagauugagacuagguugaauaugaucaacgacaagauugaugaccagauacaagauaucugggcuuacaacgccgaacuacugguucuccuggagaaucagaaaacccuugacgaacacgaugcgaacgugaauaaccuguacaauaaggucaaacgggccuugggaagcaacgcaguggaggacggcaagggguguuuugaucucuaucauaagugcgacaaucaguguauggaaacaauucgaaacggaaccuacaaucgcagaauguaucaggaggaguccaggcuggaacggcagaaaaucgaggguguaaaguuagaaucugagggcacuuacaaaauccugacgauuuauagcacaguugcuucaagucuagugauagccaugggguucgcugccuuucucuucugggcaauguccaacggaagcugccgcugcaauaucuguauuuga

SEQ ID NO: 132321 - RNA, 1683 nt, Artificial Sequence
  derived and/or modified sequence opt3 from hemagglutinin__InfluenzaA__AGQ81159
auggaggccgcuaccaucauuacaauacugcucgugaucacuggcagcaacgcagacaagauuugcaucggguaccaguccaccaauucuacggaaacagucgauacucuuaccgagaacaauguucccgugacacacgccaaagaacuguugcauaccgagcacaacggaauguuaugugcgacuaaucuggguagaccucuaauucucgacacaugcaccaucgaaggccugauauaugggaacccaucaugugaucuuccgcuggagggaagggacuggaguuacaucguagagcggcccagcgcugugaauggcgucugcuauccugguaacguggaaaauuuggaggaacuccgcucccuguucucuucggccucaagcuaccaaaagauucagaucuuuccagauaguauuuggaacguuuccuaugacgggaucucuaaagcauguagcaauuccuucuaccgaucaaugcguuggcugacgaagaaaaacaauaguuaucccgugcaggaugcccaguacacuaacaauauaggaaagaacauucucuuuauguggggcaucaaccauccuccaaccaauacaacucaaaccgacuuauacacaagaaccgauacgacuacaagcgucgcuaccgaggacauucacaggacuuucaagccccugaucggcccucggccaccggugaacgggcuuuugggacgcaucgauuauuacugggcaguacugaaacccggucagacacuaagaguuaggucuaauggcaaccucauugccccuugguaugggcauauacugcuuggagagucccacggccggauccugaagaccgacuugaaaucagguaauugcgugguccagugucagacggaacgcgggggacucaacaccacacugccauuucacaaugugagcaaguacgcuuucggcaacugccccaaauauauuggcgugaagaguuuaaagcuggccgucgggcuccgaaauguuccugcgagaucuuccaggggacuuuuuggugcaaucgccggcuucauagaagggggauggagcggccugguggcugguugguacggguuucaacauucgaacgaucagggcacuggaauggccgcagaccgggacucuacccagaaagcuauugauaagaucacauccaaaguaaauaacaucguggacaagaugaauaaacaguaugagauuaucgaucacgaguucucagaaauugagacucguuugaacaugauaaaugacaagaucgaugaccaaauucaggauaucugggccuacaacgcggagcuacugguccuccuggaaaaccagaaaacccuugacgagcaugaugccaaugugaacaaucuguacaacaagguuaagcgcgcauugggcaguaaugcuguggaagacgggaaaggauguuuugaucucuaucacaagugcgacaaccaauguauggagacaaucagaaaugguaccuacaacaggcggaaauaucaggaagagagccgacuggagcgccagaagauugaaggcgucaaauuagaguccgaagggacuuacaagauacugacgaucuauucuacaguggccagcagucuaguaauugcuaugggauucgccgcauuucucuucugggccaugucaaauggcuccugcagaugcaacaucuguauuuga

SEQ ID NO: 132322 - RNA, 1683 nt, Artificial Sequence
  derived and/or modified sequence opt3 from hemagglutinin__InfluenzaA__AGQ81161
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugauccgcuguuggaggggagagagugguccuacaucgucgaaaggcccucugcggugaacggacucugcuauccuggcaauguugagaaccuggaggagcugcggucacucuucucgagcgcucgcaguuaccagcgaauacagaucuuuccagacacgauuuggaauguguccuaugaugguacuucuaaggccuguagcggguccuucuaccguaacaugagaugguuaacccagaaaaauucagacuaucccauccaagaugcacaguacacaaacaaucagggaaagaacauucuguuuauguggggcaucaaucauccuccaacugacaccacacagagggaucuuuacacccggacggacacuacaaccagugucgccacugaggaaauaaaccgcauuuucaaacccuugaucggcccuagaccacuggugaacgggcuaaugggaaggauugauuauuacuggagcguacucaagccgggucaaacacugcggaucaagucugacggcaaucuuaucgcucccugguaugggcacauucuguccggagagucacauggccgcauauugaaaaccgaucucaagaaagguagcugcacgguucagugucagaccgaaaaagggggacugaacacaacuuuaccuuuucagaaugugaguaaguacgcauucggcaacugcucuaaguauaucggcauuaagucccugaaacucgccgucgggcuucgaaaugugccaagcagaucgucuaggggacuguuuggugcuaucgccggcuucauagaagggggaugguccggcuugguggcggguugguacggguuucaacacucaaacgaccagggcgucggaauggcagccgaccgggauaguacccagaaggcuauugacaaaaucacaagcaagguuaauaacaucguggauaaaaugaauaagcaauaugaaauuaucgaccacgaguucuccgagguagaaacucgucuaaacaugauuaauaacaaaauagaugaccagauccaggauauuugggccuacaaugcagagcugcucgugcugcuugaaaaccagaagacccuggacgagcaugaugcuaaugucaacaacuuguacaauaaggugaaacgcgcccucggcucuaacgcgguugaagacgggaagggauguuuugagcuguaucacaaaugcgaugaccaauguauggagacaaucagaaaugguaccuacaacaggcggaaguaucaggaagagagcaaauuagaacgacagaagaucgagggcgugaagcuggaaucagaggggacuuacaaaauucuaacgauauauaguacagucgccuccagccucgugaucgcaaugggauucgcugccuuucuguucugggcuaugucuaauggcucaugccgcugcaacauuuguaucuga

SEQ ID NO: 132323 - RNA, 1683 nt, Artificial Sequence
  derived and/or modified sequence opt3 from hemagglutinin__InfluenzaA__AGQ81162
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggagcuccggucguuauucucaagcgcucgcaguuaccagcgaauacagaucuuuccugacacgauuuggaauguguccuaugaugguacuucuaaggccuguagcggguccuucuaccguucaaugagauggcugacccagaaaaacagugacuauccaauccaagaugcacaguacacaaauaaccagggaaagaauauucuuuuuauguggggcaucaaccaucccccuacugacaccacacagagggauuuguacacccggacggacacuacaaccagcgucgccacugaggaaauaaaucgcauuuucaaaccacugaucggccccagaccucuagugaacgggcucaugggaaggauugauuauuacuggucuguacugaagccaggucaaacacuucggaucaaguccgacggcaaccugaucgcuccgugguaugggcacauuuugucaggagagagccauggccgcauacucaaaaccgaucugaagaaagguaguugcacgguucagugucagaccgaaaaagggggauuaaauacaacucugcccuuucagaacgugucuaaguacgcauucggcaauugcuccaaguauaucggcauuaagagccucaaacuugccgucgggcugcgaaacgugccuucgagaucuuccaggggauuguuuggugcuaucgccggcuucauagaagggggauggucaggccuaguggcggguugguacggguuucaacacaguaaugaccagggcgucggaauggcagccgaccgggauagcacccagaaggcuauugacaaaaucacauccaagguuaacaauaucguggauaaaaugaacaagcaauaugaaauuaucgaccacgaguucucugagguagaaacucgucugaauaugauuaacaauaaaauagaugaccagauccaggauauuugggccuacaacgcagagcuccuggugcuucuggaaaaucagaagaccuuggacgagcaugaugcuaacgucaauaaccucuacaacaaggugaaacgcgcccugggcagcaaugcgguugaagacgggaagggauguuuugaguuauaucacaaaugcgaugaccaauguauggagacaaucagaaacgguaccuacaauaggaagaaauaucaggaagagucaaagcuggaacggcagaagaucgagggcgugaaacuagaaagugaggggacuuacaagauucucacgauauauuccacagucgccagcucucuggugaucgcaaugggauucgcugccuuucuuuucugggcuaugucaaacggcaguugccgaugcaauauuuguaucuga

SEQ ID NO: 132324 - RNA, 1683 nt, Artificial Sequence
  derived and/or modified sequence opt3 from hemagglutinin__InfluenzaA__AGQ81164
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggagcuccggucguuauucucaagcgcucgcaguuaccagcgaauacagaucuuuccugacacgauuuggaauguguccuaugaugguacuucuaaggccuguagcggguccuucuaccguucaaugagauggcugacccagaaaaacagugacuauccaauccaagaugcacaguacacaaauaaccagggaaagaauauucuuuuuauguggggcaucaaccaucccccuacugacaccacacagagggauuuguacacccggacggacacuacaaccagcgucgccacugaggaaauaaaucgcauuuucaaaccacugaucggccccagaccucuagugaacgggcucaugggaaggauugauuauuacuggucuguacugaagccaggucaaacacuucggaucaaguccgacggcaaccugaucgcuccgugguaugggcacauuuugucaggagagagccauggccgcauacucaaaaccgaucugaagaaagguaguugcacgguucagugucagaccgaaaaagggggauuaaauacaacucugcccuuucagaacgugucuaaguacgcauucggcaauugcuccaaguauaucggcauuaagagccucaaacuugccgucgggcugcgaaacgugccuucgagaucuuccaggggauuguuuggugcuaucgccggcuucauagaagggggauggucaggccuaguggcggguugguacggguuucaacacaguaaugaccagggcgucggaauggcagccgaccgggauagcacccagaaggcuauugacaaaaucacauccaagguuaacaauaucguggauaaaaugaacaagcaauaugaaauuaucgaccacgaguucucugagguagaaacucgucugaauaugauuaacaauaaaauagaugaccagauccaggauauuugggccuacaacgcagagcuccuggugcuucuggaaaaucagaagaccuuggacgagcaugaugcuaacgucaauaaccucuacaacaaggugaaacgcgcccugggcagcaaugcgguugaagacgggaagggauguuuugaguuauaucacaaaugcgaugaccaauguauggagacaaucagaaacgguaccuacaauaggcggaaguaucaggaagagucaaaacuggaacgacagaagaucgagggcgugaagcuagaaagugaggggacuuacaaaauucucacgauauauuccacagucgccagcucucuggugaucgcaaugggauucgcugccuuucuuuucugggcuaugucaaacggcaguugccgcugcaauauuuguaucuga

SEQ ID NO: 132325 - RNA, 1683 nt, Artificial Sequence
  derived and/or modified sequence opt3 from hemagglutinin__InfluenzaA__AGQ81167
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggagcuccggucguuauucucaagcgcucgcaguuaccagcgaauacagaucuuuccugacacgauuuggaauguguccuauaacgguacuucuaaggccuguagcggguccuucuaccguucaaugagauggcugacccagaaaaauaguaacuauccaauccaagaugcacaguacacaaauaaccagggaaagaauauucuuuuuauguggggcaucaaccaucccccuacugacaccacacagagggauuuguacacccggacggacacuacaaccagcgucgccacugaggaaauaaaccgcauuuucaaaccacugaucggccccagaccucuagugaaugggcucaugggaaggauugauuauuacuggucuguacugaagccaggucaaacacuucggaucaaguccgacggcaaccugaucgcuccgugguaugggcacauuuugucaggagagagccauggccgcauacucaaaaccgaucugaagaaagguaguugcacgguucagugucagaccgaaaaagggggauuaaauacaacucugcccuuucagaacgugucuaaguacgcauucggcaauugcuccaaguauaucggcauuaagagccucaaacuugccgucgggcugcgaaacgugccuucgagaucuuccaggggauuguuuggugcuaucgccggcuucauagaagggggauggucaggccuaguggcggguugguacggguuucaacacaguaaugaccagggcgucggaauggcagccgaucgggacagcacccagaaggcuauugacaaaaucacauccaagguuaacaauaucguggauaaaaugaacaagcaauaugaaauuaucgaccacgaguucucugagguagaaacucgucugaauaugauuaacaauaaaauagaugaccagauccaggauauuugggccuacaacgcagagcuccuggugcuucuggaaaaucagaagaccuuggacgagcaugaugcuaacgucaacaaucucuacaacaaggugaaacgcgcccugggcagcaaugcgguugaagacgggaagggauguuuugaguuauaucacaaaugcgaugaccaauguauggagacaaucagaaacgguaccuacaauaggcggaaguaucaggaagagucaaaacuggaacgacagaagaucgagggcgugaagcuagaaagugaggggacuuacaaaauucucacgauauauuccacagucgccagcucucuggugaucgcaaugggauucgcugccuuucuuuucugggcuaugucaaacggcaguugccgcugcaauauuuguaucuga

SEQ ID NO: 132326 - RNA, 1683 nt, Artificial Sequence
  derived and/or modified sequence opt3 from hemagglutinin__InfluenzaA__AGQ81168
auggagaccgugagccugaucacaauucuccuugucguuacuguguccaacgccgacaagauaugcaucggcuaccagucuacuaauucaaccgaaacaguagauacucugaccgagaacaaugugcccgucacacacgcuagagaauuguuacauaccgagcacaacgggaugcugugugcaacgagucuaggacauccucucauucuggacacaugcaccaucgaaggucuuauuuauggcaauccaagcugugaucuguugcucgggggaagggagugguccuacaucguggagcggccgucugccguuaacggccugugcuaucccgguaauguggaaaaccuggaggaacuccgcucguuauucucaagcgcgcgaaguuaccaacguauacagaucuuuccugacacgauuuggaaugucuccuauucugggacuagcaaggcuuguuccgauucauucuacagaaguaugagguggcugacccagaagggaaacgccuauccaauccaggacgcacaauacacaaauaaccagggcaaaaauauucuuuuuauguggggcaucaaccaucccccuacugauaccgcccagacaaauuuguacacccggacggacacuacaaccagcguggcuacugaggagauaaaccgcacauucaagccacugauugggcccagaccucuaguaaacggacucauggguaggaucaauuauuacuggucuguucugaaaccaggccagacccuucggauuaaguccaacgggaaucugaucgcaccgugguauggacacaucuugucaggcgaaagccacggucgcauucucaagacggaucugaaacgagggaguugcaccgugcaaugucagacagagaagggaggcuuaaacacuacccugcccuuucagaaugucucuaaauacgccuucggcaacugcuccaaguauauagggaugaaaagccucaaacuugcugugggacugagaaaugugccuucgaggucuucccgggguuuguuuggcgccaucgcgggguucauugaaggaggcuggucaggucuagucgcagggugguacggcuuucagcacaguaacgaccaaggaguuggcauggccgcugaucgugacagcacacagaaggccaucgauaaaauaacuuccaaggugaauaacauuguagacaaaaugaauaagcaguaugagaucaucgaccaugaguucucugaaguggagacccgccugaacaugauuaauaacaaaaucgaugaccaaauucaggauauaugggcauacaaugcugaacuccugguccuucuggagaaccagaagacauuggacgaacacgaugccaacgugaauaaccucuacaauaaaguuaagagagcgcuggggagcaacgccguggaggacggaaaggguuguuuugaauuauaucauaaaugcgaugaccaguguauggagaccaucaggaauggcacuuacaaccggcgaaaguaucaagaggaaucaaaacuggagcgccagaagauugaaggggucaaacuagagagugaaggaacguacaagauccucacaaucuauuccaccguggcaagcucucugguaauugcuaugggcuucgccgcuuuucuuuucugggccaugucaaaugguaguugcagaugcaacauauguaucuga

SEQ ID NO: 132327 - RNA, 1683 nt, Artificial Sequence
  derived and/or modified sequence opt3 from hemagglutinin__InfluenzaA__AGQ81169
auggagaccgugagccugaucacaauucuccuugucguuacuguguccaacgccgacaagauaugcaucggcuaccagucuacuaauucaaccgaaacaguagauacucugaccgagaacaaugugcccgucacacacgcuagagaauuguuacauaccgagcacaacgggaugcugugugcaacgagucuaggacauccucucauucuggacacaugcaccaucgaaggucuuauuuauggcaauccaagcugugaucuguugcucgggggaagggagugguccuacaucguggagcggccgucugccguuaacggccugugcuaucccgguaauguggaaaaccuggaggaacuccgcucguuauucucaagcgcgcgaaguuaccaacguauacagaucuuuccugacacgauuuggaaugucuccuauucugggacuagcaaggcuuguuccgauucauucuacagaaguaugagguggcugacccagaaggacaacgccuauccaauccaggaugcacaauacacaaauaaccaggagaaaaauauucuuuuuauguggggaaucaaccaucccccuacugacaccgugcagacaaauuuguacacccggacggauacuacaaccagcguagccacugaggaaauaaaccgcacauucaagccacugauuggccccagaccucuaguuaacggccucauggggaggaucaauuauuacuggucugugcugaaaccaggacagacccuucggauuaaguccaacgguaaucugaucgcuccgugguauggccacaucuugucaggggagagccacggacgcauucucaagacggaccugaaacgaggcaguugcaccguccaaugucagacagaaaaggguggguuaaacacuacccugcccuuucagaaugugucuaaauacgcauucggaaacugcuccaaguauauaggcaugaaaagccucaaacuugccgugggccugagaaaugucccuucgaggucuucccggggguuguuuggagcuaucgccgguuucauugagggcggguggucaggccuaguugcgggaugguacgguuuucagcacaguaacgaucaaggggugggcauggcagccgaccgugauagcacacagaaggcuaucgacaaaauaacuuccaagguaaauaacauuguggacaaaaugaauaagcaguaugaaaucaucgaucaugaguucucugaggucgaaacccgccugaacaugauuaauaacaaaaucgacgaucaaauucaggacauaugggccuacaaugcagagcuccuggugcuucuggaaaaccagaagacauuggaugagcacgacgcuaacguuaauaaccucuacaauaaagugaagagagcccugggaagcaacgcggucgaagauggcaagggguguuuugaguuauaucauaaaugcgacgaucaguguauggagaccaucaggaauggaacuuacaaccggcgaaaguaucaagaagagucaaaacuggaacgccagaagauugagggugugaaacuagaaagugagggcacguacaagauccucacaaucuauuccaccguagccagcucucugguuauugcaaugggguucgcugccuuucuuuucugggcuaugucaaauggaaguugcagaugcaacauauguaucuga

SEQ ID NO: 132328 - RNA, 1683 nt, Artificial Sequence
  derived and/or modified sequence opt3 from hemagglutinin__InfluenzaA__AGQ81170
auggagaccgugagccugaucacaauucuccuugucguuacuguguccaacgccgacaagauaugcaucggcuaccagucuacuaauucaaccgaaacaguagauacucugaccgagaacaaugugcccgucacacacgcuagagaauuguuacauaccgagcacaacgggaugcugugugcaacgagucuaggacauccucucauucuggacacaugcaccaucgaaggucuuauuuauggcaauccaagcugugaucuguugcucgggggaagggagugguccuacaucguggagcggccgucugccguuaacggccugugcuaucccgguaauguggaaaaccuggaggaacuccgcucguuauucucaagcgcgcgaaguuaccaacguauacagaucuuuccugacacgauuuggaaugucuccuauucugggacuagcaaggcuuguuccgauucauucuacagaaguaugagguggcugacccagaaggacaacgccuauccaauccaggaugcacaauacacaaauaaccagggaaagaauauucuuuuuauguggggcaucaaccaucccccuacugacaccgcccagacaaauuuguacacccggacggauacuacaaccagcguggcuacugaggagauaaaccgcacauucaagccacugauuggccccagaccucuaguaaacgggcucaugggaaggaucaauuauuacuggucuguucugaaaccaggucagacccuucggauuaaguccaacggcaaucugaucgcaccgugguaugggcacaucuugucaggagaaagccacggccgcauucucaagacggaccugaaacgagguaguugcaccgugcaaugucagacagagaaagggggauuaaacacuacccugcccuuucagaaugucucuaaauacgccuucggcaacugcuccaaguauauaggcaugaaaagccucaaacuugcuguggggcugagaaaugugccuucgaggucuucccggggauuguuuggugccaucgcgggcuucauugaagggggauggucaggccuagucgcagguugguacggguuucagcacaguaacgaucaaggcguuggaauggccgcugaccgugauagcacacagaaggccaucgacaaaauaacuuccaaggugaauaacauuguagacaaaaugaauaagcaguaugagaucaucgaucaugaguucucugaaguggagacccgccugaacaugauuaauaacaaaaucgacgaucaaauucaggacauaugggcauacaaugcugaacuccugguccuucuggagaaccagaagacauuggaugaacacgacgccaacgugaauaaccucuacaauaaaguuaagagagcgcugggcagcaacgccguggaggaugggaagggauguuuugaauuauaucauaaaugcgacgaucaguguauggagaccaucaggaaugguacuuacaaccggcgaaaguaucaagaggaaucaaaacuggagcgccagaagauugaaggcgucaaacuagagagugaagggacguacaagauccucacaaucuauuccaccguggcaagcucucugguaauugcuaugggauucgccgcuuuucuuuucugggccaugucaaauggcaguugcagaugcaacauauguaucuga

SEQ ID NO: 132329 - RNA, 1683 nt, Artificial Sequence; identical to SEQ ID NO: 132328
  derived and/or modified sequence opt3 from hemagglutinin__InfluenzaA__AGQ81171

SEQ ID NO: 132330 - RNA, 1683 nt, Artificial Sequence; identical to SEQ ID NO: 132328
  derived and/or modified sequence opt3 from hemagglutinin__InfluenzaA__AGQ81172

SEQ ID NO: 132331 - RNA, 1683 nt, Artificial Sequence
  derived and/or modified sequence opt3 from hemagglutinin__InfluenzaA__AGQ81173
auggagaccgccagccugaucacaauucuccuuguggucacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggaaauccucucauucuggacacaugcaccaucgaaggucuuauuuauggcaacccaagcugugaucuguugcucgggggaagagagugguccuacaucgucgagaggccgucugcggugaauggccugugcuaucccgguaacguugaaaaucuggaggaacuccggucguuauucucaagcgcucgcaguuaccaacgaauacagaucuuuccugacacgauuuggaacguguccuauucugggacuagcaaggccuguuccgauucauucuaccguaguaugagauggcugacccagaaagacaaugcauauccaauccaggaugcccaauacacaaacaaucagggaaagaacauucuuuuuauguggggcaucaaucaucccccuacugacaccgcucagacaaacuuguacaccaggacggauacuacaaccagcgucgcaacugaggagauaaaccggacauucaaaccacugauuggcccccgcccucuagugaaugggcucaugggaagaaucaacuauuacuggucuguacugaagccaggucagacccuuaggauuaaguccaauggcaaccugaucgccccgugguaugggcacaucuugucaggagaaagccauggccggauucucaaaacggaccugaagcgcgguaguugcaccguucaaugucagacagagaaagggggauuaaauacuacccugcccuuucagaacgugucuaaguacgcuuucggcaauugcuccaaauauauaggcaugaaaagccucaaacuugccgucgggcugcgaaacgugccuucgagaucuuccaggggauuguuuggugcgaucgcaggcuucauugaagggggauggucaggccuaguggccgguugguacggguuucagcacaguaaugaucaaggcgucggaauggcugccgaccgggauagcacacagaaggcaaucgacaagauaacuuccaagguuaacaauauuguggacaagaugaacaaacaguaugagaucaucgaucacgaguucucugaaguagagacccgucugaauaugauuaacaauaagaucgacgaucaaauucaggacauaugggcuuacaacgccgaacuccuggugcuucuggagaaccagaaaacauuggaugaacaugacgcgaaugucaacaaucucuacaacaaggugaagcgcgcccugggcagcaaugcaguugaggaugggaaaggauguuuugaauuauaucacaagugcgacgaucaguguauggagaccaucagaaacgguacuuacaauaggcggaaauaucaagaggaaucaaagcuggagcgacagaaaauugaaggcgugaagcuagagagugaagggacguacaagauccucacaaucuauuccaccgucgcuagcucucuggugauugccaugggauucgcugccuuucuuuucugggcaaugucaaacggcaguugccgcugcaauauauguaucuga

SEQ ID NO: 132332 - RNA, 1683 nt, Artificial Sequence; identical to SEQ ID NO: 132328
  derived and/or modified sequence opt3 from hemagglutinin__InfluenzaA__AGQ81175

SEQ ID NO: 132333 - RNA, 1683 nt, Artificial Sequence
  derived and/or modified sequence opt3 from hemagglutinin__InfluenzaA__AGQ81177
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggaacuccggucguuauucucaagcgcucgcaguuaccagcgaauacagaucuuuccugacacgauuuggaauguguccuauaacgguacuucuaaggccuguagcggguccuucuaccguucaaugagauggcugaccaggaaaaauggagauuauccaauccaggacgcacaauacacaaacaaucagggcaagaacauucuuuuuauguggggcaucaaucaucccccuacugauaccacacagcgggacuuguacacccgcacggauacuacaaccagugucgccacugaggaaauaaacagaauuuucaaaccacugaucgggcccaggccucuagugaacggacucaugggucggauugacuauuacuggagcguacugaagccaggccagacacuucgcaucaagucugaugggaaucugaucgcuccgugguauggacacauuuuguccggcgagucacauggucgaauacucaaaaccgaccugaagagagggagcugcacgguucaaugucagaccgaaaaaggaggcuuaaacacaacucugcccuuucagaaugugaguaaguacgcauucggcaacugcucuaaauauaucgggauuaagucccucaaacuugccgucggacugaggaaugugccuagccggucgucucgugguuuguuuggcgcuaucgccggguucauagagggaggcugguccggucuaguggcggggugguacggcuuucagcacucaaacgaucaaggagucggcauggcagccgaccgcgacaguacccagaaggcuauugauaagaucacaagcaaaguuaauaacaucguggacaagaugaauaaacaguaugaaauuaucgaucacgaguucuccgagguagaaacuagacugaacaugauuaauaacaagauagacgaucaaauccaggacauuugggccuacaaugcagagcuccuggugcuucuggaaaaccagaaaaccuuggaugagcaugacgcuaaugucaacaaccucuacaauaaggugaagagggcccuggggucuaacgcgguugaagauggaaaagguuguuuugaguuauaucacaagugcgacgaucaguguauggagacaauccggaauggcaccuacaaccgacgcaaauaucaagaagagagcaagcuggaaagacagaaaaucgagggggugaagcuagaaucagagggaacuuacaagauucucacgauauauaguacagucgccuccagccuggugaucgcaaugggcuucgcugccuuucuuuucugggcuaugucuaaugguucauguaggugcaacauuugcaucuga

SEQ ID NO: 132334 - RNA, 1683 nt, Artificial Sequence; identical to SEQ ID NO: 132333
  derived and/or modified sequence opt3 from hemagglutinin__InfluenzaA__AGQ81178

SEQ ID NO: 132335 - RNA, 1683 nt, Artificial Sequence; identical to SEQ ID NO: 132325
  derived and/or modified sequence opt3 from hemagglutinin__InfluenzaA__AGQ81181

SEQ ID NO: 132336 - RNA, 1683 nt, Artificial Sequence; identical to SEQ ID NO: 132325
  derived and/or modified sequence opt3 from hemagglutinin__InfluenzaA__AGQ81183

SEQ ID NO: 132337 - RNA, 1683 nt, Artificial Sequence; identical to SEQ ID NO: 132324
  derived and/or modified sequence opt3 from hemagglutinin__InfluenzaA__AGQ81184

SEQ ID NO: 132338 - RNA, 1683 nt, Artificial Sequence
  derived and/or modified sequence opt3 from hemagglutinin__InfluenzaA__AGQ81185
auggagaccgccagccugaucacaauucuccuuguggcuacugucuccaacgcagacaagauaugcaucggcuaccagucuacuaauucaaccgaaacaguugauacucugaccgagaacaaugugcccguaacacacgccaaagaauuguuacauaccgagcacaacgggaugcugugugcgacgagucuaggacaaccucucauucuggacacaugcaccaucgaaggucuuauuuauggcaauccaagcugugaucuguugcucgaggggagagagugguccuacaucguggaaaggccgucugcugucaacggacugugcuaucccggcaauguggagaaccuggaggagcuccggucguuauucucaagcgcccgcaguuaccagcgaauacagaucuuuccugacacgacuuggaauguuuccuauaacgguaccucuaaggcauguagcggguccuucuaccguucaaugagauggcugacacagaaaaauaguaacuauccaauucaagaugcccaguacacuaauaaccagggaaagaauauccuuuuuauguggggcauuaaccaucccccuaccgacacaacccagagggauuuguacacgcggacugacacaaccacuagcguggcuacagaggaaaucaaccgcauauucaaaccacugauuggccccagaccucuagucaaugggcucaugggaaggaucgauuauuacuggucugugcugaagccaggucaaacccuucggauuaaguccgacggcaaccugaucgcaccgugguaugggcacaucuugucaggagagagccauggccgcauucucaaaacggaucugaagcgagguaguugcaccguacagugucagacagaaaaagggggauuaaauacuacccugcccuuucagaacguuucuaaguacgccuucggcaauugcuccaaauauauaggcaucaagagccucaaacuugcuguggggcugagaaacgucccuucgaggucuucccggggauuguuuggugccauugcgggcuucaucgaagggggauggucaggccuaguggcagguugguacggguuucaacacaguaaugaccagggcgugggaauggccgcugaucgugacagcacacagaaggccauagacaagauuacuuccaaagucaacaauaucguugauaagaugaacaaacaauaugaaaucauugaccacgaguucucugagguggaaacccgccugaauaugaucaacaauaagauugaugaccagauacaggauaucugggcauacaacgcugagcuccugguacuucuggaaaaucagaaaacauuggacgagcaugaugccaacgugaacaaucucuacaacaaggucaagagagcgcugggcagcaaugccguggaagacgggaaaggauguuuugaguuauaucacaagugcgauaaccaauguauggagaccauuaggaaugguacuuacaaccggcgaaaauaucaggaagagucaaagcuggaacgccagaaaaucgagggcguuaagcuagaaagugaggggacguacaagauccucacaauuuauuccaccguggcaagcucucuggucauagcuaugggauucgccgcuuuucuuuucugggccaugucaaauggcaguugcagaugcaacaucuguauuuga

SEQ ID NO: 132339 - RNA, 1683 nt, Artificial Sequence
  derived and/or modified sequence opt3 from hemagglutinin__InfluenzaA__AGQ81186
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggagcuccggucguuauucucaagcgcucgcaguuaccagcgaauacagaucuuuccugacacgauuuggaauguguccuaugaugguacuucuaaggccuguagcggguccuucuaccguucaaugagauggcugacccagaaaaacagugacuauccaauccaagaugcacaguacacaaauaaccagggaaagaauauucuuuuuauguggggcaucaaccaucccccuacugacaccacacagagggauuuguacacccggacggacacuacaaccagcgucgccacugaggaaauaaaucgcauuuucaaaccacugaucggccccagaccucuagugaacgggcucaugggaaggauugauuauuacuggucuguacugaagccaggucaaacacuucggaucaaguccgacggcaaccugaucgcuccgugguaugggcacauuuugucaggagagagccauggccgcauacucaaaaccgaucugaagaaagguaguugcacgguucagugucagaccgaaaaagggggauuaaauacaacucugcccuuucagaacgugucuaaguacgcauucggcaauugcuccaaguauaucggcauuaagagccucaaacuugccaucgggcugcgaaacgucccuucgagaucuuccaggggauuguuuggugcuauagccggcuucauugaagggggauggucaggccuaguggcggguugguacggguuucaacacaguaaugaccagggcgugggaauggcagccgaccgggauagcacccagaaggcuaucgacaaaaucacauccaaggucaacaauauuguugauaaaaugaacaagcaauaugaaaucauugaccacgaguucucugagguggaaacucgucugaauaugauaaacaauaaaaucgaugaccagauucaggauaucugggccuacaacgcagagcuccugguacuucuggaaaaucagaagaccuuggacgagcaugaugcuaacgugaauaaccucuacaacaaggucaaacgcgcccugggcagcaaugcgguggaagacgggaagggauguuuugaguuauaucacaaaugcgaugaccaauguauggagacaaucagaaacgguaccuacaauaggaagaaauaucaggaagagucaaagcuggaacggcagaagauugagggcguuaaacuagaaagugaggggacuuacaagauacucacgaucuauuccacaguggccagcucucuggucauugcaaugggauucgcugccuuucuuuucugggcuaugucaaacggcaguugccgaugcaauaucuguauuuga

SEQ ID NO: 132340 - RNA, 1683 nt, Artificial Sequence; identical to SEQ ID NO: 132328
  derived and/or modified sequence opt3 from hemagglutinin__InfluenzaA__AGQ81190

SEQ ID NO: 132341 - RNA, 1683 nt, Artificial Sequence; identical to SEQ ID NO: 132328
  derived and/or modified sequence opt3 from hemagglutinin__InfluenzaA__AGQ81191

SEQ ID NO: 132342 - RNA, 1683 nt, Artificial Sequence; identical to SEQ ID NO: 132333
  derived and/or modified sequence opt3 from hemagglutinin__InfluenzaA__AGQ81192

SEQ ID NO: 132343 - RNA, 1683 nt, Artificial Sequence
  derived and/or modified sequence opt3 from hemagglutinin__InfluenzaA__AGQ81193
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggaacuccggucguuauucucaagcgcucgcaguuaccagcgaauacagaucuuuccugacacgauuuggaauguguccuauacugguaccucuaaggccuguagcggguccuucuaccguucaaugagauggcugacacagaaaaacggagauuauccaauccaagacgcacaguacacuaauaaccagggcaagaauauucuuuuuauguggggcaucaaccaucccccuaccgauacaacccagagggacuuguacacgcggacugauacaaccacaagugucgccacugaggaaauaaaucgcauuuucaaaccacugaucgggcccagaccucuagugaacggacucauggguaggauugacuauuacuggagcguacugaagccaggccaaacccuucggaucaagucugaugggaaccugaucgcuccgugguauggacacguuuuguccggcgagucacauggucgcauucucaaaacggaccugaagcgagggagcugcaccgugcagugucagacagaaaaaggaggcuuaaauacuacccugcccuuucagaacgucaguaaguacgcauucggcaauugcucuaaauauauagggaucaagucccucaaacuugccgugggacugagaaacgugccuagcaggucgucucgggguuuguuuggcgcuauugccggguucaucgagggaggcugguccggucuagucgcggggugguacggcuuucaacacucaaaugaucagggaguuggcauggcagccgaccgugacaguacacagaaggcuauagauaagauuacuagcaaagugaacaauaucguagacaagaugaacaaacaauaugaaaucauugaucacgaguucuccgagguggaaacccgccugaauaugaucaacaauaagauugacgaucagauacaggacaucugggccuacaacgcagagcuccugguccuucuggaaaaucagaaaacauuggaugagcaugacgcuaacgugaauaaccucuacaacaagguuaagagagcccuggggucuaaugcgguggaagauggaaaagguuguuuugaguuauaucacaagugcgacgaucaauguauggagaccauuaggaacggcacuuacaaucggcgaaaauaucaggaagagagcaagcuggaacgccagaaaaucgagggggucaagcuagaaucagagggaacguacaagauccucacaauuuauaguaccguggccuccagccugguaauagcaaugggcuucgcugccuuucuuuucugggcuaugucuaacgguucaugcagaugcaauaucuguauuuga

SEQ ID NO: 132344 - RNA, 1683 nt, Artificial Sequence; identical to SEQ ID NO: 132328
  derived and/or modified sequence opt3 from hemagglutinin__InfluenzaA__AGQ81194

SEQ ID NO: 132345 - RNA, 1686 nt, Artificial Sequence
  derived and/or modified sequence opt3 from hemagglutinin__InfluenzaA__AGQ81195
auguacaagaucguggucauuauaacccugcucggcacaguuaaagggcuugacaagaucugccugggacaccaugccguggcuaacgguacuauuguaaaaacguugaccaaugagcaggaagaggugacaaacgcaacugaaaccgucgagggcaagagcuuaaauagacuguguaugaaagggaggaaccacaaggaucuaggaaauugccaucccaucggcaugcucauugguaccccugccugugaccugcaccuuacagggacuugggauacacugaucgaacgggagaacgcgauagcuuauugcuacccaggagccaccaucaaugaggaagcauugcgccaaaagauuauggaguccggcggcaucucuaaaauuucaacgggguucacuuauggaaguagcaucaacuccgccgguaccacacgagcuuguaugcguaauggcgggaacucuuuuuacgcagaacucaaguggcuggugucgaaaucaaagggacagaauuucccgcagacuaccaacacauauagaaauaccgacacgagcgagcaucugauaauguggggcauucaccaccccaguuccacucaggagaaaaacgaucucuacgguacacaaucuuuaagcaucuccguugggucaaguaccuaucagaauaacuuugugccugucgugggagccaggccacagguaaacggccagagcggccggauugacuuccauuggacucugguucaacccggggauaauaucacauuuucucacaacggaggucuuaucgcuccuucccgcgugucaaaguugauuggcagagggcugggaauacagagcgacgccaguaucgauaauaacugcgaaucuaaguguuucuggaggggcgguuccauuaauacccggcuaccauuucagaaccucagcccccgcacggucgggcagugcccuaaauacgugaauaagcgaucgcugaugcuugcgaccggcaugagaaacgugccagagaucaugcaaggaaggggccuguucggggcaauagccggauuuauugaaaaugguugggagggcauggucgacgggugguacggauuccggcaucagaacgcucagggcacaggucaagccgcagauuauaaaucuacucaggcugccaucgaccagaucaccgggaaguugaaucgucucauugagaaaacaaacacugaauuugaguccaucgaaucagaguucagugaaauugagcaccagauaggcaauguuaucaacuggaccaaggauagcauuacagacaucuggaccuaccaagcggaacuguuaguggccauggagaaucagcacacuaucgacauggcagauuccgagaugcugaaccucuaugaacgcguaagaaaacagcuuaggcagaacgcugaggaagacggaaagggcuguuuugagauuuaccaugccugcgaugacucuuguauggaaagcauacggaauaacacguaugaucacucacaauaccgagaggaggcucuguugaaucgccuaaacaucaauccggugacacugaguuccggguauaaggacauuauccucugguucagcuucggagccucuugcuuuguccugcuugcagugguuaugggucugguguucuuuugcuugaaaaacggcaauaugagauguaccauuugcaucuga

SEQ ID NO: 132346 - RNA, 1686 nt, Artificial Sequence
  derived and/or modified sequence opt3 from hemagglutinin__InfluenzaA__AGQ81196
auguacaagaucguggucauuauagcccugcucggcgcuguuaaagggcuugacaagaucugccugggacaccaugcaguggccaacgguaccauuguaaaaacauugacuaaugagcaggaagaggugacgaacgcgaccgaaacagucgagagcgcuuccuuaaauagacuguguaugaagggcaggucucacaaagaucuagggaacugccaucccaucggaaugcucauuggcacuccugccugugaccugcaccuuaccgguacaugggauacccugaucgaacgggagaaugcaauagccuauugcuacccaggggcuacugugaacgaggaagcauugcgccaaaagaucauggagucaggaggcauuaguaagaucagcacaggcuucaccuauggguccucuauuaauucggccggaacgacuaaggcuuguaugcgaaaccgugguaauucauuuuacgccgaacucaaauggcugguuagcaaaaguaagggccagaacuucccgcagaccacaaauacuuauagaaacaccgacacagcggagcaucugaucaugugggggauacaccaccccuccucuacccaggagaaaaaugaucucuacggaacgcagagcuuauccauuucagugggcaguagcacuuaucaaaacaauuuugucccugugguaggugcaaggccacagguuaacgggcagucuggacggaucgacuuccauuggacacuggugcaacccggcgauaacauuaccuuuucccacaauggcgggcuuaucgccccuucacgcgucagcaaguuggugggaagaggucugggcauccagagugacgcuccaauugauaacaauugcgaaucuaaguguuucuggaggggaggguccauaaacacucggcuacccuuucagaaucucagcccucgcacagugggccagugcccaaaauacgucaacaagcgaucgcugaugcuugccaccgguaugagaaauguuccggagaucaugcaagggaggggccuguucggagcaauugcuggcuuuaucgaaaacgggugggagggaaugguggacgguugguacggcuuccggcaucagaaugcccaggggacgggacaagcggccgauuauaaaucuacccagacagcaauagaccagauuacuggcaaguugaaccgucucaucgagaaaaccaauacagaauuugaguccaucgaaucagaguucagugaaauugagcaccagaucgguaacguaauuaauuggacuaaggauagcauaaccgacaucuggacauaccaagcugaacuguuaguggccauggagaaccagcacaccauugacauggcugauuccgagaugcugaaucucuaugaacgcgucagaaaacagcuuaggcagaacgccgaggaagacgggaagggcuguuuugagaucuaccaugcaugcgaugacucuuguauggaaagcauccggaacaauacuuaugaucacucacaauaccgagaggaggcccuguugaaccgccuaaauauuaaccccgugaagcugaguuccggauauaaagacauaauccucugguucagcuucggcgcuucuugcuuuguucugcuugcgguggucauggggcugguguucuuuugcuugaagaauggaaacaugagauguacgauuugcaucuga

SEQ ID NO: 132347 - RNA, 1686 nt, Artificial Sequence
  derived and/or modified sequence opt3 from hemagglutinin__InfluenzaA__AGQ81198
auguacaagaucguggucauuauagcccugcucggcgcuguuaaagggcuugacaagaucugccugggacaccaugcaguggccaacgguaccauuguaaaaacauugacuaaugagcaggaagaggugacgaacgcgaccgaaacagucgagagcacuuccuuaaauagacuguguaugaagggcaggaaccacaaagaucuagggaauugccaucccaucggaaugcucauuggcaccccugcuugugaccugcaccuuacagguaccugggauacucugaucgaacgggagaacgccauagcauauugcuacccaggggccacaaucaaugaggaggcuuugcgccaaaagauuauggaaucuggaggcaucucaaagauuaguaccggcuucacguaugggagcuccaucaacucugcaggaaauacuaaagccuguaugcgaaacgguggcaauucguuuuacgcugaacuccguuggcuggugucaaagaacaaagggcagaauuucccgcagaccacaaacacuuauagaaauaccgacacagccgagcaucugauaauuuggggaauccaccaccccagcaguaccaaggagaaaaacgaucucuacggcacgcaguccuuaucuauuagcguugguuccucaacuuaucaaaacaauuuugugccugucgugggggcgaggccacagguaaacggacagaguggccggaucgacuuccauuggacacugguucagcccggcgauaauaucaccuuuagccacaacgggggacuuauugcaccuucucgcguguccaaguugauagguagaggccuggggauccaaucagacgccccaauugauaauaacugcgaaagcaaguguuucuggaggggaggcaguaucaauacucggcuacccuuucagaaccucucuccucgcacagucggucagugcccaaaauacgugaauaagaaaucccugaugcuugcuaccgggaugcgaaacgugccggagauaaugcagggcagaggacuguucggcgccauugcaggguuuaucgaaaauggaugggaggguauggucgacggcugguacggguucaggcaucaaaacgcucagggaacgggccaggccgcggauuauaagagcacccaagccgcaaucgaccagauuacagguaaauugaaucggcucaucgaaaagacuaacaccgaguuugagucgauugaaucugaguucuccgaaauagagcaccagaucgggaauguuauuaacuggacaaaagauucaaucacugacaucuggaccuaccaggcugaacuguuaguggccauggagaaccaacacacaauugacauggcugauagugagaugcugaaucucuaugaacguguacgcaagcagcuuagacagaacgccgaggaagacggcaagggauguuuugagauauaccaugcaugcgaugacagcuguauggaauccaucaggaauaacaccuaugaucacucucaguaccgggaggaggcccuguugaaucgacuaaacauuaaucccgugacucugagcucaggcuauaaagacaucauucucugguucaguuucggggcuuccugcuuuguccugcuugcggugguuaugggacugguguucuuuugcuugaagaacgguaauaugcgcuguacgaucugcauauga

SEQ ID NO: 132348 - RNA, 1686 nt, Artificial Sequence
  derived and/or modified sequence opt3 from hemagglutinin__InfluenzaA__AGQ81199
auguacaagaucguggucauuauagcccugcucggcgcuguuaaagggcuugacaagaucugccugggacaccaugcaguggccaacgguaccauuguaaaaacauugacuaaugagcaggaagaggugacgaacgcgaccgaaacagucgagagcgcuuccuuaaauagacuguguaugaagggcaggucucacaaagaucuagggaacugccaucccaucggaaugcucauuggcacuccugccugugaccugcaccuuaccgguacaugggauacccugaucgaacgggagaaugcaauagccuauugcuacccaggggcuacugugaacgaggaagcauugcgccaaaagaucauggagucaggaggcauuaguaagaucagcacaggcuucaccuauggguccucuauuaauucggccggaacgacuaaggcuuguaugcgaaacgguggcaauucauuuuacgccgaacucaaauggcugguuagcaaaaguaaggggcagaacuucccgcagaccacaaauacuuaucguaacaccgacacagcggagcaucugaucauguggggaauacaccaccccuccucuacccaggagaaaaaugaucucuacggcacgcagagcuuauccauuucaguggguaguagcacuuaucaaaacaauuuugucccugugguaggggcaagaccacagguuaacggacagucuggcaggaucgacuuccauuggacacuggugcaacccggcgauaacauuaccuuuucccacaaugggggacuuaucgccccuucacgggucagcaaguuggugggucgcggccuggggauccagagugacgcuccaauugauaacaauugcgaaucuaaguguuucuggagaggaggcuccauaaacacuaggcuacccuuucagaaucucagcccucggacagugggucagugcccaaaauacgucaacaagcgcucgcugaugcuugccaccgggaugcgaaauguuccggagaucaugcaaggcagaggacuguucggcgcaauugcuggguuuaucgaaaacggaugggaggguaugguggacggcugguacggguucaggcaucagaaugcccagggaacgggccaagcggccgauuauaaaucuacccagacagcaauagaccagauuacugguaaguugaaccggcucaucgagaaaaccaauacagaauuugaguccaucgaaucagaguucagugaaauugagcaccagaucgggaacguaauuaauuggacuaaggauagcauaaccgacaucuggacauaccaagcugaacuguuaguggccauggagaaccagcacaccauugacauggcugauuccgagaugcugaaucucuaugaacguguccgcaaacagcuuagacagaacgccgaggaagacggcaagggauguuuugagaucuaccaugcaugcgaugacucuuguauggaaagcaucaggaacaauacuuaugaucacucacaauaccgggaggaggcccuguugaaccgacuaaauauuaaccccgugaagcugaguuccggcuauaaagacauaauccucugguucagcuucggggcuucuugcuuuguucugcuugcgguggucaugggacugguguucuuuugcuugaagaaugguaacaugcgcuguacgauuugcaucuga

SEQ ID NO: 132349 - RNA, 1698 nt, Artificial Sequence
  derived and/or modified sequence opt3 from hemagglutinin__InfluenzaA__AGQ81200
augaagaaaacccuccuguucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauugguuuaggcgauugcuccuuugccggguggauccugggaaauccuaugugugacgaucuaauaggcaaaaccucuuggucguacaucgucgaaaagccaaacccggcgaaugguauuugcuaucccgggacacucgagaacgaggaggagcugagacuuaaguucucaggagugcuggaauuuagcaaauucgaggcuuuuaccaguacuggcuggggcgccguuaauuccggggcaggagugacagccgcuuguaaguucgguucuagcaacuccuuuuucaggaauauggucugguugauccaucaaucaggcaccuacccugugauuaaacggacguuuaacaauacuaaggggcgcgacguacucguuguguggggaauccaccauccagcaacccugaaagagcaccaggaucuguauaagaaggacaguagcuacgucgccgugggcucugaaacauauaaccgacguuucauacccgagauuuccacuagaccuaaagugaauggucaggcugggaggaugaccuuuuacuggacaaucgucaagccaggagaaucaauuaccuucgagagcaacggcgccuuccucgcgccccgguacgcauuugaaaucguuagugugggcaacgggaaauuauuccgcucugagcugaauaucgaguccugcagcacgaagugucagacugaaauuggagguauaaacacaaauaaaucguuucauucuguacacagaaacaccaucggcgauugcccuaaguaugugaaugucaaaucccuuaaguuggccacugggcugaggaacgugccagcuauugccucacggggacuauucggcgcaaucgcugguuuuauagaagggggcuggccgggacucauuaauggcugguacggguuccaacaccgcaacgaagagggaacagguaucgccgcggacaaggaaaguacccagaaagccaucgaucagauuacgagcaagguuaauaacaucguggacaaaaugaauaccaacuuugaguccguccagcaugaguucucugaaauugaggaacgaauaaaucaacugagcaagcacguggaugacucaguaguugacaucuggaguuauaacgcacagcuucugguguugcucgagaaugagaaaacacuggauuuacaugacuccaacgucagaaaccugcacgaaaaggugaggcggaugcucaaggauaaugcuaaagacgagggcaacggguguuuuacuuucuaccacaagugcgauaaugaauguauugagcguguccgcaacggaaccuaugaccauaaagaauuugaggaggaaagcaagaucaauagacaggagaucgaaggcgugaaacuugauucuucagguaacguuuacaagauucugaguauauauagcugcaucgccuccucuuuggugcuagcugcccugauuaugggguucauccucugggcaugcucgaauggcagcuguaggugcacaauuuguaucuga

SEQ ID NO: 132350 - RNA, 1698 nt, Artificial Sequence
  derived and/or modified sequence opt3 from hemagglutinin__InfluenzaA__AGQ81202
augaagaaaacccuccuguucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaggaacugagacuuaaguucagcggggugcuggaauuuaguaaauucgaggcuuuuaccuccaauggauggggcgccguuaacucuggcgcaggggugacugccgcuuguaaguucggaagcuccaauucauuuuucaggaacacagucugguugauccaucaaagugguaccuacccugugauuaaacggacguuuaauaacacuaagggccgcgacguacucguuguguggggaguccaccauccagcaacccugaaagagcaccaggaucuguauaagaaggacagcucuuacguggccgugggguccgaaacauauaaucgacguuucauccccgagauaucaacuagaccuaaagucaacggccaggcugguaggaugaccuuuuacuggacaauuguuaagccaggggaaagcaucaccuucgagaguaacggagccuuccucgcgccccgguacgcauuugaaauugugucuguaggcaauggcaaauuauuccgcuccgagcugaacaucgagagcugcucgacgaagugucagacugaaaucgggggaauuaauacaaacaaaucuuuucauuccgugcacagaaauaccauaggugauugcccuaaguaugucaacgugaaaucacuuaaguuggccacuggccugaggaauguuccagcuaucgccagucgggggcuauucggagcaauugcuggcuuuaucgaggguggguggccgggccucauaaacggaugguacggcuuccaacaccgcaaugaagaggggacaggaauugccgcggacaaggaaagcacccagaaagccaucgaucagaucacguccaaggugaacaauauugucgaccgaaugaacaccaauuuugagucugugcagcaugagagcucagaaaucgaggaaagaauuaaccaacugaguaaacacguagaugacuccaugguugacauauggagcuauaaugcacagcuucugguguugcucgagaacgaaaagacacuggauuuacaugacucuaacgucaggaaucugcacgagaaagugcggcguaugcucaaggauaacgcuaaggacgaggguaauggcuguuucacuuuuuaccacaaaugcgauaacaaguguaucgaacgcgucagaaaugggaccuaugaccauaaagaguucgaagaggagucaaagauuaacaggcaggaaaucgagggagugaaacuugauaguagcggcaauguuuacaagauccuguccauuuauucuugcauagccucgagcuuggugcuagcugcccugaucauggguuuuauucucugggcaugcuccaacgggucaugucggugcacaaucuguauuuga

SEQ ID NO: 132351 - RNA, 1698 nt, Artificial Sequence
  derived and/or modified sequence opt3 from hemagglutinin__InfluenzaA__AGQ81203
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaggaacugagacuuaaguucagcggggugcuggaauuuaauaaauucgaggcuuuuaccaguaacggauggggcgccguuaauuccggcgcaggggugacugccgcuuguaaguucggaucuagcaacuccuuuuucaggaauauggucugguugauccaucaaucagguacauacccugugauuaaacggaccuuuaacaauacgaagggccgcgacguacucguugugugggggauccaccauccagcaacucugaaagagcaccaggaucuguauaagaaggacaguagcuacgucgccgugggaucugaaaccuauaaccgacguuucauacccgagauuuccacaagaccuaaagugaacggccaggcugguaggaugacuuuuuacuggaccaucgucaagccaggggaaucaauuacauucgagagcaauggagccuuccucgcgccccgguacgcauuugaaaucguuagugugggcaacggcaaauuauuccgcucugagcugaauaucgaguccugcagcaccaagugucagacggaaauugggggaauaaacacuaauaaaucguuucauucuguacacagaaacacaaucggugauugcccuaaguaugugaaugucaaaucccuuaaguuggccaccggccugaggaacgugccagcuauugccucacgggggcuauucggagcaaucgcuggcuuuauagaggguggguggccgggccucauuaauggaugguacggcuuccaacaccgcaacgaagaggggacuggaaucgccgcggacaaggaaaguacacagaaagccaucgaucagauuaccagcaagguuaauaacaucguggaccgaaugaauacgaacuuugaguccguccagcaugaguucucugaaauugaggaaagaauaaaucaacugagcaaacacguggaugacucaguaguugacaucuggaguuauaacgcacagcuucugguguugcucgagaacgaaaagacccuggauuuacaugacuccaaugucaggaaccugcacgagaaagugcggcguaugcucaaggauaaugcuaaggacgaggguaacggcuguuuuacauucuaccacaaaugcgauaaugaauguauugagcgcgucagaaacgggacuuaugaccauaaggaauuugaggaggaaagcaaaaucaauaggcaggagaucgaaggagugaagcuggauucuucaggcaacguuuacaaaauucugaguauauauagcugcaucgccuccucuuuggugcuagcugcccugauuauggguuucauccucugggcaugcucgaaugggagcugucggugcaccauuuguaucuga

SEQ ID NO: 132352 - RNA, 1698 nt, Artificial Sequence
  derived and/or modified sequence opt3 from hemagglutinin__InfluenzaA__AGQ81204
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaggaacugagacuuaaguucagcggggugcuggaauuuaauaaauucgaggcuuuuaccaguaacggauggggcgccguuaauuccggcgcaggggugacugccgcuuguaaguucggaucuagcaacuccuuuuucaggaauauggucugguugauccaucaaucagguacauacccugugauuaaacggaccuuuaacaauacgaagggccgcgacguacucguugugugggggauccaccauccagcaacucugaaagagcaccaggaucuguauaagaaggacaguagcuacgucgccgugggaucugaaaccuauaaccgacguuucauacccgagauuuccacaagaccuaaagugaacggccaggcugguaggaugacuuuuuacuggaccaucgucaagccaggggaaucaauuacauucgagagcaauggagccuuccucgcgccccgguacgcauuugaaaucguuagugugggcaacggcaaauuauuccgcucugagcugaauaucgaguccugcagcaccaagugucagacggaaauugggggaauaaacacuaauaaaucguuucauucuguacacagaaacacaaucggugauugcccuaaguaugugaaugucaaaucccuuaaguuggccaccggccugaggaacgugccagcuauugccucacgggggcuauucggagcaaucgcuggcuuuauagaggguggguggccgggccucauuaauggaugguacggcuuccaacaccgcaacgaagaggggacuggaaucgccgcggacaaggaaaguacacagaaagccaucgaucagauuaccagcaagguuaauaacaucguggaccgaaugaauacgaacuuugguuccguccagcaugaguucucugagauugaagagagaauaaaucaacugagcaaacacguggaugacucaguaguugacaucuggaguuauaacgcacagcuucugguguugcucgaaaacgagaagacccuggauuuacaugacuccaaugucaggaaccugcacgaaaaagugcggcguaugcucaaggauaaugcuaaggacgagggcaacggguguuuuacauucuaccacaaaugcgauaaugaguguauugaacgcgucagaaacggaacuuaugaccauaaggaguuugaagaggagagcaaaaucaauaggcaggaaaucgagggcgugaagcuggauucuucagguaacguuuacaaaauucugaguauauauagcugcaucgccuccucuuuggugcuagcugcccugauuaugggguucauccucugggcaugcucgaauggcagcugucggugcaccauuuguaucuga

SEQ ID NO: 132353 - RNA, 1698 nt, Artificial Sequence
  derived and/or modified sequence opt3 from hemagglutinin__InfluenzaA__AGQ81205
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaggaacugagacuuaaguucagcggggugcuggaauuuaauaaauucgaggcuuuuaccaguaacggauggggcgccguuaauuccggcgcaggggugacugccacauguaaguucggaucuagcaacuccuuuuucaggaauauggucugguugauccaucaaucagguaccuacccugugauuaaacggacguuuaacaauacuaagggccgcgacguacucguugugugggggauccaccauccagcuacccugaaagagcaccaggaucuguauaagaaggacaguagcuacgucgcagugggaucugaaacauauaaccgacguuucauacccgagauuuccacuagaccuaaagugaacggccaggccgguaggaugaccuuuuacuggacaaucgucaagccaggggaaucaauuaccuucgagagcaauggagcuuuccucgcgccccgguacgccuuugaaaucguuagugugggcaacggcaaauuauuccgcucugagcugaauaucgaguccugcagcacgaagugucagacugaaauugggggaauaaacacaaauaaaucguuucauucuguacacagaaacaccaucggugauugcccuaaguaugugaaugucaaaucccuuaaguuggcaacuggccugaggaacgugccagccauugcuucacgggggcuauucggagccaucgcaggcuuuauagaggguggguggccgggccucauuaauggaugguacggcuuccaacaccgcaacgaagaggggacaggaaucgcugccgacaaggaaaguacccagaaagcgaucgaucagauuacgagcaagguuaauaacaucguggaccgaaugaauaccaacuuugaguccguccaguaugaguucucugaaauugaggaaagaauaaaucaacugagcaaacauguggaugacucaguaguugacaucuggaguuacaacgcccagcuucugguguugcucgagaacgaaaagacacuggauuuacacgacuccaaugucaggaaccugcaugagaaagugcggcguaugcucaaggauaaugcaaaggacgaggguaacggcuguuuuacuuucuaucacaaaugcgauaaugaauguauugagcgcgucagaaacgggaccuacgaccacaaggaauuugaggaggaaagcaaaaucaauaggcaggagaucgaaggagugaagcuggauucuucaggcaacguuuauaaaauucugaguauauacagcugcaucgcuuccucuuuggugcuagccgcucugauuauggguuucauccucugggccugcucgaaugggagcugucggugcacaauuuguaucuga

SEQ ID NO: 132354 - RNA, 1698 nt, Artificial Sequence
  derived and/or modified sequence opt3 from hemagglutinin__InfluenzaA__AGQ81206
augaagaaaacccuucucuucgccgcuaucuuucuuuacgcaaaggccgacgagauuugcauaggcuaucugagcaacaauuccacagauaaaguggacacuaucauugaaaacaaugucacgguuaccucuucaguggaguugguagaaacagagcacacugggaguuucuguagcaucaacggaaagcagcccauuuccuuaggugauugcucuuuugcgggcuggauccuggggaauccuaugugugacgaucuaauaggaaaaaccucguggucauacaucguggaaaagccaaacccggcuaauggcauuugcuaucccgguacacucgagaacgaggaggaacugagaagcaaguucagugggguccuugaauuuuccaaauucgaggccuuuaccucuaauggauggggcgcagugaacagcggcgccgggguuacugcugcauguaaguucggauccucaaauaguuucuucaggaacaugguguggcugauccaucaaagcgguacauacccugucauuaaacggaccuuuaauaacacgaagggccgcgacguguugguaguuugggggauccaccauccagccacucucaaagagcaccaggaucuguauaagaaggacucuuccuacguggcugucggaucagaaaccuauaaucgacguuucauacccgagauuagcacaagaccuaaagugaacggccaggccgguaggaugacuuuuuacuggaccaucgugaagccagaagagaguauuacauucgaaucuaacggggcguuccuggcaccccgguacgccuuugagaucgucuccguuggaaauggcaaacucuuccgcagcgaguuaaacaucgaaucgugcucuaccaagugucagacggagauuggcgggauaaauacuaacaaauccuuucauucagugcacagaaauacaaucggagauugcccuaaguauguaaacgugaaaagucugaagcuggcuaccgguuugaggaaugucccagccauugcaagccggggccuguucggggcuaucgccggauuuauagaaggcgguuggccggggcuaauuaacggcugguacggauuccaacaccgcaaugaggaaggcacugggaucgcggccgacaaggaguccacacagaaagcaaucgaucagauuaccucuaaggugaacaauaucguugaccgaaugaacacgaauuuugagagcgugcagcaugaauuuucagagauugaagagagaauaaaccaacucaguaaacacgucgaugacuccgugguagacaucuggagcuauaaugcucagcugcuuguucuguuggaaaacgagaagacccucgaucugcaugacucuaacgugaggaauuuacacgagaaaguccggcguaugcugaaggauaacgccaaggacgaaggaaaugguuguuuuacauucuaccacaaaugcgauaacgaguguauugaacgcgugagaaauggcacuuaugaccauaaggaguuugaggaagagucaaaaaucaacaggcaggaaaucgagggggucaagcucgauaguagcggaaauguguacaaaauucuuuccauauauucuugcaucgcuucgagccugauuuuggccgcacuaaucaugggcuucauucugugggccugcuccaacgguucaugucggugcaccaucuguauauga

SEQ ID NO: 132355 - RNA, 1698 nt, Artificial Sequence
  derived and/or modified sequence opt3 from hemagglutinin__InfluenzaA__AGQ81209
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaggaacugagacuuaaguucagcgggauccuggaauuuaguaaauucgaggcuuuuaccuccaauggauggggcgccgugaacucuggcgcagggguuacugccgcuuguaaguucggaagcuccaauucauuuuucaggaacauggugugguugauucaucaaagugguacauacccugucaucaaacggaccuuuaauaacacgaagggccgcgacgugcucauaguaugggggauucaccauccagcaacucugaaagagcaccaggaucuguauaagaaggacagcucuuacguugccgugggauccgaaaccuauaaucgacguuucauccccgagauuucaacaagaccuaaagucaacggccaggcugguaggaugacuuuuuacuggaccaucgugaagccaggggaaagcaucacauucgagaguaacggagccuuccucgcgccccgguacgcauuugaaauugugucugucggcaauggcaaauuauuccgcuccgagcugaacauagagagcugcucgaccaagugucagacggaaaucgggggaauuaauacuaacaaaucuuuucauuccguucacagaaauacaaucggugauugcccuaaguaugugaacguaaaaucacuuaaguuggccaccggccugaggaaugugccagcuauagccagucgggggcuauucggagcaauugcuggcuuuaucgaggguggguggccgggccucaucaacggaugguacggcuuccaacaccgcaaugaagaggggacuggaauugccgcggacaaggaaagcacacagaaagccaucgaucagauuaccuccaaggucaacaauauaguggaccgaaugaacacgaauuuugagucuguucagcaugaguucagcgaaaucgaggaaagaauuaaccaacugucaaaacacguggaugacagugucguggacaucugguccuauaaugcacagcuucugguauugcucgagaacgaaaagacccuggauuuacaugacagcaacguuaggaaucugcacgagaaagugcggcguaugcucaaggauaacgcuaaggacgaggguaauggcuguuuuacauucuaccacaaaugcgauaacgaauguaucgagcgcgucagaaaugggacuuaugaccauaaggaauuugaggaggaaucuaaaauuaacaggcaggagauagaaggagugaagcuggauucaaguggcaaugucuaccggauccugagcauuuauuccugcaucgccucuucguuggugcuagcugcccugauuauggguuucauccucugggcaugcagcaacggguccugucgaugcaccauauguaucuga

SEQ ID NO: 132356 - RNA, 1698 nt, Artificial Sequence
  derived and/or modified sequence opt3 from hemagglutinin__InfluenzaA__AGQ81211
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaagaacugagacuuaaguucagcggggugcuggaauuuaguaaauucgaggcuuuuaccuccaauggauggggcgccguuaacucuggcgcaggggugacugccgcuuguaaguucggaagcuccaauucauuuuucaggaacauggucugguugauccaucaaagugguacauacccugugauuaaacggaccuuuaauaacacgaagggccgcgacguacucaucguuugggggauacaccauccagcaacucugaaagagcaccaggaucuguauaagaaggacagcucuuacguggccgucggauccgaaaccuauaaucgacguuucauucccgagaucucaacaagaccuaaagugaacggccaggcugguaggaugacuuuuuacuggaccauugugaagccaggggaaagcaucacauucgagaguaacggagccuuccucgcgccccgguacgcauuugaaaucgucucuguuggcaauggcaaauuauuccgcuccgagcugaacauugagagcugcucgaccaagugucagacggaaauagggggaaucaauacuaacaaaucuuuucauuccgugcacagaaauacaauuggugauugcccuaaguauguaaacgugaaaucacuuaaguuggccaccggccugaggaaugucccagcuaucgccagucgggggcuauucggagcaauagcuggcuuuauugaggguggguggccgggccucaucaacggaugguacggcuuccaacaccgcaaugaagaggggacuggaaucgccgcggacaaggaaagcacacagaaagccauugaucagaucaccuccaaggugaacaauauuguugaccgaaugaacacgaauuuugagucugugcagcaugaguucagcgaaauagaggaaagaaucaaccaacugucaaaacacgucgaugacagugugguagacauuugguccuauaaugcacagcuucugguuuugcucgagaacgaaaagacccuggauuuacaugacuuuaacgugaggaaucugcacgagaaaguccggcguaugcucaaggauaacgcuaaggacgaggguaauggcuguuucacauuuuaccacaaaugcgauaacgaauguaucgagcgcgugagaaaugggacuuaugaccauaaggaguucgaggaggaaagcaaaaucaacaggcaggagauugaaggagucaagcuggauucuucaggcaauguguaccggauacugaguaucuauagcugcauugccuccucuuugguucuagcugcccugaucauggguuuuauucucugggcaugcucgaacgggagcugucgaugcaccaucuguauauga

SEQ ID NO: 132357 - RNA, 1698 nt, Artificial Sequence
  derived and/or modified sequence opt3 from hemagglutinin__InfluenzaA__AGQ81213
augaagaaaacccuucucuucgccgcuaucuuucuuuacgugagagcagacgagauuugcauaggcuaucugagcaacaauuccacagauaaggucgacacuaucauugaaaacaauguuacggugaccucuucaguagaguugguggaaacagagcacacugggaguuucuguagcaucaacggaaaacagcccauuuccuuaggugauugcucuuuugccggcuggauccuggggaauccuaugugugacggacuaauaggcaagaccucguggucauacaucgucgaaaaaccaaacccggcgaaugguauuugcuaucccgggacacucgagaacgaggaggaacugaggcuuaaguucagccgggugcuggaauuuaguaaguucgaggcuuuuaccuccaauggauggggcgccguuaacucuggcgcaggggugacugccgcuuguaaauucggaagcuccaauucauuuuuccgcaacauggucugguugauccaucaaagugguacauacccugugauuaagcgaaccuuuaauaacacgaaaggccgugauguacucguugugugggggauccaccauccagcaacucugaaggagcaccaggaccuguauaaaaaggauagcucuuacgucgccgugggauccgaaaccuauaauagaagguucauacccgagauuucaacacggccuacugugaacggccaggcuggucgcaugaccuuuuacuggacaaucgucaagccaggggaaagcauuaccuucgagaguaacggagccuuccucgcgcccagauacgcauuugaaaucguuucugugggcaauggcaaauuauucagguccgagcugaacaucgagagcugcucgacgaagugucagacugaaauugggggaauaaauacaaacaaaucuuuucauuccguacaccggaauaccaucggugacugcccuaaguaugugaacgucaaaucacuuaaguuggccacuggccugcgcaaugugccagcuauugccagucgagggcuauucggagcaaucgcuggcuuuauagaggguggguggccgggccucauuaacggaugguacggcuuccaacacagaaaugaagaggggacaggaaucgccgcggauaaagaaagcacccagaaggccaucgaccagauuacguccaagguuaacaauaucguggauaggaugaacaccaauuuugagucuguccagcaugaguucagcgaaauugaggaacggauaaaccaacugucaaaacacguggacgauaguguaguugacaucugguccuauaaugcacagcuucugguguugcucgagaacgaaaagacacuggacuuacaugauagcaacguccguaaucugcacgagaaagugcgcagaaugcucaaggacaacgcuaaagaugaggguaauggcuguuuuacuuucuaccacaagugcgacaacgaauguauugagaggguccggaaugggaccuaugaucauaaggaauuugaggaggaaucuaaaaucaaccgacaggagaucgaaggagugaagcuggacucaaguggcaauguuuacaaaauucugagcauauauuccugcaucgccucuucguuggugcuagcugcccugauuauggguuucauccucugggcaugcagcaacggguccugucgcugcacaauuuguaucuga

SEQ ID NO: 132358 - RNA, 1698 nt, Artificial Sequence
  derived and/or modified sequence opt3 from hemagglutinin__InfluenzaA__AGQ81214
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaggaacugagacuuaaguucagcggggugcuggaauuuaguaaauucgaggcuuuuaccuccaauggauggggcgccguuaacucuggcgcaggggugacugccgcuuguaaguucggaagcuccaauucauuuuucaggaacauggucugguugauccaucaaagugguacauacccugugauuaaacggaccuuuaauaacacgaagggccgcgacguacucaucguuugggggauacaccauccagcaacucugaaagagcaccaggaucuguauaagaaggacagcucuuacguggccgucggauccgaaaccuauaaucgacguuucauucccgagaucucaacaagaccuaaagugaacggccaggcugguaggaugacuuuuuacuggaccauugugaagccaggggaaagcaucacauucgagaguaacggagccuuccucgcgccccgguacgcauuugaaaucgucucuguuggcaauggcaaauuauuccgcuccgagcugaacauugagagcugcucgaccaagugucagacggaaauagggggaaucaauacuaacaaaucuuuucauuccgugcacagaaauacaauuggugauugcccuaaguauguaaacgugaaaucacuuaaguuggccaccggccugaggaaugucccagcuaucacaagucgggggcuauucggagccauagcaggcuuuauugaggguggguggccgggccucaucaacggaugguacggcuuccaacaccgcaaugaagaggggacuggaaucgcugccgacaaggaaagcacccagaaagcgauugaucagaucacguccaaggugaacaauauuguugaccgaaugaacaccaauuuugagucugugcagcaugaguucagcgaaauagaggguagaaucaaccaacugucaaaacacgucgaugacagugugguagacauuugguccuauaaugcccagcuucugguuuugcucgaaaacgagaagacacuggauuuacaugacagcaacgugaggaaucugcacgaaaaaguccggcguaugcucaaggauaacgcaaaggacgagggcaauggguguuuuacuuucuaccacaaaugcgauaacgaguguaucgaacgcgugagaaauggaaccuaugaccauaaggaguuugaagaggagucuaaaaucaacaggcaggaaauugagggcgucaagcuggauucaagugguaauguguacaaaauacugagcaucuauuccugcauugcuucuucguugguucuagccgcucugaucaugggguucauucucugggccugcagcaacggcuccugucggugcacaaucuguauauga

SEQ ID NO: 132359 - RNA, 1698 nt, Artificial Sequence
  derived and/or modified sequence opt3 from hemagglutinin__InfluenzaA__AGQ81215
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacggacuaauaggcaaaaccucguggucauacaucgucgaaaagccaaacccggcgaaugguauuugcuaucccgggacacucgagaacgaggaggagcugagacuuaaguucagcggaauccuggaauuuaguaaauucgaggcuuuuaccuccaauggcuggggcgccgugaacucuggggcaggaguuacugccgcuuguaaguucgguagcuccaauucauuuuucaggcauauggugugguugauucaccaaaguggcacauacccugucaucaaacggaccuuuaacaauacgaaggggcgcgaugugcucguaguuuggggaauacaucacccagcaacucugaaagagcagcaggaccuguauaagaaggauagcucuuacguggccgucggcuccgaaaccuauaaccgacguuucauucccgagaucucaacaagaccuaaagugaauggucaggcugggaggaugacuuuuuacuggaccauugugaagccaggagaaagcaucacauucgagaguaacggcgccuuccucgcgccccgguacgcauuugaaaucgucucuguuggcaacgggaaauuauuccgcuccgagcugaauauugagagcugcucgaccaagugucaaacggaaauaggagguaucaacacuaauaaaucuuuucauuccgugcacagaaacacaauuggcgacugcccuaaguauguaaaugugaaaucacuuaaguuggccaccgggcugaggaacgucccagcuaucgccagucggggacuauucggcgcaauagcugguuuuauugaagggggcuggccgggacucaucaauggcugguacggguuccagcaccgcaacgaagagggaacugguaucgccgcggauaaggaaagcacacagaaagccauugaccagaucaccuccaaggugaauaacauuguugaucgaaugaauacgaacuuugagucugugcaacaugaguucagcgaaauagaggaaagaaucaaucagcugucaaaacacgucgacgauagugugguagacauuugguccuauaacgcacagcuucugguuuugcucgagaaugaaaagacccuggacuuacaugauagcaacgugaggaaccugcacgagaaaguccggcguaugcucaaggacaaugcuaaggaugagggcaacggguguuuuacauucuaccacaaaugcgacaaugaauguaucgagcgcgugagaaacggaacuuaugaucauaaggaauuugaggaggaaucuaaaaucaauaggcaggagauugaaggcgucaagcuggacucaagugguaacguguacaaaauacugagcaucuauuccugcauugccucuucguugguucuagcugcccugaucaugggguucauucucugggcaugcagcaauggcuccugucggugcaccaucuguauauga

SEQ ID NO: 132360 - RNA, 1698 nt, Artificial Sequence
  derived and/or modified sequence opt3 from hemagglutinin__InfluenzaA__AGQ81216
augaagaaaacccuucucuucgccgcuaucuuucuuuacgugaaggcagacgagauuugcauaggcuaucugagcaacaauuccacagauaaagucgacacuaucauugaaaacaauguuacggugaccucuucaguagaguugguggaaacagagcacacugggaguuucuguagcaucaacggaaagcagcccauuuccuuaggugauugcucuuuugccggcuggauccuggggaauccuaugugugacgaucuaauaggaaaaaccucguggucauacaucgucgaaaagccaaacccggcgaauggcauuugcuaucccgguacacucgagaacgaggaagaacugagacuuaaguucagcggggugcuggaauuuaguaaauucgaggcuuuuaccuccaauggauggggcgccguuaacucuggcgcaggggugacugccgcuuguaaguucggaagcuccaauucauuuuucaggaacauggucugguugauccaucaaagugguacauacccugugaccaaacggacguuuaauaacacuaagggccgcgacguacucguugugugggggauucaccauccagcaacccugaaagagcaccaggaucuguauaagaaggacagcucuuacgucgccgugggauccgaaacauauaaucgacguuucacucccgagaucucaaccagaccuaaagugaacggccaggcugguaggaugacauuuuacuggaccauagucaagccaggggaaagcauuacguucgagaguaacggagccuuccucgcgccccgguacgcauuugaaaucguuucugugggcaauggcaaauuauuccgcuccgagcugaacauugagagcugcucgacuaagugucagacagaaaucgggggaaucaauaccaacaaaucuuuucauuccguacacagaaauacuauuggugauugcccuaaguaugugaacgucaaaucacuuaaguuggccacaggccugaggaaugugccagcuauagccaguaaggggcuauucggagcaaucgcuggcuuuauugaggguggguggccgggccucaucaacggaugguacggcuuccaacaccggaaugaagaggggaccggaauagccgcggacaaagaaagcacgcagaaggccauugaucagaucaccuccaaaguuaacaauaucguggaccgcaugaacacaaauuuugagucuguccgacaugaguucagcgaaauugaggaaagaaucaaccagcugucaaagcacguggaugacaguguaguugacauuugguccuauaaugcacaacuucugguguugcucgagaacgagaaaacucuggauuuacaugacagcaacgucaggaaucugcacgagcgggugcgucgcaugcucaaggauaacgcuaaggacgaggguaauggcuguuuuaccuucuaccacaaaugcgauaacgaauguauagagagagucaggaaugggacauaugaccauaaggaauuugaggaggaaucuaaaaucaaccggcaggagauugaaggagugaagcuggauucaaguggcaauguuuacaaaauccugagcaucuauuccugcauugccucuucguuggugcuagcugcccugauaauggguuucauccucugggcaugcgggaacggcagcugucgaugcacuauuuguaucuga

SEQ ID NO: 132361 - RNA, 1698 nt, Artificial Sequence
  derived and/or modified sequence opt3 from hemagglutinin__InfluenzaA__AGQ81217
augaagaaaacccuccuguucgccgcuaucuuucuuuacgcaaaggccgacgagauuugcauaggcuaucugagcaacaauuccacagauaaaguggacacuaucauugaaaacaaugucacgguuaccucuucaguggaguugguagaaacagagcacacugggaguuucuguagcaucaacggaaagcagcccauuuccuuaggugauugcucuuuugcgggcuggauccuggggaauccuaugugugacgaucuaauaggaaaaaccucguggucauacaucguggaaaagccaaacccggcuaauggcauuugcuaucccgguacacucgagaacgaggaagaacugagacuuaaguucagcgggguccuggaauuuaguagguucgaggccuuuaccuccaauggauggggcgcagugaacucuggcgccgggguuacugcugcauguaaauucggaagcuccaauucauuuuuccggaacauggugugguugauccaucaaagugguacauacccugucauuaagcgcaccuuuaauaacacgaaaggccgagacgugcucguaguuugggggauccaccauccagccacucugaaggagcaccaggaucuguauaaaaaggacagcucuuacguggcugucggauccgaaaccuauaaucguagauucauacccgagauuucaacaaggccuaaggugaacggccaggccggucggaugacuuuuuacuggaccaucgugaaaccagaagagagcauuacauucgaaaguaacggggcguuccucgcaccccgcuacgccuuugagaucgucucuguuggaaauggcaaguuauucagauccgagcugaacaucgaaagcugcucgaccaaaugucagacggagauuggcgggauaaauacuaacaagucuuuucauuccgugcacaggaauacaaucggagauugcccuaaauauguaaacgugaagucacuuaaauuggcuaccggucugcggaaugucccagccauugcaagucgcggccuauucggggcuaucgccggauuuauagaaggcgguuggccggggcucauuaacggcugguacggauuccaacaccgaaaugaggaaggcacugggaucgcggccgacaaggagagcacacagaaggcaaucgaucagauuaccuccaaagugaacaauaucguugacagaaugaacacgaauuuugagucugugcagcaugaguucagcgagauugaagagaggauaaaccaacugucaaagcacgucgaugacagugugguagacaucugguccuauaaugcucagcuucugguuuugcucgaaaacgagaaaacccuggauuuacaugacagcaacgugcggaaucugcacgagaagguccgucgcaugcucaaagauaacgccaaggacgaaggaaaugguuguuuuacauucuaccacaagugcgauaacgaguguauugaaagagugaggaauggcacuuaugaccauaaagaguuugaggaagagucuaagaucaaccggcaggaaaucgagggggucaaacuugauucaaguggaaauguguacaagauucugagcauauauuccugcaucgcuucuucguugauucuagccgcacugaucaugggcuucauucucugggccugcagcaacgguuccugucgaugcaccaucuguauauga

SEQ ID NO: 132362 - RNA, 1704 nt, Artificial Sequence
  derived and/or modified sequence opt3 from hemagglutinin__InfluenzaA__AGQ88499
auggagaagaucgugcuccuguucgccaccauuagccuugucaaauccgaccacauaugcaucggcuaccaugcuaacaauucuacagaacagguugauacuauuauggagaagaacgugacgguaacccacgcacaagacauccuggaaaagacacauaaugggaaguugugugauuuaaacggagugaaaccccugauucuaaaggacugcucagucgccgguuggcuccugggcaauccuaugugugaugaguuuaucaacgugccagaauggaguuauauaguugagaaggcgaauccggcuaacgaccuuugcuaccccgggaauuucaacgauuaugaggaacugaaacacuugcucagcagaaucaaucauuuugagaagauucagaucauuccuaaagacuccuggacugaucacgaagccucucugggagugucggcagccuguccauaccagggcaacagcucauucuuuaggaaugucguguggcugaucaagaaagacaacgcuuaucccaccauaaagaaggguuacaauaacacaaaccaggaggaucucuuaguacugugggggauucaccauccuaauaacgaggcagaacaaacccggcuuuaucagaauccaacuacauacaucaguauuggaaccuccacguugaaccagcgccugguucccaaaaucgccacucgaucuaagaucaauggccagagcggccguauugacuucuuuuggaccauacuaaaaccuaacgaugcuauccacuucgaguccaaugggaacuuuauugccccagaauacgcguauaagaucgugaaaaagggagacucaacaauaaugaaaagugaggucgaauacgguaauugcaacacuagaugucaaaccccgauuggcgcaaucaauagcucuaugcccuuccauaacauccacccucucacaauuggggagugcccaaaguaugugaaguccaauaaacuggugcuugccaccggacugaggaacucaccccagcgggagcgcagaaggaagcggggcuuguuuggugcuaucgccggguucauugaaggaggcuggcagggcauggucgacgggugguacggauaucaccauagcaaugagcaggguaguggcuacgcagcugauaaagaaucuacgcaaaaggccauagacgggguuacuaacaaagugaacuccaucauugauaagaugaauacacaguuugaggcgguaggacgcgaguucaacaaucucgaacgaagaaucgagaaccugaauaagaaaauggaagacggcuucuuagauguguggaccuauaacgccgagcugcucguccuuauggaaaaugagaggacucuggacuaccacgauagcaacgugcggaauuuguacgacaagguucgucuacagcugaaagauaacgcaaaggaacucgguaauggguguuuugaguucuaucauaaaugcaacaaugaguguauggaaucggugcgcaacggcacauacgacuauccucaauacucugaggaagcuagacugaagagggaggagaucuccggagucaaacuugaaucaauuggcauauaucagauccugaguauuuacagcaccguggccuccucuuugguacucgcuaucaugauggccgggcugagcuuauggaugugcucaaauggaagucugcagugccggauuuguaucuga

SEQ ID NO: 132363 - RNA, 1683 nt, Artificial Sequence; identical to SEQ ID NO: 132253
  derived and/or modified sequence opt3 from hemagglutinin__InfluenzaA__AGR33888

SEQ ID NO: 132364 - RNA, 1683 nt, Artificial Sequence; identical to SEQ ID NO: 132253
  derived and/or modified sequence opt3 from hemagglutinin__InfluenzaA__AGR33889

SEQ ID NO: 132365 - RNA, 1683 nt, Artificial Sequence
  derived and/or modified sequence opt3 from hemagglutinin__InfluenzaA__AGR33890
augaacacccagauccugguguucgcccucauugcuauaacacccacuaauagcgacaagaucugccuuggccaccaugcagucuccaacgggacgaaaguuaauacccugacagagagaggaguggaaguagugaacgccacugagaccgucgaaaggacaucuauuccucggaucuguucaaaggguaaacgcaccguggauuugggccaaugcggguuacugggaacuauuacaggcccaccgcagugugaccaguuucuagaguucagugcggaucucaucauagaacgacgugaggguagcgacguuugcuaccccgggaaguuugugaaugaggaagcucugagacagauccuuagggaguccggaggcauugauaaagaagccaugggcuucaccuauucugggauccggacgaacggagcaacuucggccugucgcagaucagguagcaguuuuuacgcugagaugaaguggcuguuguccaauaccgacaacgcagccuucccuccaaugacaaagucuuauaaaaauacuaggaaggcucccgcccucauuaucuggggcauacaccauagcgucuccaccgcggagcaaacaaaacuguacgggucaggaaacaagcuggugaccguacggaguagcaauuaucagcagucuuuuguuccuuccccaggcgcagguccccaggugaacgggcaaucaggacgcauugauuuccacuggcucauguuaaauccuaacgacacggucacuuuuagcuucaauggcgccuuuaucgcuccagaucgagccaguuuccugagaggcaaaucuauggggauucaguccggaguccagguggacgcaaacugcgaaggugauuguuaccauagcggcgggacaaucaucucgaaccuuccguuucagaauauugacucuagggugguuggaaagugcccccgguaugugaagcaaaaauccuugcugcuagcuaccggcaugaagaacguaccugagauaccaaaaggucguggccucuucggggccaucgcgggauucauugaaaauggcugggaggggcugaucgauggaugguacgguuuucgccaccagaacgcccagggcgaagggacugcagcugacuacaagucaacacaaagugccauaaaucagaugaccggaaaacuuaacagacugauugagaagacgaaucagcaguucgaguugaucgacaacgaauuuaccgagguggaaaaacaaaucggcaaugucauuaacuggacaagggauagcaucacugaggugugguccuauaaugcugaacuccugguugccauggagaaccagcacaccauugacuuagcagauucugagaugaauaagcuguacgaacgggugaagcgacagcuccgcgagaacgccgaagaggacgguacaggguguuucgaaauauuucauaaaugcgaugacgauuguauggcuagcaucagaaauaacacuuaugaccacucaaaguacagggaggaggcgaugcagaaccggauucaaaucgaucccgucaaacuuaguuccggcuauaaggacgugauccugugguucagcuuuggagcaucuugcuucauuuugcuagccauagcuaugggccugguauuuaucugcguuaaaaaugggaacaugcgcuguaccauuugcaucuga

SEQ ID NO: 132366 - RNA, 1683 nt, Artificial Sequence
  derived and/or modified sequence opt3 from hemagglutinin__InfluenzaA__AGR33892
augaacacccagauccugguguucgcccucauugcuauaauccccacaaaugcagacaagauuugccuuggccaccaugccgucagcaacgggacuaaaguuaauacgcugaccgagagaggaguggaaguagugaacgcgacagagacugucgaaaggaccuccaucccucggauuuguucuaaggguaaacgcacaguggauuugggccaaugcggguuacugggaaccaucacuggcccaccgcagugugaccaguuucuagaguucucagcugaucucauaaucgaacgacgugaggguagugacguuugcuaccccgggaaguuugugaaugaggaagcccugagacagauucuuagggagagcggaggcaucaacaaagaagcaaugggcuucacauauuccgggauucggaccaauggagccacgucugcuugucgcagaucggguagcagcuuuuacgcagagaugaaguggcuguugaguaacacugauaaugccgcuuucccuccaaugaccaaguccuauaaaaacacaaggaaggcccccgcgcucaucauauggggcauucaccauucugggagcacugcagagcaaaccaaacuguacggauccggcaauaagauggucacagugcggucaaguaacuaucagcagagcuuuguaccuucuccaggugccgggccccagguuaauggacaauccggccgcaucgacuuccacuggcugaugcucaacccuaaugauaccgugacguuuucauucaacggcgcuuuuauugccccagaccgagcaucauucuuaagagggaaaaguaugggaauccagucugguguccagguggaugcuaacugcgaaggcgacuguuaccauuccgggggaacuaucauuagcaaucugccguuucagaacauagauucgaggguggucggcaagugcccccgguauguuaagcaaaaaucucuuuugcuggccacagguaugaagaaugugccugagaucccaaaagggcguggccuauucggagcgauugccggcuucaucgaaaacgggugggagggacucauagacgguugguacggcuuucgccaccagaaugcacagggggaaggaaccgcugccgauuacaaguccacucaaucagcuauuaaccagaugacaggcaaacugaauagacuuaucgagaagaccaaccagcaguucgagcugaucgacaaugaauuuacggagguagaaaaacaaauugguaacgugaucaauuggaccagggacaguauuacagaggucuggagcuauaacgccgaauugcucguggcaauggagaaucagcacacuauagaucuggccgacuccgagaugaacaaguuauacgaacggguuaagcgacagcugcgcgagaaugcugaagaggaugggaccggcuguuucgaaaucuuucauaaaugcgacgaugacuguauggcgucuauuagaaacaacacauaugaucacagcaaguacagggaggaggcaaugcagaaucggauccaaaucgaccccgugaaacucucaaguggauauaaggaugucauucuuugguucuccuuuggcgccagcugcuucauacuguuggcuaucgccauggggcuaguguuuauuugcguagaaaacggaaauaugcgcuguacuaucugcauuuga

SEQ ID NO: 132367 - RNA, 1683 nt, Artificial Sequence; identical to SEQ ID NO: 132245
  derived and/or modified sequence opt3 from hemagglutinin__InfluenzaA__AGR33895

SEQ ID NO: 132368 - RNA, 1683 nt, Artificial Sequence; identical to SEQ ID NO: 132324
  derived and/or modified sequence opt3 from hemagglutinin__InfluenzaA__AGR33897

SEQ ID NO: 132369 - RNA, 1683 nt, Artificial Sequence
  derived and/or modified sequence opt3 from hemagglutinin__InfluenzaA__AGR33899
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggagcuccggucguuauucucaagcgcucgcaguuaccagcgaauacagaucuuuccugacacgauuuggaauguguccuauaacgguacuucuaaggccuguagcggguccuucuaccguucaaugagauggcugacccagaaaaauaguaacuauccaauccaagaugcacaguacacaaauaaccagggaaagaauauucuuuuuauguggggcaucaaccaucccccuacugacaccacacagagggauuuguacacccggacggacacuacaaccagcgucgccacugaggaaauaaaccgcauuuucaaaccacugaucggccccagaccucuagugaaugggcucaugggaaggauugauuauuacuggucuguacugaagccaggucaaacacuucggaucaaguccgacggcaaccugaucgcuccgugguaugggcacauuuugucaggagagagccauggccgcauacucaaaaccgaucugaagaaagguaguugcacgguucagugucagaccgaaaaagggggauuaaauacaacucugcccuuucagaacgugucuaaguacgcauucggcaauugcuccaaguauaucggcauuaagagccucaaacuugccgucgggcugcgaaacgugccuucgagaucuuccaggggauuguuuggugcuaucgccggcuucauagaagggggauggucaggccuaguggcggguugguacggguuucaacacaguaaugaccagggcgucggaauggcagccgaucgggacagcacccagaaggcuauugacaaaaucacauccaagguuaacaauaucguggauaaaaugaacaagcaauaugaaauuaucgaccacgaguucucugagguagaaacucgucugaauaugauuaacaauaaaauagaugaccagauccaggauauuugggccuacaacgcagagcuccuggugcuucuggaaaaucagaagaccuuggacgagcaugaugcuaacgucaacaaucucuacaacaaggugaaacgcgcccugggcagcaaugcgguugaagacgggaagggauguuuugaguuauaucacaaaugcgaugaccaauguauggagacaaucagaaacgguaccuacaauaggucaaaguaucaggaagagaguaaacuggaacggcagaagaucgagggcgugaagcuagaauccgaggggacuuacaaaauucucacgauauauagcacagucgccucuucacuggugaucgcaaugggauucgcugccuuucuuuucugggcuaugaguaacggcagcugccgaugcaauauuuguaucuga

SEQ ID NO: 132370 - RNA, 1683 nt, Artificial Sequence
  derived and/or modified sequence opt3 from hemagglutinin__InfluenzaA__AGR33900
auggagaccgugagccugaucacaauucuccuugucgccacuguuuccaacgcugacaagauaugcaucggcuaccagucuacuaauucaaccgaaacaguggauacucugaccgagaacaauguacccgugacacacgcaaaagaauuguuacauaccgagcacaacgggaugcugugugccacgagucuaggacaaccucucauucuggacacaugcaccaucgaaggucuuauuuauggcaauccaagcugugaucuguugcucgaggggagagagugguccuacaucgucgaaaggccgucugcggugaacggacugugcuaucccggcaauguugagaaccuggaggagcuccggucguuauucucaagcgcucgcaguuaccagcgaauacagaucuuuccugacacgauuuggaauguguccuauaacgguacuucuaaggccuguagcggguccuucuaccguucaaugagauggcugacccagaaaaauagugauuauccaauccaagacgcacaguacacaaacaaucagggaaagaacauucuuuuuauguggggcaucaaucaucccccuacugauaccacacagagggacuuguacacccggacggauacuacaaccagcgucgccacugaggaaauaaaccgcauuuucaaaccacugaucggccccagaccucuagugaacgggcucaugggaaggauugacuauuacuggucuguacugaagccaggucaaacacuucggaucaaguccgauggcaaucugaucgcuccgugguaugggcacauuuugucaggagagagccauggccgcauacucaaaaccgaccugaagaaagguaguugcacgguucagugucagaccgaaaaagggggauuaaacacaacucugcccuuucagaaugugucuaaguacgcauucggcaacugcuccaaguauaucggcauuaagagccucaaacuugccgucgggcugcgaaaugugccuucgagaucuuccaggggauuguuuggugcuaucgccggcuucauagaagggggauggucaggccuaguggcggguugguacggguuucaacacaguaacgaucagggcgucggaauggcagccgaccgggacagcacccagaaggcuauugauaaaaucacauccaagguuaauaacaucguggacaaaaugaauaagcaauaugaaauuaucgaucacgaguucucugagguagaaacucgucugaacaugauuaauaacaaaauagacgaucagauccaggacauuugggccuacaaugcagagcuccuggugcuucuggaaaaccagaagaccuuggaugagcaugacgcuaaugucaacaaccucuacaauaaggugaaacgcgcccugggcagcaacgcgguugaagaugggaagggauguuuugacuuauaucacaaaugcgaugaccaauguauggagacaaucagaaaugguaccuacaacaggcggaaguaucaggaggaaucaaaacuggagcgacagaagaucgaaggcgugaagcuagagagugaagggacuuacaaaauucucacgauauauuccacagucgccagcucucuggugaucgcaaugggauucgcugccuuucuuuucugggcuaugucaaauggcaguugccgcugcaacauuuguaucuga

SEQ ID NO: 132371 - RNA, 1683 nt, Artificial Sequence
  derived and/or modified sequence opt3 from hemagglutinin__InfluenzaA__AGR33902
auggagaccgccagccugaucacaauucuccuuguggcuacugucuccaacgcagacaagauaugcaucggcuaccagucuacuaauucaaccgaaacaguugauacucugaccgagaacaaugugcccguaacacacgccaaagaauuguuacauaccgagcacaacgggaugcugugugcgacgagucuaggacaaccucucauucuggacacaugcaccaucgaaggucuuauuuauggcaauccaagcugugaucuguugcucgaggggagagagugguccuacaucguggaaaggccgucugcugucaacggacugugcuaucccggcaauguggagaaccuggaggagcuccggucguuauucucaagcgcccgcaguuaccagcgaauacagaucuuuccugacacgacuuggaauguuuccuauaacgguauuucuaaggcauguagcggguccuucuaccguucaaugagauggcugacccagaaaaauaguaacuauccaauccaagaugcccaguacacaaauaaccagggaaagaauauucuuuuuauguggggcaucaaccaucccccuacugacaccacacagagggauuuguacacccggacggacacuacaaccagcguggcuacugaggaaauaaaccgcauuuucaaaccacugaucggccccagaccucuagucaaugggcucaugggaaggauugauuauuacuggucugugcugaagccaggucaaacacuucggaucaaguccgacggcaaccugaucgcaccgugguaugggcacauuuugucaggagagagccauggccgcauacucaaaaccgaucugaagcgagguaguugcacgguacagugucagaccgaaaaagggggauuaaauacaacucugcccuuucagaacguuucuaaguacgccuucggcaauugcuccaaauauaucggcauuaagagccucaaacuugcuguggggcugagaaacgucccuucgaggucuucccggggauuguuuggugccaucgcgggcuucauagaagggggauggucaggccuaguggcagguugguacggguuucaacacaguaaugaccagggcgugggaauggccgcugaucgugacagcacccagaaggccauugacaagaucacauccaaagucaacaauaucguugauaagaugaacaaacaauaugaaauuaucgaccacgaguucucugagguggaaacucgccugaauaugauuaacaauaagauagaugaccagauccaggauauuugggcauacaacgcugagcuccugguacuucuggaaaaucagaaaaccuuggacgagcaugaugccaacgugaacaaucucuacaacaaggucaagagagcgcugggcagcaaugccguggaagacgggaaaggauguuuugaguuauaucacaagugcgauaaccaauguauggagacaaucaggaaugguaccuacaaccggcgaaaauaucaggaagagucaaagcuggaacgccagaaaaucgagggcguuaagcuagaaagugaggggacuuacaagauucucacgauauauuccacaguggcaagcucucuggucaucgcuaugggauucgccgcuuuucuuuucugggccaugucaaauggcaguugcagaugcaacauuuguaucuga

SEQ ID NO: 132372 - RNA, 1698 nt, Artificial Sequence; identical to SEQ ID NO: 127529
  derived and/or modified sequence opt3 from hemagglutinin__InfluenzaA__AGR49817

SEQ ID NO: 132373 - RNA, 1698 nt, Artificial Sequence
  derived and/or modified sequence opt3 from hemagglutinin__InfluenzaA__AGR49841
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacucucacaaugggaaacuaugccuccugaagggaauagcgccccuucagcuggguaacuguucaguggccggcuggaucuuggggaauccugagugcgaacuccugauuaguaaagagagcugguccuacaucguugaaaagccaaacccggagaauggaaccuguuaucccggccauuuugcugauuacgaggaacugagagagcaacucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggcaaaaauggauuguaccccaaccugagcaagucuuaugcaaauaacaaagagaaggaaguucuaguacucuggggcgugcaccacccuccaaacaucgucgaccagaaaacgcuguaccgcacugagaaugccuacguguccguggucucaagccauuauagucgaaaguucacccccgaaauagcuaagcguccuaaaguuagagaucaggaggggaggaucaacuacuauuggacacuucuggagccacgggacacuauuaucuuugaagcaaauggaaacuugauugccccgcgcuacgcuuucgcccucucuagagguuuuggcuccgggaucauaaauagcaacgcgcccaugggaaagugugaugcaaaaugccagaccccucaaggcgccauuaauucgucucugccauuccagaacgugcaccccguaacaaucggugaguguccuaaguaugugagguccgcuaaauuacggauggucaccgggcugcgcaauauuccaucaauccagagucgaggacucuuuggcgccaucgcaggcuucauugaagggggauggacggguaugguggacggcugguacggguaucaucaccagaacgagcaaggaagcggcuacgcugccgaucagaaguccacucagaaugcgauaaacgguaucacaaauaaaguuaacucugugauugaaaagaugaauacccaguuuacugccgucgggaaggaguucaacaaacuugagagaaggauggaaaaccugaauaagaaaguggacgauggcuucaucgacauauggacauacaacgcagaguugcuaguacugcucgaaaaugagcggacccuggauuuucacgacagcaacguuaagaaucuuuaugaaaaagugaagucacaacugaagaacaaugcuaaagagauuggaaacggcugcuucgaguuuuaccauaaguguaaugacgaaugcauggagagugucaaaaacgggacguaugauuaccccaaguauuccgaagagagcaaauugaaucgugagaagaucgacggagugaagcucgaaucuaucggugucuaccagauucuggccaucuauucaaccguggcuaguagcuuaguucugcuagugucccucggcgccauuucuuucuggaugugcucgaacgggagccugcagugucgcauaugcaucuga

SEQ ID NO: 132374 - RNA, 1698 nt, Artificial Sequence; identical to SEQ ID NO: 127529
  derived and/or modified sequence opt3 from hemagglutinin__InfluenzaA__AGR49853

SEQ ID NO: 132375 - RNA, 1698 nt, Artificial Sequence
  derived and/or modified sequence opt3 from hemagglutinin__InfluenzaA__AGR49865
augaaggugaaacugcucguccuucugugcaccuucacagccacuuacgcugacacgaucuguauuggcuaucacgcaaacaauagcaccgauacaguugacacuguguuggagaagaacguaaccgugacacauuccgucaauuuacuggaaaacaaucacaacgggaaacuaugccuccugaagggaauagcgccccuucagcuggguaauuguucuguggccggcuggaucuuggggaacccugagugcgaacuccugauuucaaaagagaguuggagcuacaucguugaaaagccaaauccggagaacggaaccuguuaucccggccauuuugcugauuacgaggaacugagagagcaacucuccucugugucgucauucgaaagguuugagauuuucccuaaggagagcaguuggccaaaucacacugucacagguguguccgccucuugcagccauaacggggaauccucauuuuaucggaauuuacuguggcuuaccggcaaaaacggauuguaccccaaucugaguaagagcuaugcaaacaacaaagagaaggaaguucuaguacucuggggcgugcaccacccuccaaauaucgucaaccagaaaacgcuguaccgcacugagaaugccuacgugucuguggucuccucacauuauagccgaaaguucacccccgaaauagcuaagcguccuaaaguuagagaccaggaggggaggaucaacuacuauuggacacuucuggagccaggagauacuauuaucuuugaagcaaaugguaacuugauugccccgcgguacgcuuucgcccucaaucgcggcuuugggaguggaaucauaaacucuaaugcgcccauggacaagugugaugcaaaaugccagaccccucaaggcgccauuaacuccagccugccauuccagaaugugcaccccguaacaaucggugaguguccuaaguaugugagaucggcuaaauuaaggauggucaccgggcugcggaacauuccaucuauccagucccgcggacucuuuggcgccaucgcaggcuucauugaagggggauggacggguaugguggacggcugguacggguaucaucaccagaaugagcaaggaucaggcuacgcugccgaucagaagaguacucagaacgcgauaaaugguaucacaaacaaaguuaacagcgugauugaaaagaugaauacccaguuuacugccgucgggaaggaguucaacaaacuugagcgaagaauggaaaaucugaacaagaaaguggacgauggcuucaucgacguauggacauacaaugcagaguugcuaguucugcucgaaaacgagaggacccuggauuuucacgacuccaaugugaagaaccuuuaugaaaaagucaagucucaacugaagaauaacgcuaaagagauaggaaauggcugcuucgaguuuuaccauaaguguaacgacgaaugcauggagagcgugaaaaaugggacguaugauuaccccaaguauucagaagagaguaaauugaaccgggagaagauugacggagucaagcucgaauccauggguguguaccagauccuggccaucuauagcaccguugcuucuucauuagugcugcuaguaagucucggcgccauuagcuucuggaugugcuccaaugggucucugcagugucguaucugcauuuga

SEQ ID NO: 132376 - RNA, 1701 nt, Artificial Sequence; identical to SEQ ID NO: 124672
  derived and/or modified sequence opt3 from hemagglutinin__InfluenzaA__AGR49877

SEQ ID NO: 132377 - RNA, 1701 nt, Artificial Sequence; identical to SEQ ID NO: 124450
  derived and/or modified sequence opt3 from hemagglutinin__InfluenzaA__AGR49888

SEQ ID NO: 132378 - RNA, 1701 nt, Artificial Sequence
  derived and/or modified sequence opt3 from hemagglutinin__InfluenzaA__AGR49900
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaaguguuaccccuaugacgucccugauuacgcaucguugaggucacucguggccagcaguggcacucuggaauuuaauaacgaguccuucaauuggacagguguuacccagaacgggacgucuagcgcuugcauccggcgcuccaauaacucauuuuucagucgacugaauuggcucacucauuuaaaguuuaaauauccagcacugaacgugaccaugcccaauaacgagaaguucgacaaacuuuacauuuggggaguccaccauccuggcacagauaacgaccagaucuuuuuguaugcccaggcuagcggccguauuacugugucuaccaagagaucccaacagacaguaaucccaaauauagggucaaggccccggguucgcaacauuccuagcagaaucaguauuuacuggaccaucgugaaaccaggagauauccugcuaauuaauucuacggguaaccucauagccccgaggggcuacuucaagauccgguccggaaagagcucgauuaugcgcucugacgcgcccaucgggaaauguaauuccgaaugcauaacuccuaacggcucaauuccaaaugacaagcccuuucagaacgucaaucgaaucacauauggugcauguccuagauacgugaaacagaacacccugaagcuggccacugggaugaggaaugugccagagaaacaaacacggggaaucuucggcgcuauugccggcuuuaucgaaaacgggugggagggaauggucgaugguugguauggcuuccgucaccagaauagugaggggauuggacaggcagcugaccuuaagagcacccaagccgcgauagaucagaucaacggcaaauugaaucgccucauugguaagacgaacgaaaaguuccaccagaucgagaaagaauuuuccgagguugaagggagaauccaggaccuggagaaguacguggaggauaccaaaauugacuuauggucuuauaacgccgaacugcucguagcacuugagaaucaacauacaauagaucugacugacagcgaaaugaacaaguuguucgagaaaaccaagaagcagcuaagggaaaaugcugaggauaugggcaacggaugcuuuaaaaucuaccacaagugugacaaugccugcauuggcucaauccggaacgggacauaugaucaugacguguaccgagacgaggcucugaauaaccgcuuccagauuaaaggagucgaacucaagagugguuacaaagauuggauccuguggauauccuuugccaucagcugcuuccuucuguguguggcauugcucggcuuuauuaugugggccugccagaaggggaauaucagauguaacauuugcaucuga

SEQ ID NO: 132379 - RNA, 1701 nt, Artificial Sequence
  derived and/or modified sequence opt3 from hemagglutinin__InfluenzaA__AGR49912
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacuccccacaccagauccuagauggcgaaaauuguacccucauagacgcucugcuuggggauccgcagugcgacggauuccaaaacaaaaagugggaucuguuuguggagagaucuaaagccuauucgaauuguuaccccuaugacgucccugauuacgcaucauugaggagccucguggccaguuccggcacucuggaguucaacaaugaaucuuuuaacuggacagguguuacccagaaugggacgagcuccgcuugcauccggcgcucaaacaauaguuucuuuagccgacugaacuggcucacucauuuaaaguucaaguauccagcacugaaugugaccaugcccaacaacgaggaauuugacaaacuuuacauuuggggaguccaccauccuggcacagauaaugaccagaucuucuuguaugcccaggcuucuggccguauuacuguguccaccaagagaucacaacagacaguaaucccaaacauagggagcaggccccggguucgcaauauuccuaguagaaucucuauuuacuggaccaucgugaaaccaggagauauccugcuaauuaacuccacggguaaucucauagccccgaggggcuacuuuaagauccggagcgggaaaucgucuauuaugcgcuccgacgcgcccaucggaaaguguaacucaaagugcauaacuccuaauggcaguauuccaaacgacaaacccuuccagaaugucaaccgaaucacauauggugcauguccuagauacgugaagcagaauacccugaaacuugccacugggaugaggaacgugccagagaagcaaacacggggaaucuuuggcgcuauugccggcuucaucgaaaaugggugggagggaauggucgaugguugguauggcuuucgucaccagaacagcgaggggauuggacaggcagcugaccugaaauccacccaagccgcgauagaucagaucaauggcaaguugaaccgccucauugguaaaacgaacgaaaaguuccaccagaucgagaaggaguucucugaaguugaagggagaauccaggaccuggagaaauacguggaggauaccaagauugacuuauggagcuauaaugccgaacugcucguagcacuugagaaccaacauacaauagaucugacugacucagaaaugaauaaauuguuugagaagaccaaaaagcagcuaagggaaaacgcugaggauaugggcaauggaugcuucaagaucuaccacaaaugugacaacgccugcauuggcaguauccggaaugggacauaugaucaugacguguaccgagacgaggcucugaacaaucgcuuucagauuaagggagucgaacucaaauccgguuacaaggauuggauccuguggaucagcuucgccauaucuugcuuucuucuguguguggcauugcucggcuucauuaugugggccugccagaaagggaacaucagauguaauauuugcaucuga

SEQ ID NO: 132380 - RNA, 1701 nt, Artificial Sequence
  derived and/or modified sequence opt3 from hemagglutinin__InfluenzaA__AGR49924
augaagaccaucauugcccugagcuacauacucugccuuguguccgcucagaaacugcccggcaacgacaauucuacagcaacuuuguguuuagggcaccaugccgucccuaacggaacgaucguuaagaccauuacaaaugaucaaaucgaggugacuaacgcgaccgaacugguacagucaaguagcacaggugagauuugcgacuccccacaccagauccuagauggcgaaaauuguacccucauagacgcucugcuuggggauccgcagugcgacggauuccaaaacaaaaagugggaucuguuuguggagagaucuaaagccuauucgaauuguuaccccuaugacgucccugauuacgcaucauugaggagccucguggccaguuccggcacucuggaguucaacaaugaaucuuuuaacuggacagguguuacccagaaugggacgagcuccgcuugcauccggcgcucaaacaauaguuucuuuagccgacugaacuggcucacucauuuaaaguucaaguauccagcacugaaugugaccaugcccaacaacgaggaauuugacaaacuuuacauuuggggaguccaccauccuggcacagauaaugaccagaucuucuuguaugcccaggcuucuggccguauuacuguguccaccaagagaucacaacagacaguaaucccaaacauagggagcaggccccggguucgcaauauuccuaguagaaucucuauuuacuggaccaucgugaaaccaggagauauccugcuaauuaacuccacggguaaucucauagccccgaggggcuacuuuaagauccggagcgggaaaucgucuauuaugcgcuccgacgcgcccaucggaaaguguaacucaaagugcauaacuccuaauggcaguauuccaaacgacaaacccuuccagaaugucaaccgaaucacauauggugcauguccuagauacgugaagcagaauacccugaaacuugccacugggaugaggaacgugccagagaagcaaacacggggaaucuuuggcgcuauugccggcuucaucgaaaaugggugggagggaauggucgaugguugguauggcuuucgucaccagaacagcgaggggauuggacaggcagcugaccugaaauccacccaagccgcgguugaucagauaaauggcaaguugaaccgccucaucgguaaaacgaacgaaaaguuccaccagauugagaaggaguucucugaaguggaagggagaauccaggaccuggagaaauacguagaggauaccaagaucgacuuauggagcuauaaugccgaacugcucguggcacuugagaaccaacauacaauugaucugacugacucagaaaugaauaaauuguuugagaagaccaaaaagcagcuaagggaaaacgcugaggauaugggcaauggaugcuucaagauauaccacaaaugugacaacgccugcaucggcaguauucggaaugggacauaugaucaugacgucuaccgagacgaggcucugaacaaucgcuuucagaucaagggaguggaacucaaauccgguuacaaggauuggauucuguggaucagcuucgccauaucuugcuuucuucuguguguugcauugcucggcuucaucaugugggccugccagaaagggaacauuagauguaauaucugcauuuga

SEQ ID NO: 132381 - RNA, 1701 nt, Artificial Sequence
  derived and/or modified sequence opt3 from hemagglutinin__InfluenzaA__AGR49936
augaagaccaucauugcccugagcuacauacucugccuuaucuccgcucagaaauuccccggcaacgacaauucuacagcaacucuguguuuggggcaccaugccgugccuaacggaacgauugucaagaccaucacaaaugaucaaauugagguuacuaacgcgaccgaauuagugcagucaaguagcacaggugagaucugcgacuccccacaccagauacuggauggcgaaaauuguacccuaaucgacgcucuccugggggauccgcagugcgacggauuucaaaacaaaaagugggaucuuuucguagagagaucuaaagccuauucgaauuguuaccccuaugacgugccuggcuacgcaucacugaggagcuuggucgccaguuccgguacucucgaauuuaacaaugagucuuucaacuggacaggggugacccagaauggaacgagcuccgcuugcauucggcgcucaaacaauaguuucuucagccgacugaacuggcugacucaucucaaguuuaaguauccagcauuaaauguuaccaugcccaacaacgaggaauuugauaaacuguacaucuggggcgugcaccauccuggcacagacaaugaucagauuuuucuuuaugcccaggcuucugggcguaucacugucuccaccaagagaucacaacagacagugauaccaaacauuggaagcaggccccggguacgcaauaucccuaguagaauuucuaucuacuggaccaucguuaaaccaggugacauuuugcugauaaacuccacgggcaaucuaaucgccccgaggggguacuucaagauucggagcggaaaaucgucuaucaugcgcuccgaugcgcccauaggcaaguguaacucagagugcauuacuccuaaugguaguaucccaaacgacaagcccuuucagaaugugaaccgaaucacauauggggcauguccuagauacgucaaacagaauacccucaagcuggccacuggaaugaggaacgugccagaaaaacaaacacggggcauuuucggcgcuaucgccggguuuauugagaauggaugggaggguaugguggacggcugguauggguuccgucaccagaacagcgaaggaauaggccaggcagcugaucuuaaguccacccaagccgcgaucgaccagauuaaugguaaacugaaccgcuugaucgggaagacgaacgagaaauuccaccagaucgaaaaggaguuuucugaagucgagggcaggauucaggaucucgagaaguacguugaagacaccaaaauagaucuguggagcuauaaugccgaguuacugguggcacucgaaaaccaacauacaaucgaccuuacugauucagagaugaauaagcuguucgagaaaaccaagaaacaguugagagaaaacgcugaggacaugggaaauggcugcuuuaagauuuaccacaagugugauaacgccugcaucgggaguauucggaauggaacauaugaccaugauguauaccgagacgaagcucuaaacaaucgcuuccagaucaaagguguggagcugaaguccggcuacaaagacuggauacucuggaucagcuuugccauuucuugcuuccugcuuugugucgcacuguugggguuuaucaugugggccugccagaagggaaacauuagauguaauaucugcauauga

SEQ ID NO: 132382 - RNA, 1701 nt, Artificial Sequence; identical to SEQ ID NO: 129710
  derived and/or modified sequence opt3 from hemagglutinin__InfluenzaA__AGR49948

SEQ ID NO: 132383 - RNA, 1701 nt, Artificial Sequence; identical to SEQ ID NO: 124543
  derived and/or modified sequence opt3 from hemagglutinin__InfluenzaA__AGR49960

SEQ ID NO: 132384 - RNA, 1701 nt, Artificial Sequence
  derived and/or modified sequence opt3 from hemagglutinin__InfluenzaA__AGR49972
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacuauuguggaacccggugacaagaucaccuucgaggccacaggcaaccuggucguuccuagguacgcuuuugccauggaacggaacgcagggucgggaauaauuaucucugauacuccagugcaugacugcaauaccacaugucaaaccccgaaaggcgcuauuaacacgucccuacccuuccagaauauccacccuaucacuauugguaagugcccaaaguauguaaaaucaacaaagcuccgccuggccaccgggcuuagaaacgugcccaguauacagagcaggggacuguuuggcgcgaucgccggcuucauugaagggggauggacugguauggucgacggcugguacggguaucaucaccagaaugaacaaggauccggcuacgcagcugauuugaaaucuacacagaacgccaucgacgagauaaccaauaaggugaacagcguuauugagaaaaugaauacgcaguuuaccgcuguggguaaggaguucaaccaccucgaaaagcggaucgaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaauuggcaacggauguuuugaguucuaucacaagugcgacaauaccuguauggaauccgugaaaaacggcacauacgauuauccuaaguacagcgaggaagccaaacucaauagagaggagaucgacggggucaagcuggaaucuacuaggauuuaucaaauacuugcuaucuacucaaccguggcgaguagccuggucuuggugguuucccucggagcaauuucuuuuuggaugugcucgaacgguagccugcagugccggaucuguaucuga

SEQ ID NO: 132385 - RNA, 1698 nt, Artificial Sequence; identical to SEQ ID NO: 128714
  derived and/or modified sequence opt3 from hemagglutinin__InfluenzaA__AGR49983

SEQ ID NO: 132386 - RNA, 1698 nt, Artificial Sequence; identical to SEQ ID NO: 128714
  derived and/or modified sequence opt3 from hemagglutinin__InfluenzaA__AGR49995

SEQ ID NO: 132387 - RNA, 1701 nt, Artificial Sequence; identical to SEQ ID NO: 124672
  derived and/or modified sequence opt3 from hemagglutinin__InfluenzaA__AGR50007

SEQ ID NO: 132388 - RNA, 1701 nt, Artificial Sequence; identical to SEQ ID NO: 124672
  derived and/or modified sequence opt3 from hemagglutinin__InfluenzaA__AGR50018

SEQ ID NO: 132389 - RNA, 1701 nt, Artificial Sequence; identical to SEQ ID NO: 124672
  derived and/or modified sequence opt3 from hemagglutinin__InfluenzaA__AGR50029

SEQ ID NO: 132390 - RNA, 1701 nt, Artificial Sequence
  derived and/or modified sequence opt3 from hemagglutinin__InfluenzaA__AGR50040
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacagucuucaaguacaggugagauuugcgacagcccacaccagauccuagauggcgaaaauuguacccucauagacgcucugcuuggggauccgcagugcgacggauuucaaaacaaaaagugggaucuguucguggagagauccaaagccuauucuaauuguuaccccuaugacgucccugauuacgcaucguugaggucacucguggccagcaguggcacucuggaauuuaacaaugaguccuucaacuggacagguguuacccagaaugggacgucuagcgcuugcauccggcgcuccaacaauucauuuuucagucgacugaacuggcucacucauuuaaaguuuaaguauccagcacugaaugugaccaugcccaacaacgagcaguucgacaaacuuuacauuuggggaguccaccauccuggcacagauaaugaccagaucuuuuuguaugcccaagcuagcggccguauuacugugucuaccaagagaucccagcagacaguaaucccaaacauagggucaaggccccggguucgcaauauuccuagcagaaucaguauuuacuggaccaucgugaaaccaggagauauccugcuaauuaacucuacggguaaucucauagccccgaggggcuacuucaagauccgguccgggaaaagcucgauuaugcgcucugacgcgcccaucggaaaguguaacuccgaaugcauaacuccuaauggcucaauuccaaacgacaagcccuuucagaaugucaaccgaaucacauauggugcauguccuagauacgugaaacaaaauacccugaagcuggccacugggaugaggaacgugccagagaaacagacacggggaaucuucggcgcuauugccggcuuuaucgaaaaugggugggagggaauggucgaugguugguauggcuuccgucaccagaacagugaggggcgcggacaagcagcugaccuuaagagcacccaggccgcgauugaucagauaaauggcaaauugaacagacucaucgguaagacgaacgaaaaauuccaccagauugagaaggaauuuuccgagguugaagggaggauccaagaccuggagaaguacguggaggauaccaaaaucgacuuauggucuuauaaugccgaacugcucguagcacuugagaaccagcauacaauugaucugacugacagcgaaaugaauaaguuguucgagaaaaccaagaaacagcuacgggaaaacgcugaggauaugggcaauggaugcuuuaagauauaccacaagugugacaacgccugcaugggcucaauccgaaaugggacauaugaucaugacguguaccgcgacgaggcucugaacaauagauuccagauuaaaggagucgaacucaagagugguuacaaagauuggauccuguggauuuccuuugccaucagcugcuuccuucuguguguggcauugcucggcuuuauaaugugggccugccaaaaggggaacaucagguguaauauuugcaucuga

SEQ ID NO: 132391 - RNA, 1701 nt, Artificial Sequence; identical to SEQ ID NO: 124672
  derived and/or modified sequence opt3 from hemagglutinin__InfluenzaA__AGR50052

SEQ ID NO: 132392 - RNA, 1701 nt, Artificial Sequence; identical to SEQ ID NO: 124672
  derived and/or modified sequence opt3 from hemagglutinin__InfluenzaA__AGR50063

SEQ ID NO: 132393 - RNA, 1701 nt, Artificial Sequence
  derived and/or modified sequence opt3 from hemagglutinin__InfluenzaA__AGR50074
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcguaaucaggagggaagaaugaacuacuauuggacucugguggaacccggugauaagauuaccuucgaggccacaggcaaccuagucguuccuagguacgcuuuugccauggaacggaaugcagggucgggaaucauaauuucugacacuccagugcaugauugcaacaccacaugucaaaccccgaaaggcgcuaucaauacgucccuccccuuccagaacauucacccuaucacuaucgguaagugcccaaaguauguaaaaucaacaaagcugcgccuugccaccgggcugagaaaugugcccaguauucagagcaggggauuguuuggcgcgauagccggcuucaucgaagggggauggacugguauggucgacggcugguacggguaucaucaccagaacgaacaaggauccggcuacgcagcugaccucaaaucuacacagaaugccauugaugagaucaccaacaaggugaauagcguuauagagaaaaugaacacgcaguuuaccgcuguggguaaggaguucaaucaccuggaaaagcggauugaaaacuuaaauaaaaaggucgacgauggguuccuggacaucuggacauacaacgccgagcuccuugugcuguuggaaaaugagcgcacucuagauuaucaugacucaaacguaaagaaccuguacgagaagguucgaagucagcucaaaaauaacgcaaaggaaaucggcaauggauguuuugaguucuaucacaagugcgauaacaccuguauggaauccgugaaaaauggcacauacgacuauccuaaguacagcgaggaagccaaacugaacagagaggagauugauggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 132394 - RNA, 1701 nt, Artificial Sequence; identical to SEQ ID NO: 124672
  derived and/or modified sequence opt3 from hemagglutinin__InfluenzaA__AGR50085

SEQ ID NO: 132395 - RNA, 1701 nt, Artificial Sequence; identical to SEQ ID NO: 124672
  derived and/or modified sequence opt3 from hemagglutinin__InfluenzaA__AGR50096

SEQ ID NO: 132396 - RNA, 1701 nt, Artificial Sequence; identical to SEQ ID NO: 124672
  derived and/or modified sequence opt3 from hemagglutinin__InfluenzaA__AGR50107

SEQ ID NO: 132397 - RNA, 1701 nt, Artificial Sequence; identical to SEQ ID NO: 124865
  derived and/or modified sequence opt3 from hemagglutinin__InfluenzaA__AGR50118

SEQ ID NO: 132398 - RNA, 1701 nt, Artificial Sequence
  derived and/or modified sequence opt3 from hemagglutinin__InfluenzaA__AGR50129
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucggucagugcccaaaguauguaaagucaacaaaacugcgccuugccaccgggcugagaaacgugcccaguauucagagcaggggauuguuuggcgcgauagccggcuucaucgaagggggauggacugguauggucgacggcugguacggguaucaucaccaaaaugaacagggauccggcuacgcagcugaucucaagucuacacagaacgccauugacgagaucaccaauaaagugaacagcguuauagagaagaugaauacgcaguuuaccgcuguggguaaagaguucaaccaccuggaaaagcggauugaaaauuuaaacaagaaagucgaugacggguuccuggauaucuggacauacaaugccgagcuccuugugcuguuggaaaacgagcgcacucuagacuaucaugauucaaauguaaagaaccuguacgagaaaguucgaagucaacucaagaacaaugcaaaagaaaucggcaacggauguuuugaguucuaucacaagugcgacaauaccuguauggaauccgugaagaacggcacauacgauuauccuaaauacagcgaggaagccaagcugaauagagaggagauugacggggucaaacuugaaucuacuaggaucuaucagauucuggcuauauacucaaccguggcgaguagcuugguccucgugguuucccugggagcaaucucuuuuuggaugugcucgaacgguagcuuacagugccggauuuguaucuga

SEQ ID NO: 132399 - RNA, 1701 nt, Artificial Sequence; identical to SEQ ID NO: 124672
  derived and/or modified sequence opt3 from hemagglutinin__InfluenzaA__AGR50140

SEQ ID NO: 132400 - RNA, 1701 nt, Artificial Sequence; identical to SEQ ID NO: 124867
  derived and/or modified sequence opt3 from hemagglutinin__InfluenzaA__AGR50151

SEQ ID NO: 132401 - RNA, 1698 nt, Artificial Sequence; identical to SEQ ID NO: 128714
  derived and/or modified sequence opt3 from hemagglutinin__InfluenzaA__AGR50162

SEQ ID NO: 132402 - RNA, 1701 nt, Artificial Sequence; identical to SEQ ID NO: 124672
  derived and/or modified sequence opt3 from hemagglutinin__InfluenzaA__AGR50174

SEQ ID NO: 132403 - RNA, 1701 nt, Artificial Sequence; identical to SEQ ID NO: 124711
  derived and/or modified sequence opt3 from hemagglutinin__InfluenzaA__AGR50185

SEQ ID NO: 132404 - RNA, 1701 nt, Artificial Sequence; identical to SEQ ID NO: 124672
  derived and/or modified sequence opt3 from hemagglutinin__InfluenzaA__AGR50196

SEQ ID NO: 132405 - RNA, 1701 nt, Artificial Sequence
  derived and/or modified sequence opt3 from hemagglutinin__InfluenzaA__AGR50207
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaaaagcuacccaaaguuaucuaaguccuauauaaacgacaaaggcaaggaaguacugguucuuuggggcauccaccaccccucaacgagcgcugaucaacagaguuuguaccagaaugccgacgcguacguguucgucgggucuucccgcuauagcaaaaaguuuaaaccugagauugcaauccgaccaaaggugcgugaucaggagggaagaaugaacuacuauuggacucugguggaacccggugacaaaauuaccuucgaggccacaggcaaucuagucguuccuagguacgcuuuugccauggaacggaacgcagggucgggaaucauaauuucugauacuccagugcaugacugcaacaccacaugucaaaccccgaagggcgcuaucaauacgucccuccccuuccagaacauucacccuaucacuaucgguaagugcccaaaauauguaaagucaacaaaacugcgccuugccaccgggcugagaaaugugcccaguauucagagcaggggauuguuuggcgcgauagccggcuucaucgaagggggauggacugguauggucgacggcugguacggguaucaucaccagaacgaacaaggauccggcuacgcagcugaucucaagucuacacagaaugccauugacgagaucaccaacaaagugaauagcguuauagagaagaugaacacgcaguuuaccgcuguggguaaggaguucaaucaccuggaaaaacggauugaaaacuuaaauaagaaagucgaugacggguuccuggauaucuggacauacaacgccgagcuccuugugcuguuggaaaaugagcgcacucuagacuaucaugauucaaacguaaagaaucuguacgagaaaguucgaagucagcucaagaacaacgcaaaggaaaucggcaauggauguuuugaguucuaucacaaaugcgacaacaccuguauggaauccgugaagaauggcacauacgauuauccuaaauacagcgaggaagccaagcugaacagagaggagauugacggggucaaacuugaaucuacuaggaucuaucaaauucuggcuauauacucaaccguggcgaguagcuugguccucgugguuucccugggagcaaucucuuuuuggaugugcucgaaugguagcuuacagugccggauuuguaucuga

SEQ ID NO: 132406 - RNA, 1701 nt, Artificial Sequence; identical to SEQ ID NO: 124672
  derived and/or modified sequence opt3 from hemagglutinin__InfluenzaA__AGR50218

SEQ ID NO: 132407 - RNA, 1701 nt, Artificial Sequence; identical to SEQ ID NO: 124672
  derived and/or modified sequence opt3 from hemagglutinin__InfluenzaA__AGR50229

SEQ ID NO: 132408 - RNA, 1701 nt, Artificial Sequence; identical to SEQ ID NO: 124867
  derived and/or modified sequence opt3 from hemagglutinin__InfluenzaA__AGR50240

SEQ ID NO: 132409 - RNA, 1701 nt, Artificial Sequence; identical to SEQ ID NO: 124725
  derived and/or modified sequence opt3 from hemagglutinin__InfluenzaA__AGR50251

SEQ ID NO: 132410 - RNA, 1701 nt, Artificial Sequence
  derived and/or modified sequence opt3 from hemagglutinin__InfluenzaA__AGR50262
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccccgaaaggcgcuaucaacacgucccuccccuuccagaauauucacccuaucacuaucgguaagugcccaaaguauguaaaaucaacaaagcugcgccuugccaccgggcugagaaacgugcccaguauucagagcaggggauuguuuggcgcgauagccggcuucaucgaagggggauggacugguauggucgacggcugguacggguaucaucaccagaaugaacaaggauccggcuacgcagcugaucucaaaucuacacagaacgccauugacgagaucaccaauaaggugaacagcguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagaaaacucuagacuaucaugauucaaauguaaagaaccuguacgagaaaguucgcagucagcucaagaacaaugcaaaggaaaucggcaacggauguuuugaguucuaucacaaaugcgacaauaccuguauggaauccgugaagaacggcacauacgauuauccuaaauacagcgaggaagccaagcugaaucgagaggagauugacggggucaaacuugaaucuacuagaaucuaucaaauucuggcuauauacucaaccguggcgaguagcuugguccucgugguuucccugggagcaaucucuuuuuggaugugcucgaacgguagcuuacagugcaggauuuguaucuga

SEQ ID NO: 132411 - RNA, 1701 nt, Artificial Sequence; identical to SEQ ID NO: 124672
  derived and/or modified sequence opt3 from hemagglutinin__InfluenzaA__AGR50273

SEQ ID NO: 132412 - RNA, 1701 nt, Artificial Sequence
  derived and/or modified sequence opt3 from hemagglutinin__InfluenzaA__AGR50284
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauuccccagugcaugacugcaauacuaccugucaaacaccgaaaggcgcuaucaacaccucacuccccuuccagaauauucacccuaucacgaucgguaagugcccaaaguauguaaaaaguacuaagcugcgccuugccacagggcugagaaacgugcccagcauucaguccaggggauuguuuggcgcgauagccggcuucaucgaagggggauggaccgguauggucgacggcugguacggguaucaucaccagaaugaacaaggaucuggcuacgcagcugaucucaaaagcacucagaacgccauugacgagaucacaaauaaggugaacucaguuauagagaaaaugaauacccaguuuacggcuguggguaaggaguucaaccaccuggaaaagcggauugaaaauuuaaacaaaaaggucgaugacggguuccuggauaucuggaccuacaaugccgagcuccuugugcuguuggaaaacgagcgcacacuagacuaucaugauaguaauguaaagaaccuguacgagaagguucgaucccagcucaaaaacaaugcaaaggaaaucggcaacggauguuuugaguucuaucacaagugcgacaauacuuguauggaaagcgugaaaaacggcaccuacgauuauccuaaguacucugaggaagccaaacugaauagagaggagauugacggggucaaacuugaaucaacaaggaucuaucaaauucuggcuauauacaguacuguggcgagcuccuugguccucgugguuucucugggagcaaucucguuuuggaugugcagcaacgguuccuuacagugccggauuuguaucuga

SEQ ID NO: 132413 - RNA, 1701 nt, Artificial Sequence; identical to SEQ ID NO: 125415
  derived and/or modified sequence opt3 from hemagglutinin__InfluenzaA__AGR50295

SEQ ID NO: 132414 - RNA, 1701 nt, Artificial Sequence; identical to SEQ ID NO: 124672
  derived and/or modified sequence opt3 from hemagglutinin__InfluenzaA__AGR50306

SEQ ID NO: 132415 - RNA, 1701 nt, Artificial Sequence; identical to SEQ ID NO: 124672
  derived and/or modified sequence opt3 from hemagglutinin__InfluenzaA__AGR50317

SEQ ID NO: 132416 - RNA, 1701 nt, Artificial Sequence; identical to SEQ ID NO: 132405
  derived and/or modified sequence opt3 from hemagglutinin__InfluenzaA__AGR50328

SEQ ID NO: 132417 - RNA, 1701 nt, Artificial Sequence
  derived and/or modified sequence opt3 from hemagglutinin__InfluenzaA__AGR50339
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucgacuacgaggagcucagggagcagcugagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcucgugaaaaagggaaacagcuacccaaaauuaucuaaguccuauauaaaugacaagggcaaagaaguacugguucuuuggggcauccaccaccccucaacgagcgcugaucaacagaguuuguaccagaacgccgacgcguacguguucgucgggucuucccgcuauagcaagaaauuuaagccugagauugcaauccgaccaaaagugcgugaucaggagggaagaaugaauuacuauuggacucugguggaacccggugacaagauuaccuucgaggccacaggcaaccuagucguuccuagguacgcuuuugccauggaacggaacgcagggucgggaaucauaauuucugauacuccagugcaugacugcaauaccacaugucaaaccuccaaaggcgcuaucaacacgucacucccguuccagaauauucaccccaucacuaucgguaagugcccuaaguauguaaaaaguacaaagcugcgccuugccaccgggcugagaaacgugccaagcauucaguccaggggauuguuuggcgcgauagccggcuucaucgaagggggauggacugguauggucgacggcugguacggguaucaucaccagaaugaacaaggaucuggcuacgcagcugaucucaaaagcacacagaacgccauugacgagaucaccaauaaggugaacucaguuauagagaaaaugaauacgcaguuuaccgcuguggguaaggaguucaaccaccuggaaaagcggauugaaaauuuaaacaaaaaggucgaugacggguuccuggauaucuggacauacaaugccgagcuccuugugcuguuggaaaacgagcgcacucuagacuaucaugauaguaauguaaagaaccuguacgagaagguucgaucccagcucaaaaacaaugcaaaggaaaucggcaacggauguuuugaguucuaucacaagugcgacaauaccuguauggaaagcgugaaaaacggcacauacgauuaucccaaguacucugaggaagccaaacugaauagagaggagauugacggggucaaacuugaaucaacuaggaucuaucaaauucuggcuauauacaguaccguggcgagcuccuugguccucgugguuucucugggagcaaucucguuuuggaugugcagcaacgguuccuuacagugccggauuuguaucuga

SEQ ID NO: 132418 - RNA, 1701 nt, Artificial Sequence
  derived and/or modified sequence opt3 from hemagglutinin__InfluenzaA__AGR50350
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggaucauggggaauccugagugugaaucucugucaacagcaaguagcugguccuacauuguugagaccucuucgucagacaacggaacuugcuauccaggcgauuuuaucgacuacgaagaguugagggagcagcucagcaguguguccucuuucgaacgguuugagauuuucccgaagacaagcuccuggcccaaucacgauucaaacaagggugucaccgccgcuuguccucaugcaggggccaaaaguuuuuauaagaaucugaucuggcuggugaaaaagggaaacagcuacccaaaacucucuaaguccuauauaaaugacaagggcaaagaaguauuaguucuguggggcauccaccaccccucaacgagcgcugaucaacagagucuuuaccagaacgccgacgcguacguguucgucgggucuucccgcuauagcaagaaauuuaagccugagauugcaauccgaccaaaagugcgugaucaggagggaagaaugaauuacuauuggacuuugguggaacccggugacaagauuaccuucgaggccacaggcaaccuggucguuccuagguacgcuuuugccauggaacggaacgcagggucgggaaucauaauuucugauacuccagugcaugacugcaauaccacaugucaaaccccgaaaggcgcuaucaacacgucccuacccuuccagaauauucacccuaucacuaucgguaagugcccaaaguauguaaaaucaacaaagcuccgccuggccaccgggcuuagaaacgugcccaguauucagagcaggggacuguuuggcgcgauagccggcuucaucgaagggggauggacugguauggucgacggcugguacggguaucaucaccagaaugaacaaggauccggcuacgcagcugauuugaaaucuacacagaacgccauugacgagaucaccaauaaggugaacagcguuauagagaaaaugaauacgcaguuuaccgcuguggguaaggaguucaaccaccucgagaagcggauugaaaaucugaacaaaaaggucgaugacggguucuuagauaucuggacauacaaugccgagcugcucgugcuucuggaaaacgagcgcacuuuggacuaucaugauucaaauguuaaaaaccuauacgagaagguacgaagucagcugaaaaacaaugcaaaggaaaucggcaacggauguuuugaguucuaucacaagugcgacaauaccuguauggaauccgugaaaaacggcacauacgauuauccuaaguacagcgaggaagccaaacucaauagagaggagauugacggggucaagcuggaaucuacuaggaucuaucaaauucuugcuauauacucaaccguggcgaguagccuggucuuggugguuucccucggagcaaucucuuuuuggaugugcucgaacgguagccugcagugccggauuuguaucuga

SEQ ID NO: 132419 - RNA, 1698 nt, Artificial Sequence
  derived and/or modified sequence opt3 from hemagglutinin__InfluenzaA__AGR50361
augaaggugcagcugcucguccuucugugcaccuucacagccacuuacgcugacacgaucuguauuggcuaucacgcaaacaauagcaccgauacaguugacacuguguuggagaaaaacguaaccgugacacauuccgucaauuuacuggaaaacucucacaaugggaagcuaugccuccugaaaggaauagcgccccuucaacuggguaacuguucaguggccggcuggaucuuggggaauccugagugcgaacuccugauuaguaaggagagcugguccuacaucguugaaaaaccaaacccggagaauggaaccuguuaucccggccauuuugcugauuacgaggaacugagagagcagcucucuucggugagcucauucgaaagguuugagauuuucccuaaggagaguuccuggccaaaccacacugucacaggugugucugccagcugcucccauaauggggaaucaaguuuuuaucggaacuuacuguggcuuaccggaaagaauggcuuguaccccaaccugagcaaaucuuaugcaaauaacaaggagaaagaaguucuaguacucuggggcgugcaccacccuccaaacaucgucgaccagaagacgcuguaccgcacugagaaugccuacguguccguggucucaagccauuauagucgaaaauucacccccgaaauagcuaagcguccuaagguuagagaucaggaggggaggaucaacuacuauuggacacuucuggagccaggagacacuauuaucuuugaagcaaaugguaacuugauugccccgcgguacgcuuucgcccucucucgcggcuuuggguccggaaucauaaauagcaacgcgcccaugggcaaaugugaugcaaagugccaaaccccucagggugccauuaauucgucucugccauuccagaacgugcaccccguaacaaucggggaguguccuaaauaugugagauccgcuaaguuaaggauggucaccggacugcggaauauuccaucaauccagagucgcggccucuuuggcgccaucgcaggguucauugaaggagguuggacgggcaugguggacgggugguacggauaucaucaccaaaacgagcagggcagcgguuacgcugccgaucagaaauccacucagaaugcgauaaacgggaucacaaauaagguuaacucugugauugaaaagaugaauacccaauuuacugccgucggcaaggaguucaacaaacuugagcgaagaauggaaaaccugaauaaaaagguggacgauggauucaucgacauauggacauacaacgcagaguugcuaguacugcucgaaaaugagaggacccuggauuuucacgacagcaacguuaaaaaucuuuaugaaaaggugaaaucacagcugaagaacaaugcuaaggagauuggcaacgggugcuucgaguuuuaccauaaauguaaugacgaaugcauggagagugucaagaacggaacguaugauuaccccaaauauuccgaagagagcaaguugaaucgggagaaaaucgacggugugaagcucgaaucuaugggcgucuaccagauccuggccauuuauucaaccguggcuaguagcuuaguucugcuagugucccucggggccaucucuuucuggaugugcucgaacggaagccugcaaugucguauuugcauauga

SEQ ID NO: 132420 - RNA, 1701 nt, Artificial Sequence
  derived and/or modified sequence opt3 from hemagglutinin__InfluenzaA__AGT18718
augaaggugauccuggucguucuccuuuacaccuucgccacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucaauuacgaagaacucagggagcagcugagcagugucuccucuuucgaacgguuugagauuuucccgaagacaagcuccuggcccaaccacgacucaaauaagggugugaccgcagccuguccucaugcuggggcaaaaaguuuuuauaagaaccugaucuggcucgugaaaaagggaaauagcuacccaaaauuaucuaaguccuauauaaacgauaagggcaaagaaguucuggugcuuuggggcauccaccaccccucaacgacugccgaccaacagagcuuguaccagaaugcugaugccuacgucuucguggggaccagucgcuauucuaagaaauuuaagccugagauugcgauccgaccaaaagugcgugaccaggagggaagaaugaacuacuauuggacacugauugaacccggugauaagaucacuuucgaggcaaccggcaaccuagucguuccuagguacgccuuugcuauggaacggaaugccggguccggaauaauuaucagcgacacaccagugcaugauugcaacaccacgugucaaacuccggagggcgcaauuaauacaucgcuccccuuccagaacauccacccuaucaccauugguaaaugcccaaaguauguaaagucuacuaaacugcgccuugcuacagggcugagaaaugugcccuccauacagucaaggggauuguuuggcgccaucgcgggcuucauugaagggggauggaccgguauggucgacggcugguacggguaucaucaccagaacgagcaaggaaguggcuacgccgcagaccucaagagcacgcagaaugcuaucgauaaaauaaccaacaagguaaauuccguuauugagaaaaugaacacacaguuuacugccguggguaaggaguucaaucaccuggagaagcggaucgaaaacuuaaauaaaaaggucgacgauggguuccuggacaucuggaccuacaacgcugagcuccuugugcuguuggaaaaugagcgcacacuagauuaucaugacucuaacguuaaaaaccuguacgagaagguacgaaaucagcucaaaaacaaugccaaggaaauuggcaacggauguuuugaguucuaucacaagugcgauaauacuuguauggaaagcgugaaaaacggcaccuacgacuauccuaaguacucagaggaagcaaaacugaauagagagaagaucgauggggucaaacuugagaguacaaggauuuaucaaauacuggccaucuacuccaccguggcuagcucuuugguccucgugguuucacugggagcgauuaguuuuuggaugugcagcaacgguuccuuacagugccggaucuguaucuga

SEQ ID NO: 132421 - RNA, 1701 nt, Artificial Sequence
  derived and/or modified sequence opt3 from hemagglutinin__InfluenzaA__AGT18720
augaaggugauccuggucguucuccuuuacaccuucgccacagcuaacgcagacacucugugcauuggauaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucaauuacgaagaacucagggagcagcugagcagugucuccucuuucgaacgguuugagauuuucccgaaggcaagcuccuggcccaaccacgacucaaauaagggugugacagccgcuuguccucaugcaggggccaaaaguuuuuauaagaaccugaucuggcucguuaaaaagggaaauagcuacccaaaauuaucuaaguccuauauaaacgauaagggcaaagaaguacuggugcuuuggggcauccaccaccccaauaccacggcugaccaacagucauuguaccagaacgccgaugcguacgucuucguggggacuagccgcuauaguaagaaauuuaagccugagauugcaauccgaccaaaagugcgugaccaggagagaaggaugaacuacuauuggacccugauugaacccggagauaagaucacauucgaggccacugguaaucuagucguuccucgguacgcuuuugccauggaacgcaacgcaggcucugggauaauuaucuccgacaccccagugcaugauugcaauacaaccugucaaacgccggagggagcuauuaacacuagccuccccuuccagaauauccacccuaucacaauuggcaaaugcccaaaguauguaaagucgaccaaacugagacuugccacuggucugaggaacgugcccucuauacagucccggggguuguuuggagcgaucgccggcuucauugaaggcggguggacaggaauggucgacgguugguacggcuaucaucaccagaaugagcaagggucaggauacgcagcugaccucaagaguacccagaacgccaucgauaaaauaacgaauaaggugaacagcguuauugagaaaaugaauacccaguuuacagcugugggcaaggaguucaaccaccuggagaagcgcaucgaaaauuuaaacaaaaaggucgacgaugguuuccuggacaucuggacuuacaaugccgagcuccuugugcuguuggaaaacgagcgaacccuagauuaucaugacuccaacguuaaaaaucuguacgagaagguaagaaaccagcucaaaaauaacgcaaaggaaauugggaauggcuguuuugaguucuaucacaagugcgauaacacauguauggaaucugugaaaaauggaacuuacgacuauccuaaguacagcgaggaagccaaacugaacagggagaagaucgauggcgucaaacuugagucaacccggauuuaucaaauacuggcuaucuacaguacaguggcguccagcuugguccucgugguuucucugggggcaauuucauuuuggaugugcaguaauggcagcuuacagugccguaucuguaucuga

SEQ ID NO: 132422 - RNA, 1701 nt, Artificial Sequence
  derived and/or modified sequence opt3 from hemagglutinin__InfluenzaA__AGT18721
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuauucaacggagcgaaaucuguacaaagaccuccucauggccgaaccacgacaguaauaagggugucacggccgcuugcccccaugcaggggccaagagcuucuauaagaaccugauauggcucgugaaaaagggaaauucuuacccuaaauuauccaagucauauaucaacgauaagggcaaagagguacugguucuuuggggcauucaccaccagaauagccgcgggcaucagcagaguuuguaccaaaacgcugacgccuacguguuugucggaacuucucgauauuccaagaaauucaagccagaaaucgcgauucgucccaaagugaaggagcaggaugguagaauggacuacuauuggacccugaucgagccuggcgauaaaauaacauuugaagcaacugggaaccuaguggucccaagguacgccuucgcuauggagcggaaugccggaagcggcauuaucauuucggacacccccguucacgauuguaacacaaccugccagacgccugaaggugcaaucaauacuucucucccauuucagaacauccauccgauuacaauagggaagugucccaaguaugugaaauccaccaagcugcgccuugcuacuggacugagaaauguaccuucaauccaaaguaggggcuuguucggcgccauugcgggguuuaucgagggagguuggacaggcaugguggacgggugguacggauaucaccaccagaacgaacagggcagcgguuacgccgcagaccucaaauccacccagaaugcuauagauaagauuacgaacaaagucaauucugugaucgagaagaugaacacccaauucacagccguugggaaggaguuuaaucaucuggaaaaacggaucgagaacuuaaauaagaaaguggacgauggcuuccuggacauuuggacuuacaacgcugaacuccuuguccuguuggagaaugaacgcacccuagauuaucacgacagcaacgugaagaaccuguacgagaaaguacgaaaucagcucaagaacaaugccaaggagaucggaaacggcugcuuugaguucuaucauaaaugugauaauacaugcauggagucaguuaagaacgggacuuacgacuauccaaaauacagugaagaggcaaagcugaauagagagaaaauugauggagugaaacuugaauccaccaggauauaucagauccuggccauuuacagcacagucgcuucuucauuggugcucgucgugagucugggugcgaucagcuucuggaugugcuccaacggcucuuuacaaugucggaucugcauuuga

SEQ ID NO: 132423 - RNA, 1701 nt, Artificial Sequence
  derived and/or modified sequence opt3 from hemagglutinin__InfluenzaA__AGT18722
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaagucgaacaauaggacuugcuauccaggagacuuuaucaacuacgaagaacuccgggagcagcugucaagcgugaguuccuucgaacgcuuugagauuuucccgaagacaucuagcuggcccaaucacgauuccaacaaaggcgucaccgccgcuuguccucaugccggugcaaagucauuuuauaaaaaucugaucuggcucgugaagaaagggaacaguuacccaaaguuaagcaagucuuauauaaaugacaaaggaaaggaaguacugguucuuuggggcauccaccaccccuccacgacugcugaucaacagucauuguaccagaacgccgacgcguacguguucgucggcaccagccgauauaguaaaaaguuuaaaccugagauugcaauccguccaaaggugagagaucaggaggggaggaugaacuacuauuggacacugauugaacccggagacaaaaucacuuucgaggccaccgguaaucuaguggucccucgguacgcuuuugccauggaacgcaacgcaggcucugggauaauuaucuccgauacaccaguucaugacugcaauaccacgugucaaacuccggagggagcuauuaacacaagccuccccuuccagaauauccacccuaucaccauuggcaagugcccaaaguaugugaaaucgacuaagcugagacuugccacaggucugaggaacguacccucuauacagucccggggguuguuuggagcgaucgccggcuucauugaaggcggguggaccggaaugguggaugguugguacggcuaucaucaccagaaugagcaagggucaggauacgcagcugaccucaaaaguacgcagaacgccaucgacaagauaaccaauaaagucaacagcgugauugagaagaugaauacacaguuuacugcuguuggcaaggaguucaaccaccuggagaaacgcaucgaaaauuuaaacaagaaaguggaugacgguuuccuggauaucuggaccuacaaugccgagcuccuuguccuguuggaaaacgagcgaacacuagacuaucaugauuccaacgugaagaaucuguacgagaaaguaagaaaccagcucaagaauaacgcaaaggaaauugggaauggcuguuuugaguucuaucacaaaugcgacaacacuuguauggaaucuguuaagaauggaaccuacgauuauccuaaauacagcgaggaagccaagcugaacagggagaaaaucgacggcgugaaguuagagucaacacggauuuaucaaauacuggcuaucuacaguaccgucgcguccagcuuggugcucgucgugucucugggggcaauuucauuuuggaugugcaguaauggaagccuucagugccguaucuguaucuga

SEQ ID NO: 132424 - RNA, 1701 nt, Artificial Sequence
  derived and/or modified sequence opt3 from hemagglutinin__InfluenzaA__AGT18723
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuaagacuaacaauaggacaugcuauccaggagacuuuaucaacuacgaagaacuccgggagcagcugucgucagugagcaguuucgaacgcuuugagauuuucccgaagaccuccucuuggcccaaucacgauagcaacaaaggcgucacggccgcuuguccucaugccggugcaaaguccuuuuauaaaaaucugaucuggcucgugaagaaagggaacucauacccaaaguuaaguaagagcuauauaaaugacaaaggaaaggaaguacugguucuuuggggcauccaccaccaaaacaaaaaggcugagcagcagacucccuaccagaacgccgaugcguacguguucgucggcaccucucgauauuccaaaaaguuuaaaccugagauugcaauccguccaaaggugagagaccaagaagggaggauggauuacuauuggacauugauugagcccggagacaagaucacuuucgaagccaccgguaaucugguggucccucgguacgcuuuugccauggagcgcaacgcaggcucagggauaauuaucagcgauacaccaguucaugacugcaauaccacgugucagacuccggaaggagcuauuaacacaagucuacccuuccagaauauccacccuaucaccauuggcaaaugcccaaaguaugugaaaucuacuaagcucagacuggccacaggucuuaggaacguacccuccauacagagccgggggcuguuuggagcgaucgccggcuucauugagggcggguggaccggaaugguggaugguugguacggcuaucaucaccaaaaugagcaggggucgggauacgcagcugacuugaaaucuacgcagaacgccaucgacaagauaaccaauaaggucaacuccgugauugagaaaaugaauacacaguuuacugcuguuggcaaggaguucaaccaccucgaaaaacgcaucgagaaucugaacaagaaaguggaugacgguuucuuagauaucuggaccuacaaugccgaacugcucguccuucuggagaacgagcgaacauuggacuaucaugauucaaacgugaagaaucuauacgaaaagguaagaaaccaacugaaaaauaacgcaaaggagauugggaauggcuguuuugaguucuaucacaaaugcgacaacacuuguauggaaaguguuaagaauggaaccuacgauuauccuaaauacagcgaagaggccaagcucaacagggagaagaucgacggcgugaaacuggaauccacacggauuuaucagauacuugcuaucuacucuaccgucgcgagcucacugguguuggucgugagucucggggcaauuuccuuuuggaugugcagcaauggaucucugcagugccguaucuguaucuga

SEQ ID NO: 132425 - RNA, 1701 nt, Artificial Sequence
  derived and/or modified sequence opt3 from hemagglutinin__InfluenzaA__AGT18724
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggagugguuccccugcaucuugguaaaugcaacauagcuggcuggauccuggggaauccugagugugaaucuuugucaacagccaguagcugguccuacauuguggagaccucuaagacuaacaauaggacaugcuauccaggagacuuuaucaacuacgaagaacuccgggagcagcugucgucagucagcaguuucgaacgcuuugagauuuucccgaagaccuccucuuggcccaaucacgauagcaacaaaggcgugacggcagccuguccucaugcuggugcaaaguccuuuuauaaaaaucugaucuggcucguaaagaaagggaacucauacccaaaguuaaguaagagcuauauaaaugacaaaggaaaggaaguucuggugcuuuggggcauccaccaccccucuacuaccgccgaucaacagacauuguaccagaacgcugacgccuacgucuucgugggcacuucccgauauucaaagaaguuuaaaccugagauugcgauccguccaaaggugagagaucaggaggggaggaugaacuacuaucggacccugauugaacccgagaauaaaaucacauucgaagcaaccggaaaccuagucguuccucgcuacgccuuugcuauggagagaaaugccgguagcggcauaauuaucagugacacgccagugcaugauugcaacacuacaugucaaaccccggaaggggcaauuaauacuucucuccccuuccagaacauccacccuaucacaauuggaaagugcccaaaguauguaaaauccaccaagcugaggcuugcuacgggccugcggaaugugcccagcauacagucgcgcgguuuguuuggggccaucgcgggauucauugagggcggcuggaccgggauggucgacggaugguacgguuaucaucaccagaacgagcaaggcucuggguacgccgcagaucucaaauccacacagaaugcuaucgacaagauaacuaacaaaguuaauucagugauugaaaagaugaacacccaguuuacagccgugggaaaggaguucaaucaccuggaaaaacgaaucgagaacuuaaauaagaaagucgacgauggcuuccuggacaucuggacuuacaacgcugaacuccuugugcuguuggagaacgagagaacccuagauuaucaugacaguaauguaaagaaccuguacgaaaaaguuaggaaucagcucaagaacaaugccaaggagauugguaacggguguuuugaguucuaucacaaaugcgauaauacauguauggagagcgugaagaacggcaccuacgacuauccuaaauacuccgaagaggcaaagcugaaucgggagaaaaucgauggagucaaacuugaaucuacucguauuuaucaaauacuggccaucuacagcacgguggcuucaaguuugguccucgugguuucccugggcgcgauuagcuuuuggaugugcucuaacgggucauuacagugccgcaucuguaucuga

SEQ ID NO: 132426 - RNA, 1701 nt, Artificial Sequence
  derived and/or modified sequence opt3 from hemagglutinin__InfluenzaA__AGT18725
augaaggugauccuggucguucuccuuuacaccuucgccacagcuaacgcagacacucugugcauuggcuaucacgccaauaacagcacggauaccguggacacaguauuggagaaaaaugugacugucacccauuccgugaacuuacuggaagauaagcacaaugggaaacuauguaagcucagaggaguugcgccccugcaucuugguaaaugcaacauagcuggcuggauccuggggaauccugagugugaaucuuugucaacagccaguagcugguccuacauuguggagaccucuucgucagacaacggaacuugcuauccaggcgauuuuaucaauuacgaagaacucagggagcagcugagcagugucuccucuuucgaacgguuugagauuuucccgaagacaagcuccuggcccaaccacgacucaaauaagggugugaccgcagccuguccucaugcuggggcaaaaaguuuuuauaagaaccugaucuggcucguuaaaaagggaaauagcuacccaaaauuaucuaaguccuauauaaacgauaagggcaaagaaguacuggugcuuuggggcauccaccaccccucaacgagcgccgaccaacagaguuuguaccagaaugcugaugccuacgucuucguggggacuucucgcuauuccaagaaauuuaagccugagauugcgauccgaccaaaagugcgugaccaggagggaagaaugaacuacuauuggacccuggucgaacccggugauaagauuacauucgaggcaacuggcaaccuaguugugccuagguacgccuuugcuauggaacggaaugccgggagcggaaucauaauuucggacaccccaguacaugauugcaacacaaccugucaaacgccggagggcgcaaucaauacuucucuccccuuccagaacauucacccuaucacaaucgguaaaugcccaaaguaugugaaguccaccaaacugcgccuugcuacugggcugagaaauguccccucaauucagaguaggggauuguuuggcgccauagcgggcuucaucgaagggggauggacagguaugguggacggcugguacggguaucaucaccagaacgagcaaggaagcggcuacgccgcagaccucaaguccacccagaaugcuauugauaaaaucacgaacaagguuaauucugugauagagaaaaugaacacccaguuuacagccgucgguaaggaguucaaucaccuggagaagcggauugaaaacuuaaauaaaaagguggacgauggguuccuggacaucuggacuuacaacgcugagcuccuuguacuguuggaaaaugagcgcacccuagauuaucaugacagcaacguuaaaaaccuguacgagaaggugcgaacacagcucaaaaauaacgccaaggaaaucggcaauggauguuuugaguucuaucacaagugcgauaacacuuguauggaaucagucaaaaauggcaccuacgacuauccuaaguacagugaggaagcaaaacugaacagagagaagauugauggggugaaacuugaguccacaaggaucuaucaaauucuggccauauacagcaccgucgcuucuucauuggugcucguugugagucugggagcgaucagcuuuuggaugugcuccaaugguucuuuacagugccggauuuguaucuga

SEQ ID NO: 132427 - RNA, 1701 nt, Artificial Sequence
  derived and/or modified sequence opt3 from hemagglutinin__InfluenzaA__AGT18734
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacugcugaccaacagagcuuguaccagaaugccgaugcguacguguucgucgggaccagucgcuauucuaagaaauuuaagccugagauugcaauccgaccaaaagugcgugaccaggagggaagaauuaacuacuauuggacacugaucgaacccggugauaagauaacuuucgaggccaccggcaaccuaguggucccuagguacgcuuuugccauggaacggaaugcaggguccggaauuaucauuagcgacacaccaguucaugauugcaacaccacgugucaaacuccggagggcgcuaucaauacaucgcuccccuuccagaacauccacccuauuaccauagguaaaugcccaaaguaugugaagucuacuaaacugcgccuugccacagggcugagaaauguacccuccauccagucaaggggauuguuuggcgcgauugccggcuucaucgaagggggauggaccgguaugguggacggcugguacggguaucaucaccagaacgagcaaggaaguggcuacgcagcugaccucaagagcacgcagaaugccauagauaaaauuaccaacaaggucaauuccgugaucgagaaaaugaacacacaguuuacugcuguugguaaggaguucaaucaccuggagaagcggaucgaaaacuuaaauaaaaagguggacgauggguuccuggacauuuggaccuacaacgccgagcuccuuguccuguuggaaaaugagcgcacacuagauuaucaugacucuaacgugaaaaaccuguacgagaagguacgaaaucagcucaaaaacaaugcaaaggaaaucggcaacggauguuuugaguucuaucacaagugcgauaauacuuguauggaaagcguuaaaaacggcaccuacgacuauccuaaguacucagaggaagccaaacugaauagagagaagauugauggggugaaacuugagaguacaaggauauaucaaauccuggcuauuuacuccaccgucgcgagcucuuuggugcucgucgugucacugggagcaaucaguuuuuggaugugcagcaacgguuccuuacagugccggaucuguauuuga

SEQ ID NO: 132428 - RNA, 1701 nt, Artificial Sequence; identical to SEQ ID NO: 132139
  derived and/or modified sequence opt3 from hemagglutinin__InfluenzaA__AGT18735

SEQ ID NO: 132429 - RNA, 1701 nt, Artificial Sequence
  derived and/or modified sequence opt3 from hemagglutinin__InfluenzaA__AGT18748
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagaugaagagaacuguacacucaucgacgcucugcuuggcgauccgcagugcgacgauuuucagaauaaaaagugggaccuguucguggaaaggagcaaagccuauuccaacuguuaccccuaugaugucccugacuacgcaucuuugcggucgcucguggccucaagcgggacccuggaguuuaauaacgagaguuucaauugggcuggaguuacucaaaacggcacauccucugcaugccgccgagguagcaauuccucauuuuucagucgucugaacuggcucacccauuuaaauuuuaaguauccagcccugaacgugacgaugcccaacaaugaacaguucgauaaacuuuacauuuggggaguccaccauccuagcacugacaaggaucagaucuuuuuguaugcucagucuuccgggagaauuaccgugucaacaaagaggagccaacaggccguaaucccaaacauaggcagucggccccgcauuagaaauaucccuucuaggauuuccaucuacuggacuaucguuaaaccaggcgacauucugcuaauaaacagcaccgggaaucucaucgcgccgcggggauacuucaagauucgcucggguaaaucuuccaucaugcgaucagacgcacccauaggcaaguguaagagugagugcauuacaccuaacgggagcaucccaaaugauaaacccuuucagaacgugaauagaaucaccuauggagccuguccuagguacgucaagcaguccacgcugaaacuugcuacuggcaugcggaacgugccagaaaagcaaacacgugguauuuucggggccaucgcaggauuuauugagaauggcugggagggcaugguggacgggugguauggauuccgccaccagaacucugaagguagaggccaggcugccgaucugaaaagcacccaagcggccauagaccagaucaaugggaaguugaacaggcucauuggaaaaacuaaugagaaguuccaccagaucgaaaaggaguuuucagaagucgagggccggauccaggaucuggagaaauacguugaagacacaaagauugauuuauggaguuauaacgcagagcugcucguggcucuugaaaaccaacauaccauagaccugacggauuccgagaugaauaaauuguucgaaaagaccaaaaagcagcuacgagagaacgccgaggacauggguaaugggugcuuuaagaucuaccacaaaugugauaacgcuugcauuggcagcauccgcaauggaacauaugaccaugacguauacagagaugaagcccugaacaauagguuccagauuaagggcguggagcucaaaucuggguacaaggacuggauccuguggauaucauuugcaaucaguugcuuccuucugugugucgccuugcucggauuuauuaugugggcuugccagaaagguaacauccgguguaauauuugcaucuga

SEQ ID NO: 132430 - RNA, 1701 nt, Artificial Sequence
  derived and/or modified sequence opt3 from hemagglutinin__InfluenzaA__AGT18749
augaagaccaucauugcccugagcuacauacucugccuuguguucgcucagaaacugcccgagaacgacaauuccacagcaacuuuguguuuaggccaccaugccgucccuaacgggacgaucguuaagaccauuacagaugaccaaaucgaagugacuaaugcgaccgagcugguacagaacucuucaacaggagaaauuugcgauaguccacaccagauccuagacggugagaauuguacccucauagaugcucugcuuggcgacccgcagugcgauggguuucaaaacaaaaagugggaccuguucguggaaagaagcaaagccuauuccaauuguuaccccuaugaugucccugacuacgcaucuuugaggucgcucguggccucaagcggaacucuggaguuuaacaaugagaguuucaacuggacaggcguuacccagaaugguacguccucugcuugcauccggcgcagcaacaauuccuuuuucucacgacugaacuggcucacucauuuaaauuuuaaguauccagcacugaacgugaccaugcccaacaaugaacaguucgauaaacuuuacauuuggggaguccaccauccugggacagacaaagaucagaucuuuuuguaugcccaagcuaguggccguauuacugugagcaccaagagaucucagcaggccguaaucccaaacauaggcuccaggccccggguucgcaauauuccuucaagaaucagcauuuacuggacaaucgugaaaccaggggacauccugcuaauuaacaguaccggaaaucucauagcgccgagggguuacuuccggauccgcucuggccgauccagcauuaugagaucggacgcacccaucgggaaguguaacucugagugcauaacgccuaauggauccauuccaaacgauaaacccuuucagaaugucaacaggaucacuuauggcgccuguccucgguacgugaagcaaaauacacugaaacuugcuaccgguaugcguaacgugccagaaaagcagacucgcgggaucuucggagccauugcaggcuuuaucgagaauggcugggaggggauggucgacggaugguaugguuucagacaccagaacucagaaggcagggggcaagcugccgaucugaagaguacacaggcggccauugaccagauaaauggaaaauugaaccggcucaucggcaagaccaacgagaaauuccaccagauugaaaaggaguuuagcgaaguugagggucgaauccaagaucuggagaaauacguggaagacacgaagaucgauuuaugguccuauaaugcagagcugcucguagcucuugaaaaccagcauaccauugaccugacagauucugagaugaauaaguuguucgaaaagacuaagaaacagcuacgcgagaacgccgaggacauggggaauggcugcuuuaagauauaccacaaaugugauaacgcuugcaucggaagcauuagaaauggcaccuaugaccaugacguguacagggaugaagcccugaacaaucgguuccagaucaagggggucgagcucaagucaggauacaaagacuggauucuguggaucaguuuugcaauauccugcuuccuucuguguguggccuugcucgguuuuaucaugugggcuugccaaaagggcaacauucgcuguaauaucugcauuuga

SEQ ID NO: 132431 - RNA, 1701 nt, Artificial Sequence
  derived and/or modified sequence opt3 from hemagglutinin__InfluenzaA__AGT18751
augaagaccgugaucgcccugagcuacauucucugccuugucuucgcucagaaacugcccggcaacgacaauuccacagcaacuuuguguuuagggcaccaugccguuccuaacggaacgauagugaagaccaucacaaaugaucaaauugagguaacuaacgcgaccgaacuggugcaaaauucuucaacaggugagaucugcgacaguccacaccagauucuagauggcgaaaacuguacccucaucgacgcucugcuuggggauccgcagugcgacggauuucagaauaaaaagugggaucuguucgucgagagaagcaaagccuauuccaacuguuaccccuaugacgugccugauuacgcaucuuugaggucgcucguugccucaagcggcacucuggaauuuaauaacgagaguuucaauuggacaggugugacccagaacgggacguccucugcuugcauacggcgcagcaauaacuccuuuuucucacgacugaauuggcucacucauuuaaacuuuaaguauccagcacugaacgucaccaugcccaauaacgagcaguucgacaaguuguacaucuggggagugcaccauccuggcacagauaaagaccagauuuuucuuuaugcccaagcuaguggccguaucacuguaagcaccaagagaucucagcaggccguuauuccaaauaucggguccaggccccgggugcgcaacauaccuucaagaauuagcaucuacuggacaauugucaaaccaggagauauccugcuaaucaauaguaccgguaaccucauugcgccgaggggcuacuucaagauacggucugggcgcuccagcaucaugcgaucggacgcacccauuggaaaauguaauucugaaugcaucacgccuaacggcuccauaccaaaugacaagcccuuucagaacgugaauagaauuacuuauggugccuguccuagguacgugaagcaaaacacacugaaacuugcuaccgggaugcggaaugucccagagaagcagacucguggaaucuucggcgccaucgcaggcuuuauugaaaacgggugggagggaaugguugaugguugguauggcuuccgccaccaaaauucagaggggagaggacaggcugccgaccugaaaaguacacaggcggccaucgaucagauuaacggcaaguugaacaggcucauagguaaaaccaaugaaaaguuccaccagaucgagaaagaauuuagcgagguggaagggcggauucaagaccuggagaaguacguagaggauacgaagaucgacuuaugguccuauaaaucugaacugcucguggcacuugagaaccagcauaccaucgaucugacagacagcgaaaugaauaaguuguucgagaaaacuaagaaacagcuacgagaaaacgcugaggauaugggcaauggaugcuuuaagauuuaccacaagugugacaacgccugcauaggcucaauccgcaaugggaccuaugaucaugacgucuacagagacgaggcucugaacaauagguuccagauuaaaggaguggaacucaagagugguuacaaagauuggauccuguggauuuccuuugccaucagcugcuuccuucuguguguugcauugcucggcuuuauaaugugggccugccaaaaggggaacauccgguguaauauuugcaucuga

SEQ ID NO: 132432 - RNA, 1701 nt, Artificial Sequence
  derived and/or modified sequence opt3 from hemagglutinin__InfluenzaA__AGT18752
augaagaccaucauugcccugagcuacauaaucugccucguguucgcucagaaacuucccggcaacgacaauuccacagcaacucuguguuuggggcaccaugccgucccuaacggaacgauuguuaagaccaucacaaaugaucaaauugaggugacuaacgcgaccgaauuaguacagaauagcucaacaggugagaucugcaacaguccacaccagauacuggacggcgaaaauuguacccuaaucgaugcucuccugggggacccgcagugcgauggauuucaaaacaaaaagugggaccuuuucguggagagaagcaaagccuauuccaauuguuaccccuaugaugucccugacuacgcaucucugaggucguugguggccucaagcggcacucucgaauuuaacaaugagaguuucaacuggacagguguuacccagaaugggacguccucugcuugcauucggcgcagcaacaauuccuuuuucucacgacugaacuggcugacucaucucaacuuuaaguauccagcauuaaaugugaccaugcccaacaaugagcaguucgauaagcuguacaucuggggaguccaccauccuggcacagacaaagaucagauuuuucuuuaugcccaagcuaguggccguaucacugugagcaccaagagaucucagcaggccguaauaccaaacauuggguccaggccccggguucgcaauaucccuucaagaauuagcaucuacuggacaaucgugaaaccaggagacauuuugcugauaaacaguaccgguaaucuaaucgcgccgaggggcuacuucaagauucggucugggcgcuccagcaucaugcgaucggaugcacccauaggaaaauguaacucugaaugcauuacgccuaauggcuccaucccaaacgacaagcccuuucagaaugucaacagaaucacuuauggugccuguccuagguacgugaagcaaaauacacucaaacuggcuaccgggaugcggaacgugccagagaagcagacucguggaauuuucggcgccaucgcaggcuuuauugaaaaugggugggagggaauggucgacgguugguauggcuuccgccaccagaacucagaggggagaggacaagcugccgaucuuaaaaguacacaggcggccauagaccagaucaacggcaagcugaauagguugauugguaaaaccaacgaaaaguuccaccagaucgagaaagaauuuagcgagguugaagggcggauccaagaucucgagaaguacguggaggacacgaagauugaucugugguccuauucuagcgaauuacugguagcacucgagaaucagcauaccauagaccuuacagauucagaaaugaacaaacuguucgagaagacuaaaaagcaguugcgagaaaaugcugaggacaugggcaacggaugcuuuaaaaucuaccacaagugugauaaugccugcauuggcaguauccgcaacgggaccuaugaccaugauguguacagagacgaggcucuaaauaacagguuccagauuaagggagucgaacugaaauccgguuacaaggacuggauccucuggauaucuuuugccaucucuugcuuccugcuuuguguggcacuguugggcuuuauuaugugggccugccaaaaagggaauauccgguguaacauuugcaucuga

SEQ ID NO: 132433 - RNA, 1701 nt, Artificial Sequence
  derived and/or modified sequence opt3 from hemagglutinin__InfluenzaA__AGT18753
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugaucaaaucgaggugacuaacgcgaccgaacugguacaaaauucuucaacaggugagauuugcaacaguccacaccagauccuagacggcgaaaauuguacccucauagaugcucugcuuggggacccgcagugcgauggauuucagaacaaaaagugggaccuguucguggagagaagcaaagccuauuccaauuguuaccccuaugaugucccugacuacgcaucuuugaggucgcucguggccucaagcggcacucuggaauuuaacaaugagaguuucaacuggacagguguuacccagaaugggacguccucugcuugcauccggcgcagcaacaauuccuuuuucucacgacugaacuggcucacucauuuaaacuuuaaguauccagcacugaaugugaccaugcccaacaaugagcaguucgauaaacuuuacauuuggggaguccaccauccuggcacagacaaggaucagaucuuuuuguaugcccaagcuaguggccguauuacugugagcaccaagagaucucagcaggccguaaucccaaacauaggguccaggccccggguucgcaauauuccuucaagaaucagcauuuacuggacaaucgugaaaccaggagacauccugcuaauuaacaguaccgguaaucucauagcgccgaggggcuacuucaagauccggucugggcgcuccagcauuaugcgaucggaugcacccaucggaaaauguaacucugaaugcauaacgccuaauggcuccauuccaaacgacaagcccuuucagaaugucaacagaaucacuuauggugccuguccuagguacgugaagcaaaauacacugaaacuugcuaccgggaugcggaacgugccagagaagcagacucguggaaucuucggcgccauugcaggcuuuaucgaaaaugggugggagggaauggucgacgguugguauggcuuccgccaccagaacucagaggggagaggacaagcugccgaucugaaaaguacacaggcggccauugaccagauaaacggcaaguugaauaggcucaucgguaaaaccaacgaaaaguuccaccagauugagaaagaauuuagcgagguugaagggcggauccaagaucuggagaaguacguggaggacacgaagaucgauuuaugguccuauaaaucugaacugcucguagcacuugagaaucagcauaccauugaccugacagauagcgaaaugaacaaguuguucgagaaaacuaagaaacagcuacgagaaaaugcugaggacaugggcaacggaugcuuuaagauauaccacaagugugauaaugccugcaucggcucaauucgcaacgggaccuaugaccaugauguguacagagacgaggcucugaauaacagguuccagaucaaaggagucgaacucaagagugguuacaaagacuggauucuguggaucuccuuugccauaagcugcuuccuucuguguguggcauugcucggcuuuaucaugugggccugccaaaaggggaauauucgguguaacaucugcauuuga

SEQ ID NO: 132434 - RNA, 1701 nt, Artificial Sequence
  derived and/or modified sequence opt3 from hemagglutinin__InfluenzaA__AGT18754
augaagaccaucauugcccugagcuacauacucugccuuguguucgcucagaaacugcccgagaacgacaauuccacagcaacuuuguguuuaggccaccaugccgucccuaacgggacgaucguuaagaccauuacagaugaccaaaucgaagugacuaaugcgaccgagcugguacagaacucuucaacaggagaaauuugcgauaguccacaccagauccuagacggugagaauuguacccucauagaugcucugcuuggcgacccgcagugcgauggguuucaaaacaaaaagugggaccuguucguggaaagaggaaaagccuauagcaauuguuaccccuaugaugucccugacuacgcauccuugaggucucucguggccacuucgggcacacuggaguuuaacaaugagucauucaacuggaccgguguuacgcagaaugggacuagcagugcuugcauccggcgcuccaacaauagcuuuuucucucgacugaacuggcucacccauuuaaauuuuaaguauccagcacugaacgugacaaugcccaacaaugaacaguucgauaaacuuuacauuuggggaguccaccauccuggcacugacaaggaucagaucuuuuuguaugcccaggcuuccggccguauuaccgugucaacaaagagaagucaacaggccguaaucccaaacauagggagcaggccccggguucgcaauauuccuucuagaaucuccauuuacuggaccaucgugaaaccaggagacauccugcuaauuaacucaacggguaaucucauagcgccgaggggcuacuucaagauccggagcgggcgcaguucuauuaugcgauccgacgcacccaucggaaaauguaacagcgagugcauaacuccuaauggcucgauuccaaacgauaagcccuuucagaaugucaacagaaucacauauggugccuguccuagguacgugaagcaaaauacccugaaacuugcuacugggaugcggaacgugccagaaaagcagacacguggaaucuucggcgccauugcaggcuuuaucgagaaugggugggagggaauggucgacgguugguauggcuuccgccaccagaacucugaagggagaggacaagcugccgaucugaaauccacccaggcggccauugaccagauaaauggcaaguugaacaggcucaucgguaaaacgaacgagaaguuccaccagauugaaaaagaguuuucagaaguugaggggcggauccaagaucuggagaaguacguggaagacaccaagaucgauuuauggaguuauaaugcagagcugcucguagcucuugaaaaccagcauacaauugaccugacugauagcgagaugaauaaauuguucgaaaagaccaaaaagcagcuacgagagaacgccgaggacaugggcaauggaugcuuuaaaauauaccacaagugugauaacgcuugcaucggcuccauucgcaaugggacauaugaccaugacguguacagagaugaagcccugaacaauagguuccagaucaagggagucgagcucaaaucugguuacaaggacuggauucuguggaucagcuuugcaauaucaugcuuccuucuguguguggccuugcucggcuuuaucaugugggcuugccaaaaagggaacauucgguguaauaucugcauuuga

SEQ ID NO: 132435 - RNA, 1701 nt, Artificial Sequence
  derived and/or modified sequence opt3 from hemagglutinin__InfluenzaA__AGT18756
augaagaccaucauugcccugagcuacgugcucugccuugucuucgcucagaaacugcccggcaacgacaauuccacagcaacuuuguguuuagggcaccaugccguuccuaacggaacgauagugaagaccaucacaaaugauagaauugagguaacuaacgcgaccgaacuggugcaaaauucuucaaucggugagauuugcgacaguccacaccagauccuagauggcgaaaacuguacacucauagacgcucugcuuggggauccgcagugcgacgauuuucagaauaaaaagugggaccuguucgucgagaggagcaaagccuauuccaacuguuaccccuaugaugugccugacuacgcaucuuugcggucgcucguugccucaagcggaacccuggaauuuaauaacgagaguuucaauugggcuggcgugacucaaaacgguacauccucugcaugccgccgagggagcaauuccucauuuuucagucgucugaacuggcucacccauuuaaauuuuaaguauccagcccugaacgucacgaugcccaacaaugagcaguucgauaaguuguacaucuggggagugcaccauccuggcacugacaaagaucagauuuuucuuuaugcucagagcucuggcagaaucaccguauccacaaagaggucacaacaggccguuauuccaaacaucgggagccggccccgcauaagaaauauuccuaguaggaucucuauuuacuggacuaucgugaaaccaggagacauccugcuaauuaacuccaccgguaaucucauagcgccgcggggcuacuucaagauccgcagcgggaaaucgucuauuaugcgauccgacgcacccaucggaaaguguaagucagaaugcauaacaccuaacggcaguauuccaaaugauaaacccuuucagaacgucaauagaaucaccuauggugccuguccuagguacgugaagcagagcacgcugaaacuugcuacugggaugcggaacgugccagagaagcaaacacguggaaucuucggcgccauugcaggcuuuaucgaaaaugggugggagggaauggucgacgguugguauggcuuccgccaccagaacuccgaggggagaggacaggcugccgaucugaaaucuacccaagcggccauugaccagauaaauggcaaguugaacaggcucaucgguaaaacuaaugaaaaguuccaccagauugagaaggaauuuagcgagguugaagggcggauccaggaucuggagaaauacguggaggacacaaagaucgauuuauggucauauaaaagugaacugcucguagcacuugagaaccaacauaccauugaccugacggauuccgaaaugaacaaguuguucgagaaaaccaagaagcagcuacgagaaaaugcugaggacaugggcaacggaugcuuuaaaauauaccacaagugugauaaugccugcaucggcagcauucgcaacgggacauaugaccaugacguguacagagaugaggcucugaauaacagguuccagaucaaaggagucgaacucaagucugguuacaaagacuggauucuguggaucucauuugccauaaguugcuuccuucuguguguggcauugcucggcuuuaucaugugggccugccagaaggggaauauucgguguaacaucugcauuuga

SEQ ID NO: 132436 - RNA, 1701 nt, Artificial Sequence
  derived and/or modified sequence opt3 from hemagglutinin__InfluenzaA__AGT18757
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggagcaaagccuauuccaacuguuaccccuaugaugucccugacuacgcaucuuugcggucgcucguggccucaagcggaacccuggaauuuaauaacgagaguuucaauugggcuggcguuacucaaaacgguacauccucugcaugccgccgagggagcaauuccucauuuuucagucgucugaacuggcucacccauuuaaauuuuaaguauccagcccugaacgugacgaugcccaacaaugagcaguucgauaaacuuuacauuuggggaguccaccauccuggcacugacaaggaucagaucuuuuuguaugcucagagcucuggcagaauuaccguguccacaaagaggucacaacaggccguaaucccaaacauagggagccggccccgcauuagaaauaucccuaguaggauuucuaucuacuggacuaucguuaaaccaggagacauucugcuaauaaacuccaccgguaaucucaucgcgccgcggggcuacuucaagauucgcagcgggaaaucgucuaucaugcgauccgacgcacccauaggaaaguguaagucagaaugcauuacaccuaacggcaguaucccaaaugauaaacccuuucagaacgugaauagaaucaccuauggugccuguccuagguacgucaagcagagcacgcugaaacuugcuacugggaugcggaacgugccagagaagcaaacacguggaauuuucggcgccaucgcaggcuuuauugaaaaugggugggagggaaugguggacgguugguauggcuuccgccaccagaacuccgaggggagaggacaggcugccgaucugaaaucuacccaagcggccauagaccagaucaauggcaaguugaacaggcucauugguaaaacuaaugaaaaguuccaccagaucgagaaggaauuuagcgaggucgaagggcggauccaggaucuggagaaauacguugaggacacaaagauugauuuauggucauauaacgcagaacugcucguggcucuugagaaccaacauaccauagaccugacggauagugaaaugaauaaauuguucgagaagaccaaaaagcagcuacgagaaaacgccgaggacaugggcaauggaugcuuuaagaucuaccacaaaugugauaacgcuugcauuggcuccauccgcaaugggacauaugaccaugacguauacagagaugaggcccugaacaauagguuccagauuaagggaguggaacucaaaagcgguuacaaggacuggauccuguggauaucuuuugcaaucucaugcuuccuucugugugucgccuugcucggcuuuauuaugugggcuugccagaaagggaacauccgguguaauauuugcaucuga

SEQ ID NO: 132437 - RNA, 1701 nt, Artificial Sequence
  derived and/or modified sequence opt3 from hemagglutinin__InfluenzaA__AGT18758
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggagcaaagccuauuccaacuguuaccccuaugaugucccugacuacgcaucuuugcggucgcucguggccucaagcggaacccuggaauuuaauaacgagaguuucaauugggcuggcguuacucaaaacgguacauccucugcaugccgccgagggagcaauuccucauuuuucagucgucugaacuggcucacccauuuaaauuuuaaguauccagcccugaacgugacgaugcccaacaaugagcaguucgauaaacuuuacauuuggggaguccaccauccuggcacugacaaggaucagaucuuuuuguaugcucagagcucuggcagaauuaccguguccacaaagaggucacaacaggccguaaucccaaacauagggagccggccccgcauuagaaauaucccuaguaggauuucuaucuacuggacuaucguuaaaccaggagacauucugcuaauaaacuccaccgguaaucucaucgcgccgcggggcuacuucaagauucgcagcgggaaaucgucuaucaugcgauccgacgcacccauaggaaaguguaagucagaaugcauuacaccuaacggcaguaucccaaaugauaaacccuuucagaacgugaauagaaucaccuauggugccuguccuagguacgucaagcagagcacgcugaaacuugcuacugggaugcggaacgugccagagaagcaaacacguggaauuuucggcgccaucgcaggcuuuauugaaaaugggugggagggaaugguggacgguugguauggcuuccgccaccagaacuccgaggggagaggacaggcugccgaucugaaaucuacccaagcggccauagaccagaucaauggcaaguugaacaggcucauugguaaaacuaaugaaaaguuccaccagaucgagaaggaauuuagcgaggucgaagggcggauccaggaucuggagaaauacguugaggacacaaagauugauuuauggucauauaguuccgaacugcucguggcacuugagaaccaacauaccauagaccugacggauagcgaaaugaacaaauuguucgagaagaccaaaaagcagcuacgagaaaaugcugaggacaugggcaacggaugcuuuaagaucuaccacaaaugugauaauacaugcauuggcucuauccgcaacgggacuuaugaccaugacguauacagagaugaggcccugaauaacagguuccagauuaagggaguggaacucaaaucagguuacaaggacuggauccuguggauaaguuuugcuaucagcugcuuccuugucuguguggcccuguugggcuuuauuaugugggcaugccagaaagggaauauccgguguaacauuugcaucuga

SEQ ID NO: 132438 - RNA, 1701 nt, Artificial Sequence
  derived and/or modified sequence opt3 from hemagglutinin__InfluenzaA__AGT18759
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggagcaaagccuauuccaacuguuaccccuaugaugucccugacuacgcaucuuugcggucgcucguggccucaagcggaacccuggaauuuaauaacgagaguuucaauugggcuggcguuacucaaaacgguacauccucugcaugccgccgagggagcaauuccucauuuuucagucgucugaacuggcucacccauuuaaauuuuaaguauccagcccugaacgugacgaugcccaacaaugagcaguucgauaaacuuuacauuuggggaguccaccauccuggcacugacaaggaucagaucuuuuuguaugcucagagcucuggcagaauuaccguguccacaaagaggucacaacaggccguaaucccaaacauagggagccggccccgcauuagaaauaucccuaguaggauuucuaucuacuggacuaucguuaaaccaggagacauucugcuaauaaacuccaccgguaaucucaucgcgccgcggggcuacuucaagauucgcagcgggaaaucgucuaucaugcgauccgacgcacccauaggaaaguguaagucagaaugcauuacaccuaacggcaguaucccaaaugauaaacccuuucagaacgugaauagaaucaccuauggugccuguccuagguacgucaagcagagcacgcugaaacuugcuacugggaugcggaacgugccagagaagcaaacacguggaauuuucggcgccaucgcaggcuuuauugaaaaugggugggagggaaugguggacgguugguauggcuuccgccaccagaacuccgaggggagaggacaggcugccgaucugaaaucuacccaagcggccauagaccagaucaauggcaaguugaacaggcucauugguaaaacuaaugaaaaguuccaccagaucgagaaggaauuuagcgaggucgaagggcggauccaggaucuggagaaauacguugaggacacaaagauugauuuauggucauauaguuccgaacugcucguggcacuugagaaccaacauaccauagaccugacggauagcgaaaugaacaaauuguucgagaagaccaaaaagcagcuacgagaaaaugcugaggacaugggcaacggaugcuuuaagaucuaccacaaaugugauaaugccugcauuggcucuauccgcaacgggacauaugaccaugacguauacagagaugaggcucugaauaacagguuccagauuaagggaguggaacucaaaucagguuacaaggacuggauccuguggauaaguuuugccaucagcugcuuccuugucuguguggcacuguugggcuuuauuaugugggccugccagaaagggaauauccgguguaacauuugcaucuga

SEQ ID NO: 132439 - RNA, 1701 nt, Artificial Sequence
  derived and/or modified sequence opt3 from hemagglutinin__InfluenzaA__AGT18760
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggaacaaagccuauagcaauuguuaccccuaugaugucccugacuacgcauccuugcggucucucguggccucgucaggaacccuggaauuuaacaaugagagcuucaacugggcuggcguuacucaaaaugguacaaguuccgcaugccgccgagggucuaacagcuccuuuuucucacgucugaauuggcucacccauuuaaacuuuaaguauccagcccugaacgugacgaugcccaauaacgagcaguucgauaaacuuuacauuuggggaguccaccauccuggcacugacaaggaucagaucuuuuuguaugcucagaguagcggcagaauuaccgugucuacaaagaggucccaacaggccguaaucccaaauauagggucacggccccgcauuagaaacaucccuagcaggauuaguaucuacuggacuaucguuaaaccaggagacauucugcuaauaaauucuaccgguaaccucaucgcgccgcggggcuacuucaagauucgcuccgggaaaagcucgaucaugcgaucugacgcacccauaggaaaguguaaguccgaaugcauuacaccuaauggcucaaucccaaacgauaaacccuuucagaaugugaacagaaucaccuauggugccuguccuagguacgucaagcagaguacgcugaaacuugcuacugggaugcggaaugugccagagaagcaaacacguggaauuuucggcgccaucgcaggcuuuauugaaaacgggugggagggaaugguggacgguugguauggcuuccgccaccagaauagcgaggggagaggacaggcugccgaucugaaauccacccaagcggccauagaccagaucaacggcaaguugaauaggcucauugguaaaacuaacgaaaaguuccaccagaucgagaaggaauuuucugaggucgaagggcggauccaggaucuggagaaauacguugaggacacaaagauugauuuauggagcuauaaaucagaacugcucguggcacuugagaaccaacauaccauagaccugacggauagugaaaugaauaaguuguucgagaaaaccaagaagcagcuacgagaaaacgcugaggacaugggcaauggaugcuuuaaaaucuaccacaagugugauaacgccugcauuggcuccauccgcaaugggacauaugaccaugacguauacagagaugaggcucugaacaauagguuccagauuaaaggaguggaacucaagagcgguuacaaagacuggauccuguggauaucuuuugccaucucaugcuuccuugucuguguggcacuguugggcuuuauuaugugggccugccagaaggggaacauccgguguaauauuugcaucuga

SEQ ID NO: 132440 - RNA, 1701 nt, Artificial Sequence
  derived and/or modified sequence opt3 from hemagglutinin__InfluenzaA__AGT18761
augaagaccaucauugcccugagcuacauacucugccuuguguucgcucagaaacugcccggcaacgacaauuccacagcaacuuuguguuuagggcaccaugccgucccuaacggaacgaucguuaagaccauuacaaaugauagaaucgaggugacuaacgcgaccgaacugguacaaaauucuucaauuggugagaucugcgacaguccacaccagauacuagauggcgaaaacuguacacucaucgacgcucugcuuggggauccgcagugcgacgauuuucagaauaaaaagugggaccuguucguggagaggagcaaagccuauuccaacuguuaccccuaugaugucccugacuacgcaucuuugcggucgcucguggccucaagcggaacccuggaauuuaauaacgagaguuucaauugggcuggcguuacucaaaacgguacauccucugcaugccgccgagggagcaauuccucauuuuucagucgucugaacuggcucacccauuuaaauuuuaaguauccagcccugaacgugacgaugcccaacaaugagcaguucgauaaacuuuacauuuggggaguccaccauccuggcacugacaaggaucagaucuuuuuguaugcucagagcucuggcagaauuaccguguccacaaagaggucacaacaggccguaaucccaaacauagggagccggccccgcauuagaaauaucccuaguaggauuucuaucuacuggacuaucguuaaaccaggagacauucugcuaauaaacuccaccgguaaucucaucgcgccgcggggcuacuucaagauucgcagcgggaaaucgucuaucaugcgauccgacgcacccauaggaaaguguaagucagaaugcauuacaccuaacggcaguaucccaaaugauaaacccuuucagaacgugaauagaaucaccuauggugccuguccuagguacgucaagcagagcacgcugaaacuugcuacugggaugcggaacgugccagagaagcaaacacguggaauuuucggcgccaucgcaggcuuuauugaaaaugggugggagggaaugguggacgguugguauggcuuccgccaccagaacuccgaggggagaggacaggcugccgaucugaaaucuacccaagcggccauagaccagaucaauggcaaguugaacaggcucauugguaaaacuaaugaaaaguuccaccagaucgagaaggaauuuagcgaggucgaagggcggauccaggaucuggagaaauacguugaggacacaaagauugauuuauggucauauaguuccgaguuccugguggcacucgaaaaccaacauaccauagaccuuacggauagcgaaaugaacaaacuguuugagaagaccaaaaagcaguugcgagaaaaugcugaggacaugggcaacggaugcuucaagaucuaccacaaaugugauaaugccugcauuggcucuauccgcaacgggacauaugaccaugacguauacagagaugaggcucuaaauaacagguuucagauuaagggaguggaacugaaaucagguuacaaggacuggauccucuggauaaguuucgccaucagcugcuuucuggucuguguggcacuucugggcuucauuaugugggccugccagaaagggaauauccgguguaacauuugcaucuga

SEQ ID NO: 132441 - RNA, 1701 nt, Artificial Sequence
  derived and/or modified sequence opt3 from hemagglutinin__InfluenzaA__AGT37102
auggaggccaagcuggugguccucuucugcgcuuuuaccacacuuaaagcagacaucauuuguguuggcuaccacgccaacaauagcacugauacgguggacaccauaauggaaaagaacguaacagugacucauuccgucaaucuguuggagaacucucacaaugggaaauuaugcucacugaacggaaaggcgccccuacagcucgguaauuguaacguggcuggcuggauccuggggaauccugaaugcgaucuucuguugaccgccaacaguuggagcuauauuaucgagacauccucuucgaaaaauggaaccuguuacccaggcgaguucucagacuaugaggagcucagagaacugcugagcacuguuaguuccuuugagagguucgaaauuuuuccgaaggcaacaucuuggcccaaccaugagaccacgaagggugccacuaucgcuugcagccacuccggggcaucaaguuucuaccggaaucucuuauggauagugaaaaagggaaacagcuauccuaaaaucucuaaguccuacaccaauaaccgcggcaaagagguccuggugauuuggggcguacaucacccacccacagauucaagccaacaggcccuuuaucagaacacucacaccuacaucaguguugggucuuccaaguacuaucagcgauuuacaccuguggucgcugcccguccaaagauuagagaacaagagggaaggaugaauuacuauuggaccuugcuggaacagggugacacgaucacuuucgaggcgacaggcaaccuaauagcacccugguacgccuuugcucucgauauggggagcucgucuggaauuaugguguccgacgccccugugcauaauuguaccacuaaaugccagacaccacacggcgcacugaagucaaaccuuccguuccagaauguccaucccaucaccauuggugaauguccuaaauauguuaagaguacgcaacugcggauggcuaccggguugcgcaacaucccaagcauccaguccagaggacucuuuggcgccauugcgggcuucauagaagggggauggacagguaugaucgauggcugguacggguaucaccaccagaaugagcagggaucuggcuacgccgcagaccagaaaagcacucaaauugcuaucgaugguauaucaaacaaggugaauaguauuaucgaaaagaugaacguacaguuuaccuccguggggaaagaguucaaugaccuggaaaagaggaucgagaacuuaaauaaaaaggucgaugacggcuuccuggacguguggacauacaacgccgaacuccuuguucuguuggagaaugagcggacucuagauuuucaugacuucaacgugaaaaaccuguaugaaaaggucaaaagccaacuccgcaauaacgcuaaggagauuggaaauggcugcuuugaguucuaccacaagugugauaacgaaugcauggaaaaugugaaaaacgggaccuauaauuaccccaaguauucugaggagucaaaacugaaccgagaaaagaucgacggaguaaaacuugagaguauugguguucaucagauacuggccaucuacagcacaguggcauccucuuugguccuccuggugucguuaggcgccauuagcuuuuggaugugcuccaaugggucacugcaguguagaaucugcaucuga

SEQ ID NO: 132442 - RNA, 1701 nt, Artificial Sequence
  derived and/or modified sequence opt3 from hemagglutinin__InfluenzaA__AGU01877
augaaggccauccuggugguccuccuuuacaccuucgcuacagcaaacgccgacacucugugcauuggcuaucacgcgaauaacagcacggauaccguugacacaguguuggagaaaaauguaacugugacccauuccgucaacuuacuggaagauaagcacaaugggaaacuauguaagcucagaggaguggcuccccugcaucuugguaaaugcaacauagccggcuggauccuggggaauccugagugugaaucuuugucaacagcaaguagcugguccuacauuguugagaccucuucgucagacaacggaacuugcuauccaggcgauuuuaucaauuacgaagaacucagggagcagcugagcaguguguccucuuucgaacgguuugagauuuucccgaagacaagcuccuggcccaaccacgacucaaauaagggugucaccgccgcuuguccucaugcaggggccaaaaguuuuuauaagaaccugaucuggcucgugaaaaagggaaauagcuacccaaaauuaucuaaguccuauauaaacgauaagggcaaagaaguacugguucuuuggggcauccaccaccccucaacgacuaccgaccaacagagcuuguaccagaaugcugaugccuacguguucgucgggacaagucgcuauucuaagaaauuuaagccugagauugcgauccgaccaaaagugcgugaccaggagggaagaaugaacuacuauuggacucugauugaacccggugauaagaucaccuucgaggcaacaggcaaccuaguggucccuagguacgccuuugcuauggaacggaaugccggguccggaauaauuaucagcgacaccccaguucaugauugcaacacgacuugucaaacaccggagggcgcaauuaauaccucgcuccccuuccagaacauccacccuaucacuauugguaaaugcccaaaguaugugaagucuacaaaacugcgccuugcuaccgggcugagaaauguacccuccauacagucaaggggauuguuuggcgccaucgcgggcuucauugaagggggauggacggguaugguggacggcugguacggguaucaucaccagaacgagcaaggaaguggcuacgccgcagaccucaagagcacccagaaugcuaucgauaaaauaacaaacaaggucaauuccgugauugagaaaaugaacacucaguuuaccgccguugguaaggaguucaaucaccuggagaagcggaucgaaaacuuaaauaaaaagguggacgauggguuccuggacaucuggacauacaacgcugagcuccuuguccuguuggaaaaugagcgcacucuagauuaucaugacucuaacgugaaaaaccuguacgagaagguacgaaaucagcucaaaaacaaugccaaggaaauuggcaacggauguuuugaguucuaucacaagugcgauaauaccuguauggaaagcguuaaaaacggcacauacgacuauccuaaguacucagaggaagcaaaacugaauagagagaagaucgauggggugaaacuugagaguaccaggauuuaucaaauacuggccaucuacuccacugucgcuagcucuuuggugcucgucgugucacugggagcgauuaguuuuuggaugugcagcaacgguuccuuacagugccggaucuguaucuga

SEQ ID NO: 132443 - RNA, 1701 nt, Artificial Sequence
  derived and/or modified sequence opt3 from hemagglutinin__InfluenzaA__AGU01878
augaaggccauccugguggucaugcucuacacccuugcuacagcaaacgccgacacucugugcauuggcuaucacgcgaauaacagcacggauaccguugacacaguguuggagaaaaauguaacugugacccauuccgucaacuuacuggaagauaagcacgacgggaaacuauguaagcucagaggaguggcuccccugcaucuugguaaaugcaauauagccggcuggauccuggggaacccugagugugaaucuuugucaacagcaaguagcugguccuacauuguugagaccucuggaucggauaauggcacuugcuauccaggugacuucaucgauuacgaggaacucagggagcagcugucaagcgugaguuccuuugaacgguucgagauuuuuccgaagacaucuagcuggcccaaccacgacuccaauaagggggucaccgccgcuuguccucaugcaggagccaaaggcuucuauaagaaccugaucuggcucgugaaaaagggcaauucauacccaaaauuaaguauaagcuauaucaacgauaaggggaaggaaguacugguucuuugggguauucaccaccccucuacgacugcugaccaacaguccuuguaccagaaugccgauaccuacguguuugucggaacaucacgcuauagcaaaaaguucaaaccugagaucgcgauucgaccaaaggugcgugaccaggagggcagaaugaacuacuauuggacucugguggaacccggggauaaaaucaccuuugaggcaacaggaaaucuagucguuccuagguacgccuucgcuauggaacggaacgccggcagugguauaauuaucucugacaccccagugcaugacugcaacacgacuugucaaacaccgaagggggcaauuaauaccucccuccccuuucagaacauccacccuaucacuauuggaaaaugcccaaaguauguaaagagcacaaaacugcgccuugcuaccggccugagaaaugugcccucgauacagucuaggggcuuguucggggccaucgcgggauuuauugaggguggcuggacggggauggucgauggaugguacggcuaucaucaccagaacgaacaagguuccggguacgccgcagaccucaagucaacccagaaugcuaucgauaaaauaacaaacaaggugaauaguguuauugagaaaaugaacacucaguucaccgccgugggcaaggaguuuaaucaccuggaaaagcggaucgagaacuuaaauaaaaaggucgacgauggauuccuggacaucuggacauacaacgcugaacuccuugugcuguuggagaaugaacgcacucuagauuaucaugacagcaacguaaagaaucuguacgagaagguucgaaaccagcucaaaaacaaugccaaggagauuggcaacggguguuucgaauuuuaucacaagugcgauaauaccuguauggaguccgugaaaaacggaacauacgacuauccuaaguacucugaagaggcaaaacugaauagagaagagaucgauggugucaaacuugagagcaccaggauuuaucaaauacuggccaucuacucaacugcugcgaguuccuuggugcucgucgugagccugggcgcaauuucuuucuggaugugcucaaacgggaguuuacagugccggaucuguaucuga
